United States Patent 7,745,391 (HUMAN THROMBOSPONDIN POLYPEPTIDE) - sequence listing, part 230

SEQ ID NO: 610641 - DNA, 732 bp, Homo sapiens
  misc_feature (22)..(22): n is a, c, g, or t
  misc_feature (109)..(109): n is a, c, g, or t
  misc_feature (318)..(318): n is a, c, g, or t
  misc_feature (420)..(420): n is a, c, g, or t
  misc_feature (427)..(427): n is a, c, g, or t
  misc_feature (438)..(438): n is a, c, g, or t
  misc_feature (518)..(518): n is a, c, g, or t
  misc_feature (530)..(530): n is a, c, g, or t
  misc_feature (565)..(565): n is a, c, g, or t
  misc_feature (571)..(571): n is a, c, g, or t
  misc_feature (576)..(576): n is a, c, g, or t
  misc_feature (578)..(578): n is a, c, g, or t
  misc_feature (585)..(585): n is a, c, g, or t
  misc_feature (590)..(590): n is a, c, g, or t
  misc_feature (595)..(595): n is a, c, g, or t
  misc_feature (657)..(657): n is a, c, g, or t
  misc_feature (664)..(664): n is a, c, g, or t
  misc_feature (669)..(669): n is a, c, g, or t
  misc_feature (674)..(674): n is a, c, g, or t
  misc_feature (685)..(685): n is a, c, g, or t
  misc_feature (704)..(704): n is a, c, g, or t
  misc_feature (721)..(721): n is a, c, g, or t
agtcgctgacacccccccattncctgggcagaggagggcagtggggcccagaaaaaaggggggccagcctcccaggaggactggggcctgccctgctggggtcactgcngaccaggcctcagccttccttccagccccaccctctcccctgcagtttgtttaaaagtggagctgcaaaaattaaataaaaataaaaacaaacccctgagtggtaaaaaaccaaattaaaaacccccctccgtgtcaacaggtcctaaagccagtctggcgggacaggcaggcggggcaggcgggggaggcggctggtggagcgcagcnggtgctgcgagtgccgggctcaccgtcagactcctcctcctccttctcagggcccaggtggccctgggtgcctggtcgcttcaggatggcgctgtactcganggctgtngactctgcctncaggaccacctccaccaggctgaagacggtgatgactgtgcagagcgcagccgtgaggggacaaggatgggagggctgangtcgaggcgcantctgctccatccctgcagcaggaccctgggccctncttcgnctctngnagctctnctcgnctgtntgtaggggccctcagagatgcctggtagcagatggagtagagatctgagcgctccaggtatnaacacanctganggctnggtcgcgtcanggcaatgtggggaaacgtncagaaattctgggtgtnactcatagctt

SEQ ID NO: 610642 - DNA, 430 bp, Homo sapiens
aggagaagggcgccagatacaaccttgtccatcgaggcggcactgtacatttggggaccccatcgtttaaggccatgttactataatcgcattttatacgaaaaggcatggtgacccatgaccagaggtgattctatggttatgtgtgccaggctggctggctggaactggtgtggctatcattattggatggcgacgaccgcgtgctactggctgctagtgttcctgacagttgatagtgggatgacttatgacacttgcccagcctggctctgcctcacatttattcattccgtcccctgggttaacaatgttccctgcgacacctgatacgatgggacctctgtcttcttcaacagaggacttgatttttcgtatttcgcactgtggactctgggcactgtttggcctctgggccactgtttgcgct

SEQ ID NO: 610643 - DNA, 291 bp, Homo sapiens
ctggaatgggaatgattcacaagagtcatctgagtggggatctgcaccactgcactccgagcctgtgtgacagagtgagaccctgtcttaaaaaaaaaaaaaaaaaggttatcctaaggctttactacgacacgtctaagtgtgggatttctttttattgggccccattggggaattgggtctccccaaggtctggaaaatggatatttcatccccttcgtggaaacaacattcaggccatttatctcctttcagcattggtctttcccctatcattctaagggttggtcg

SEQ ID NO: 610644 - DNA, 415 bp, Homo sapiens
tgatgcacagcatcctcatctacctccatctggatctgcttcctcttgaatctagattgacattaggtgtatccacacggcatgattgatttatttcagtaaccggaaagcttccttcatatgtttaggttggacctcatcacagcagtgcatccgagccatagcttcagagagacgaatcatgctctcaagctgtcgccctgttttcctccatgaacacttgagtcactccagaaccatctctctggcggagatgtttatattgctccacaatgaagtcctctgactctttggaaatcttgggtttaaactgtcttgcaaagagaagatatcttctgatatcatcgagggaatagacacgatcaattgattcctcaattcttgaatgcaaatctactatgcgcctggcaatggc

SEQ ID NO: 610645 - DNA, 233 bp, Homo sapiens
  misc_feature (106)..(106): n is a, c, g, or t
ccatatattccaccttaggaaaatactggggcgtatattctattaaaactcaaaagagttgaacacaaaagagaaatacattggatccagacaagaggatatcctnatagaggagatagattaagggaattcctaaaaagaaagctatacatcaattaaacctggagaggaaccagtgcagttggtagcaagaaactagagatatttatctagtcatttataatgatgttagc

SEQ ID NO: 610646 - DNA, 431 bp, Homo sapiens
  misc_feature (18)..(18): n is a, c, g, or t
  misc_feature (161)..(161): n is a, c, g, or t
  misc_feature (163)..(164): n is a, c, g, or t
cattttgggataatgctngaaaatgtaagagcatccctggtccagagctcacatacactgcccagtccagcaaatgccctacagcttaatttccctctctggaagaccatccttcagcattgcttttaccaagagaactctgttttcctgggacagacaananngcacagccttagggcatccttggtctcattatgccagtgggaatgaatgtgaccctttggatgaagtcatttggcaacagcatctgggacataacattgactgtcatacccttccatttagacacacttttgggactcactataaagaaaagattcgaaatgcagaaaacatttgatatacaaagatattcagtgagatagtgcttaaaactgaaaacacacacaactgccaaagcaatagagaaataattaaatcaatcaacaatg

SEQ ID NO: 610647 - DNA, 457 bp, Homo sapiens
gatcactgcaagctccgcctcctaggttcagaccattctcctgcctcagcttcccaggtagctgggactgcaggcgcccgccactgcgcccggctaattttttgcatttttagtggagacagggtttcaccgtgttagccaggatggtctcgatctcctgatctgcccgcctcagcctcccaaagtgctgggattacaggcatgagccaccgcgcccggcccaggcacttaatttttgtgttgacttagtaacaagtgcaactattacgggacgatggagtcaattggcttcatgtgactgtagtgggaaatggtcaagagggaatatgtcaggaatgttggagttggaaacgggaagtgctatggtggagagacaagattactctggccgggctgtaaaggacggctacaatgggaggctgaaggcagaaccaagaaaatgggagtgagtatggaa

SEQ ID NO: 610648 - DNA, 529 bp, Homo sapiens
caaaatatctggattttgatgtaacacaatacaaagataattacatcctaattttatgttaacacatatgacaagttattacaggaaaatatttgacatgcatttgcaaataaaacaaagtttgttcatttatattttacttaagacctgtgaccagttttatcttgtcacaagaatgaatcaagggacaaaggtaagttccacgctccccaaccactgggtgccaatcccccttcaatgtactccttcttccccagagtgcagaagcgtctgaagacagttatgacatggacacatgcatgatctattatacgtaatcacaaaagctgattctgtcatcactgcatcttgtctcatcattaggagcgaatggctggggggacggtggcacagtcagcctccttcaaagttttgtcgattacgggtctatataccagagtgacctttccagtgccgacgtgcacataagacaaggtgtgcttcctccagtgcacctcagagggcttctctgttgcaccttgataggcct

SEQ ID NO: 610649 - DNA, 189 bp, Homo sapiens
cgcgattcggcttcatcttggagtcgcttgtgggttaattgagttaaaagatgagcctaagggaaccctttactcaaataacatgaaagtgaaaaaaaaaacaggggtcaaattagttttaaaaggcaaacctcaggaggtaaaaagtgaccaaattactacctttaaattccctgagtgaagcaggaa

SEQ ID NO: 610650 - DNA, 776 bp, Homo sapiens
actctttttaggtacagtaatctaatatccaaagtcttggactcagctaaagagggtatttaccttaaaaaaaaaaaaaaacaagattccatcttttgatccataatggctggctgggcggccggggaatcaagacaaccttagttcacttgggtattcccataatccttgtctttcagggttgacctgttacagctgcttaaacacatcactgtatgctaggtattgcctaccttcacttacttttctaaccttgccgatgtgctgccttcataaactgggtatatctccgccacacttctacgtaaggcccccaatgcagtcacacaactgtgtatcactgactaaacactcgccacttctgccatgtccagtcattcatctttcccagtcacgacgtgggtcatttaagcatatctgggccagcacctaaagtcaatccataaaccttctaccacgtccccaggggtcaacaatttcaccatcattgtgcccataggcacactccagttaaattagcacaccaaggctaacgtcttctcaaaaaatactatgctagcactattgcagaccccaacgatctcgaaggcattgaactcctaaagcaatagcgctgtagagggttcacccctaacatctggcgtcacatctggtagcaggtcctacattctcacgcaaaagcactaaggttctaaccgcgacattccttcagaaacggttgtgaagcccattaactctcataatccccgtgtgacactttagggcaaatcctcaaa

SEQ ID NO: 610651 - DNA, 195 bp, Homo sapiens
  misc_feature (42)..(42): n is a, c, g, or t
  misc_feature (108)..(108): n is a, c, g, or t
  misc_feature (116)..(116): n is a, c, g, or t
  misc_feature (129)..(129): n is a, c, g, or t
acctttgccgcggggcctgctgggacttgtagttgcctaganagggcaccaccctgcacttccggacccgccgctggaggcccgtgaggcgttggtgtcccctggatnttacatancccaacgccgggnttttgcaatggggcccaggggaggccttgagcttggatttacacttgtaataaagactcctgtgga

SEQ ID NO: 610652 - DNA, 326 bp, Homo sapiens
ggatatgtaccacattttatttattcattcatctgtcgatggacacttaagttgctttcaaatcttggctattttactcctgtaatcccagcactttgggaggctgaggtggtcagaagtttgagaacagcctggccaacatggtgaaacctcgtctctactaaaaatacaaaaattagccaggcattgtggcaggtgcctgtaatcccagctagtcaggagactgaggcaggagaatcactggaattcataaggtggaagttctactgggccattgattcaccactgcacaccagcctgagtgacaactccatctcaaaaaaaaa

SEQ ID NO: 610653 - DNA, 836 bp, Homo sapiens
  misc_feature (453)..(453): n is a, c, g, or t
  misc_feature (629)..(629): n is a, c, g, or t
caagtaggcggctatggtatatatacgcctcacactcattctcaaccccctgacaaaacacatagcctactcgttccttgtattatcccgtatgaggcatagttatgacgagctccatcgtgcctaggatgaacagacctagaatcgctcattgcatatcgtcttcaattcatgccagcataggccctcgtagttaaacaggccattctcattccagataccccgctgaagcttcaccgggcgcatgtccattctcactacactcgcgctcatcggatctgtacagtccctcagttactattctgccttaggcaaatttctgaactagtgatacgcgattctcgcatggtcggcactgagtagatccatgctctccaatgggactgtcatagagcgtacatacattcgctcgatctgaaatatggctgtgttctggagtgtactatactcagnctagagggcactcagcttaatccatgcgtaccttgaggccgcccgcgatgttattaacctctcacttggggagaaaactcctctgttggcttagtagaccagcgttactccctggatctaaatcatcgaacttcgtccgtactatgattcaggacgttcaagcgatagacttaggntcgatcatgtcccattattacggtccgcatctctacgagttattatactcatcgaagcgacaatagtggggggccacgattgcacctccaacaacgatttgaacatatcattaaagaggacccttcatttctagcacgtagaaaaaggaccgctgctattgttctatactgccgtattgccgccgagttctccctccttattacgtc

SEQ ID NO: 610654 - DNA, 548 bp, Homo sapiens
ggagagagagagagaactagtctcgagttatttttcatttaatgggcttggggagggaggtaggtgttactggtgttcactatttagtggggtaataaggaatatgtaaggagtatgggggtaattatggtggcaaccatacggtagttattcagtgggggcattttgtgtaagggcgcaaacggctgcaacacagagttggtgatagcgcctaagcatagtgtcagagttgggataagggggctatttctcgcatagggggtggaagcggatgagataaaaagatcccggactagccaccatattagcgccttgagtgggacgtagcggcctgaaaaccgggggatgagggcgcctgcaacacgtgcgcatagcagggagaattccaaggggtgcttggaagcaccgtaaatagggcgctcagcttcgcgccatagcctagaccgcataagacacgggacgcgccctaaagcagagggggcgaccgaaggctcagagcattaggcagtcaaaacacggggcaaacaactgaaagcagggcaccacaa

SEQ ID NO: 610655 - DNA, 246 bp, Homo sapiens
  misc_feature (124)..(124): n is a, c, g, or t
cagtcgaagcccaaagaccctgtcaaagacacaagctggatcgaaaccctgaacaacacggggcgattctggctattgttcctgggcatcatggccactctcgtcggtggcaccatggtagcgngctgggatgaatggaaggccgaagacgagcccgagaaatcgagcaatctggttggagccggcggtcgcggcggcagcggcaccacatcggtggaaacgcgggcagaagaccgcaaaaccttc

SEQ ID NO: 610656 - DNA, 173 bp, Homo sapiens
  misc_feature (150)..(150): n is a, c, g, or t
gacacagctcccaggaacctccacggccatggcactaggcagagggaatcctctatcacctcctgctgttcacctcgagctgcgacgagacgacgagggcgtgcgcgcacctgccgagatgcttccctgtgcaagaggtttgcagtaggnattggctactggcatgaccctac

SEQ ID NO: 610657 - DNA, 176 bp, Homo sapiens
ctagctcggtaccctggaaattaagggactcagaataaccaaaataatcttgacaaacagtcaagttggaatgctcacacttcctgatttcaaaacttactacaaagctacaataataaagacagtgtgctactggcatctgggtagacatacagatcaatggaatagaactgaga

SEQ ID NO: 610658 - DNA, 543 bp, Homo sapiens
  misc_feature (140)..(140): n is a, c, g, or t
  misc_feature (508)..(508): n is a, c, g, or t
  misc_feature (510)..(511): n is a, c, g, or t
agagacctgaagactacttgagactgttgcttgaaagcagtgtcggcagcacccggacctggacttgtgacgctgatggatttcagctctaaagagaaacccctgtctattcccagacagagagaaagagcagaagagcngattacctgcaaaggacagacttaggtgggcgcccctgtgccagagggcagcggggaggccgggtgcatgctgagcccgagtgtgtgtgtatgtgtacaggcaattgcaaaggcgtagaaaagctttagacaggtatccaaggaaaagctgagtgttgattccctctgggacccagacttctgctccttggctttccctgatcgtgactgtttttctcacggccacgttcctcctgctaacctgctgtgtttacataccaactagatattcgtgggttggagggtgggatagggaagatactttttctttctgtactaatgggaatacactgtctatagtacctgcagcttgtaagtttatttgaaanannctgaaatataaaagcgtaaatttcaaaaaaaa

SEQ ID NO: 610659 - DNA, 107 bp, Homo sapiens
ccggcatcagctggccagatggccggcggcgcggtgctgaccgaaaccgtgttcgcctggccgggcatcggccggctgatgttcgatgcgctgctgcagcgcgacta

SEQ ID NO: 610660 - DNA, 863 bp, Homo sapiens
catggtggctcacgcctgtaatcccagcacttgggaggctgaggcaggcggatcatgaggtcagaagatcgagaccatcgtggctaacatggtgaaaccccgtctctactaaaaatacaaaaaattagccagatgtggtggcgggcgcctgtagtcccagctacttggaggctgaggcaggagaatagcgtgaacccgggaggtggagcttgcagtgagccgagatcccgccactgcactccagcctgggcgacagagcaagacttgtctcaaaaaataaataaattaattaatcagagatgaatacgaagacattacaaccaaatactgcagaaatttaacaggactcattagaggctgctataagcaaatatatgccaataaatgggaaaacctagaggaaatgggtaaatttctaacttaacaacttaccaagactgaaccatgaagaaatccaaaacctgaacagaccaataacaagtaacgagattgaagccgtaataaaaagtctcccaaagaaagaaaagaaagagacacgaaattaaagaaaaggccaggacccagtgcttcactgctgagtttaaccagatacttaaagaagaactaatactaaattctactcatattattctgaaaataaggtggagagaatacttccaaatcattctaccaggtcagtgtcattctgtatcaaaacagaccaaggaccctcacagaccagagaacaaacaaaacaatgggggcggcccgccccagaagtttaaaacatcgttgggcgggccaggtagaaatggccaacggcccgagagaaccgcgacgccggggtgggttccaccaaaaacgccgggcgcggttgaaccagg

SEQ ID NO: 610661 - DNA, 319 bp, Homo sapiens
gtgagataggttcttgctctatcacccaggctgactgcagtggctctatcatggctcactgcagcctcaatcccccacccctgggctcaggtgatccccccacctcagcctcctaagtagctgtgactataagtgtgtgtcaccacactcgactaatttttttgttctttgtagagatggggtcttactatgttgccctggctggtgtcaaactcctgggcttgagtgatcctcctgtctcagcctcccaaagtgttgggattacaggcatgagcgatcacgtctggccaataatggaagttttttaaataagtaaatt

SEQ ID NO: 610662 - DNA, 820 bp, Homo sapiens
gctgtgaaaaaagaacaatgctgaacatgcatataacttatatgtaagaaatactgtacaaggacttgatgcatctgggtagctgtagggcatgaaggatgccaagaagtttaaggaatatgggagaaatagtgtggacattagaagaaactaggtctgatattcaaatggcaaactgccagtttgtctcctgtcactggccacagtgttggatgcattaaaagagaataaaaaaaaagaaaaacagagaaagcgaaaaaaaaagaaaaaagtggtaggcgaatcatttgttcaaagctgtgggctctgcaaaggaaataccagttctgggcaactcagtgtgaccgttcaccagtggcccatttgagggttcagagagcctttttctaggcctacatgcttgtgtgaacaagtcgcctgtaatggtggtcggtatgtataattcaaggagcaccacattaggacaagatgtggatctattcatcatgtttatacaaggccgacggtggcattaattcattgaagggtagtcttaaagaacggttcttccgtgtggtggtgaaaaattttccttctctctcaaattcgggttggattaactagattacttcagggggcgagaaaaaaaaacacatgaaaaaggacaacaagggggcgtctaaaagtgcccggaggaccacggcacggaccgggttgagaaaggggccccaaggggggaaaacaagagggggggtcaaacgcgggcggacacggccggcctgggagccccgggggcagggaccccaaaaagccgaaaataggatggcacatacgggggcga

SEQ ID NO: 610663 - DNA, 111 bp, Homo sapiens
cacaccacctgagtccagaatgtcttacagaatgtcctagaaccagattatcattaacataacatgcccctgactttattcctgaaaatacccacagactcaggtggtgtg

SEQ ID NO: 610664 - DNA, 1547 bp, Homo sapiens
  misc_feature (778)..(778): n is a, c, g, or t
tcacccggcgggcggcgggcggtcttctacatcgggcccccccccccgctgtgtggggcgccccccgggggggggcccccacgggggggtgtgtgggacacacaggtgggcgccccgcgggggggggggcgcccccccatgtgtgtgttctcctggggggacacacacacaccccccgcggggccccccctttgggggttcttctcttctctcttctcgatatggggcgcgcccccacactcgccacgccgcctgctgcgtctctctctctctctctcccccgcgcgggtgggtgcgccgcgcgcggtgtgggtgggcgcgcccgcgcggtggcgcgcgtctctctctctctctgtgggtggcggcctccgcccccacctgctgctgcccccgcgcgctgtgagggtcgtctcacacgcgtgttctgcgcgcgcgagagggtgtgtgggtgggtggtgtcgtcacacactatatctctctgcggcgcggcccacgtcggtgtgtctctcccctctcgcacgtgtgtgtgtgatgggcgtctctctctcgcgcgacagcgcgcgtgtgtgtgtgtgtggcggtggagtcgtcgtctcacctctccgcgcgcgctgtgtgtctctctctctctgtgctgctgtgagagggggggtgggactctatctcaccgcgctgtgtgtgtgctggctgtgtgtgtgtcgggcgacacacacacagtgtgttgtctcccacctccgcactcccctcgtgtggggggctctgtgtggtgcgtgcgagncgcgcgcgtcgatgaccactctctctctgtgtgttgcccacatccactcacaacacacacacaacactatatatcatcacacagcacgaggggggggggggcgcgcgcgcgtcccacatctccttctctctcggtctcccgcggaggggtggtcctctctttgaaccacactacttctgtgctgcgcggtgtggtggtggacgtcctcctcttcctcaccaacgcggtggggaggacacttctagctagtcatctttccgactcccccccctcctccccgcgcaagctagatctcttctgtgctgggcggtcggctcctacaacgtgcctccctgctcccctcccccgcagcgggggagggggggacccccccctcggggggtagttttacgtctttacaccaaccgggggggggccggcgcgcgtcccccctctcatctttactcgtgcggtgatttggcggcgggctgccccaacaccctatattgcggggggtgcatcgctactaatccccaccactgttgggcgttcgatactcagaggcgggccgcactgcttggtgtggcacccaccaccttcgttggggggggtattccctccaggacgtggcttccctacctataccatctggggggggggccccccacatacatattctgtattgtgtccgcagccgacctgacggggggtgtttctcctccatcactctacctgcctgctgcgcgacatagtatctgttttgtccacatccctctatgatagggtcttc

SEQ ID NO: 610665 - DNA, 167 bp, Homo sapiens
tctggacccccatctctatatgtgtccacacaaccacatctgccttttccacaatgcttttcacaaatgaatggtgagagagaaggaaaccttgggaggaggacattacttggttgttcttggctggtttgaaaatgcacaaataaacttgggatgtggttccttgc

SEQ ID NO: 610666 - DNA, 512 bp, Homo sapiens
gtgtaggcgttctaggaggatcccctgcagcccatgtcacaaggatgtctacaataaaaaagagacaataacatgtgctggtgaggacgcggagcaatgggaaccctcatacaaggctgggggggaatgtaaaagggcgcagtcccttgggaaaacagtctggcagttcctaaaaaggataaacatagagttaccatatgacccagcaattacactgtgagataaataccacgagaaagggaaataaaaacaaatgtccacggtacacaaatgttcacagcagcactatccataatagccaaaagacagaaagaacccagatgaccatcaactgaagaatgatatataaaatgtggtatattcatataatgaaatgttactcagcactagaaaggaatgaaatagtgatacatgctacaacatggataaaccttgaaaacattatgccaagtgaaagaatccagtcacaaaagaccacatatgcatgtttatatgaaacgtcccaaacagca

SEQ ID NO: 610667 - DNA, 345 bp, Homo sapiens
  misc_feature (204)..(204): n is a, c, g, or t
tagcaggatcacgtatatgtactattaatagtagacaacattagtgtaggaagatattacagatcaataaagttgcaggcatgtggtcacactgtatccagcacttggaaatcgagatgggaggatcacttgaggcaggagttcgagacagcctggcaacgcaacgagacccccatctctacaaaaattttaaaaattagctgngcatggtggtgggcgcctgtagtcccagctactccggaggctgaggcgggagaatcgcttgaacccggaaggtggaggttgcagtgagccgggatcgcaccattgcactccagcctgggcgacagagcgagactctgtctc

SEQ ID NO: 610668 - DNA, 449 bp, Homo sapiens
acggcctacggagcggcggcggcggttcgtcctacggtggagagcgactacggtaacggtttcggcggcttcggcagcttcagccagtcatcagtcctcctatgggcccataaagagcggcggcggtggcggtggtggaggcagtagctggggcggtcgcagtaatagtggaccttacagaggcggctatggcggtgggggtggctatggaggcagctccttctaaaagaaaatttaataatgcctgggagtggctataggggtagctctattccaatcagcccaagtggggtcaactcctaagccccagcccctcacacacaccgtcttccctgttttagcccttgggggagccacttctaaggctgcttacccttgggggtgttcctctatttgcctgccacctctcttgtctctccctctgaagatggcctcggcgcccccggccg

SEQ ID NO: 610669 - DNA, 405 bp, Homo sapiens
cagagccttcgtgtctttttgtgacctactagtgctagtaactcttttctattccagaatagtgacttacctgtgatatttcactttggaagatcccctccttcaatggacgaactttttcttcctgcaagggtataagctatcactttaatcataacagaatattatcctacgactataaagagacctcaaatgcgcactgatatgtatatgtgtgtattatataggtaagaaaggataagttccttatattctctaatacagtggttcttacactttgtcatgcatcagaatcatctggaggtactcactttgctgggcaaacccccagagtttccccgtaatgaggtcagggtgagatctaaaatattatatttccaatcagtacccaggaaccgcgaatgt

SEQ ID NO: 610670 - DNA, 811 bp, Homo sapiens
  misc_feature (1)..(1): n is a, c, g, or t
natggacaatctaacatggtcgtgacattacaaacgtgtcctcttaatcctcccccgagtaccatttcaacagcactcccttgataatattctctatgaaataatatacagctccacattggcaaccatgacgtttataatttattcaaaagactacttcacaacacactttaccatgccacgataatctttctccggcatgatcacccctcccccactgttggttgattgccccccacataactgtctccccaacaaaggttatttttatactgtggaccttccatttaacaggtactattttcccccccattacaactctttgtatttgtttttacgcacgcgcaatacacccctataatttgctcaagaatcactccctataaagttaacaacaagcagcacactcttatatctcttcaagtaataagccccccctctcttgtcgtaattctagcgataaagaaaaaatgtattttcagcaatgtcatataatataacagaaactacctcgcgctgtatattaaaaggggagtataaactcctctctacctcatgtcacctttgtgaggacaattatcccttcagagcgcttcaaaattttaaaaaacatgttttatttcgggcggaatataacataccccaaaggaaaatcaccactcttattacatttgagtactctgcgccgctgatatcaaaaagaaccacctatcccgcaaatatcctcttgaagaaagaccaaataacaaacatgatttcgacccacaatgtagtatgtaaaaaaactttcccacagacccacataacacaa

SEQ ID NO: 610671 - DNA, 120 bp, Homo sapiens
agggctcaatggaccctcggggacccaagtgggggttttaaccctttccccccccccccagccccctgccctgaaatgagacttttttttgaaatttttaaaaagaacagggaggctcca

SEQ ID NO: 610672 - DNA, 121 bp, Homo sapiens
agtcacacagcgaccatcacacgaatctaccaaatgcatgtagcatctgtaattcacgaacatggtcaacaaaatcatgttcacttacaagccccaatttcatttaacattaagagaaaaa

SEQ ID NO: 610673 - DNA, 101 bp, Homo sapiens
gaccccactccacccttaccaccagacaacctttagccaaaaccatttatcccaaaataaaggttagggcgatagaacattggccaacctgggcgcaataa

SEQ ID NO: 610674 - DNA, 391 bp, Homo sapiens
tggagatggagtctcacggtgccttccaggctggagtgcagtgatgcgatgaaggctcactgcaacctctgcctccggggttcaagtgattctcctgcctcagtctcgggagtagctggaataacaggcgcctaccaccatgccgggctaattttggtattttaactagagatgaggttcaccatgtgggccaggctgatctcgagctcttgacctcaagtgatccacctgcctcagtttcccaaagtgcggggatcacgggttggagccaccagggcgggcctcaatttctccattttaaaagggtcactcagatgccaggtggagggcaggagatctgcatgagaggtgaagatccgggggccagggggatgctgtggtctggctgcag

SEQ ID NO: 610675 - DNA, 168 bp, Homo sapiens
agacaaccttagccaaaccatttacccaaataaagtataggcgatagacattgacacctcgcgcaatagatatagtaccgcaggaatagtggccaatttttaaccaggcatattttgcagggactaacccctttacctctgcataatggattaactggattaacttgc

SEQ ID NO: 610676 - DNA, 378 bp, Homo sapiens
  misc_feature (368)..(368): n is a, c, g, or t
agaggctcacatgtgggccaggctgtcttgaactcgtggctagtgacttgcccacctcagcttcacaaatggctgggatacaggcatgagccactgcgcccggcctaacaaggctaattctacagcattttcataagtgtgggactatgggtcatcttttcaacaaaaccagatattaccaatcaaggtcagtgaaaggagagtggtagacttaaagtagggtcaatggtcctacatttccaggtggtggataacagcctaccatagaggtgtcaccagcttccaccaatttacacgggaggaaacagagctcagctcagagaggtggagtttcccaagaagccaagtcggggggccaagaatagggncggggtgcca

SEQ ID NO: 610677 - DNA, 664 bp, Homo sapiens
ggcggagactgcgaccctcttctctcagtctgccttactaccatgccgctctacgagggcctgggtgagcggcggggcagaagactggcggtgcgtgatctgacctgggagaggcctttaccaagtgtggatttgctggagaaactggtccaacgatgtactaagttcctagtgtgatatacaaagagctgggactgcctaatgcctgtcgagagcttgtatcagtataactactcaatacagcaacgtaattatgttgcctacctaaaggaattcatccgacagtactatattctcagcgctagtctactcggtgaatccgcagatgaccgccgagtccgtgagttatcgaatcggtattatgtccttcgtcacttcatgagagacactcactcgtgtgcttttcaaatattttgaggttccatctgtcttgcttgctccaagtcatctaatggctcttctgacgcttggaattaattctgccatggtcctagattgtggactatagggaaagcctggtgttacccatatatgaaggaatcccagttctaaattgtaggggagcactacccctaggaggaacaagctcttcacaaagagttggaaactcaactattggaacaatgtactgttgacacaagtgttgctaaagaacagagccttc

SEQ ID NO: 610678 - DNA, 297 bp, Homo sapiens
  misc_feature (267)..(267): n is a, c, g, or t
tgtgtcccttcatgcagtgcatggaaggagggaggggtttccagtggctgttctggcagcggtatcaatgatgtcccccccagaatattcagcaccgggatcatacgggggtggtgggggagagaggctccaccatatgtggtggaccagggggaatctggcccttggcgctgcaccggtggcaatgcttacttgtgtcccttcatgcagttcatggaaggagggaggcgtctccagtgctgtgttggcagctgtatcattgatgtncccccccagtatggctcagcgcgggtccgg

SEQ ID NO: 610679 - DNA, 782 bp, Homo sapiens
aggtatatgagcagctggccaaatagcttcaagtgagaaatgtcgatgagcgactccaggtaagctaagcacctcggagttatatagtgcagggctggcactttgggctgtacacgttcttcgattgacaacgagatggtcccagtatacttacactgcatctatgtggccctgggatatggtgtttttccctggagttgaacatctgtgcgagaagctctcaagtatcatcgatccgtacaggagctctctcctcacagagcgtcgagagaacagccgtcaccaaggatgtccatgaatgatcaatagccccatatccaaatgttggctagagggggtgagagaattacaaagggctgcaggatatgtgcccatgagaaggccgtcgagcattgaacttcttgccgcacccagtcctcagacattaaacgagcctggaatgtcagtaaacatgaagatagcaaaaacaaagaagatgttgggggggggcctgggcccacggaaaagcgttattacaaagcatgaccggattgggggggcggggtggaccccagtatggacgacgttgaacagccgtgcacattggccgcgtggcatgaggaggaaggctcgaggggaagagacacatagggggcttcgtgctttgcccccggattaaaaagcaccggccgggagcacaccagtatcttggtgacgataccatgtcagaagatcgggtcttgaaggaagaaacgggggcttacaccgaaagatcaaggcactgatattaattaggggcgagg

SEQ ID NO: 610680 - DNA, 559 bp, Homo sapiens
tcgaagatggcggtggcagggtatgtgttagaagaggaatgaacctctgactgtaaagttttaagttttatgcgattaccgggctctgccatcttaacaaaccctgttcttgggtgggtgtgggtataatactaagttgagatgatatcatttacgggggaaggcgctttgtgaagtaggccttatttctcttgtcctttcgtacagggaggaatttgaagtagatagaaaccgacctggattactccggtctgaactcagatcacgtaggactttaatcgttgaacaaacgaacctttaaaaacaaaaaaaaaaaaaaaaacaaaaaacaaacaacaaaacaaaaaaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgcc

SEQ ID NO: 610681 - DNA, 332 bp, Homo sapiens
cgctctagagatccccaatgcggagtcatagtagtatatccaatgaaatatcaacgtcttcaggcgtggagctataagtcatacagctcagaattggcggggaggtacttcctggggcatcctcaatcaattggaacaggagccagcggataaatatttcagcctcctgttcagtcagacaattctgggaagcattatatatccaacctccgtaatacctttctatggatttttcttctgtctctctaccatctttcccactcctgcatcctggagccaaacgccaaataaactactgcactcaagttttttttctctcctgcaaatgtggg

SEQ ID NO: 610682 - DNA, 893 bp, Homo sapiens
tatctcgtgttcgatgtccacccctgccttggtatctacagggggctttcaaagagagttgtccatcaaagacgtgtgcccctgtaatgcccacccccaaaattcctccgacccggagattgatttcggggaccccacgtgaagatttttttcaccgcactgtattagtactaaacgtatcctggcaaatcggaaagggggctctgtcccacgccaggaatgcttttctcctgcaagaccccctttacaaggcaatggtaagggaaacccgttttgagaagtctataataatacttactctcggctgcagagatttatggtcaagttacctgcccgtggccaactaacccacaggccccgcactgtgaaactagctcgcctgaaatgcggggcagaattgggaaaattaaccgaaagggcaccctttaaaaaattggaatcagcttgttctaaacctactgaagcatttgtgatatttgttacaaaatcacaccgggcccaggccgataacatcactttcctttgcgaagtggcggcacatgcacaatgcttttttctgtaggccactagtatctaggggaaattgctcgtcttttgttggcatatacaatttctacagacaagctccctcccttgcacaaatcatatgcaaccttatgtttacacctattttgtcacagattcacactagtctctgggcgacattccgtatagacagatcatttctctaaggagtactacccttctgcattgtgcttcgaaaatattcctttgtacaacccccgagatggagtaaaatgtccctaattgtgccattctagtgattctctataacttcaccatcttacaccctaattttaaagggaattaaaatcttgtttaaaaaccatact

SEQ ID NO: 610683 - DNA, 194 bp, Homo sapiens
tggacgtatcacacccagaccttcgcgctgaccctgctgcgccgtggtgaccaggatgtgggcaccaactggaccatcggttacgatccgggtcagaacccgccgtacggtgaggccctcaaggctgcctacaagttcatcaacgtcggcaactaccagctcaacgtttcctgcggtgctctcacccaggaaga

SEQ ID NO: 610684 - DNA, 224 bp, Homo sapiens
tccgaccgtggggcggttctccccgtccttaggcacatcctggtggtcgcccgcgtcccgggaggtctccatattgatgcctgaagttagtgcggagcgccctatcggcttagctgcactacagcccattaactcctgggctcatgcgatcctcccacctcaggcctcccgcagtagctcggactacaggcacgcgccaccgcgcccggcacggtgcgttggcc

SEQ ID NO: 610685 - DNA, 780 bp, Homo sapiens
cccttttgttaaatcataagaaaggatttatgagcttcatagggttcagcatgcaagggtaaataaaagaacgtttattgtggtatcccaggtgaaccccatgcaatttctatccattatgcactaaaacttcagaagggccattccatgaatgtaggctctctatgctagagtgttcagtgttggccattgcgcgcttttgcctaatcgacgtgaaggcccccctagccaagcaagagtggtgactagccttctccctgtggcaaccagctgctgtcctcaggccggtaagaaagaggagagtttcttggccactggagcgatttccgttgggcaatgcccaggtagaccagaggccgtgccttgaggctgagctgagacacctcactggttttcccttcgcccattgaaccagtcacagtgtccccttgctcccaggctacacttctgtcttcgttagtcgtaagtttgcccacctgtaaagtagattcaggatatctgtagagggctgtacaacagacttcgaaggtttgctactgtatatactgccattgagaaggggaaatttttcaacattgtagaagcttcagaattagaggtgcctctttacctcagaccagggagtgaagtagagtgtatttagccaaaatacttgttcaattccttataaaaactacatctttcagatgcaagagtgtcgaacatgtgcttaaccgaggtgcttactagttggtgagcagtgttgagcttagaagtggtataacttaggggtgcgtactg

SEQ ID NO: 610686 - DNA, 104 bp, Homo sapiens
ggtggtgagtgaacctgagataatgccattgcactccaggctgggcaagagaggttcttttgaaattcagcagaatcttctctgtctggctgtagcctggtgtt

SEQ ID NO: 610687 - DNA, 816 bp, Homo sapiens
  misc_feature (6)..(6): n is a, c, g, or t
  misc_feature (79)..(79): n is a, c, g, or t
  misc_feature (102)..(102): n is a, c, g, or t
  misc_feature (107)..(107): n is a, c, g, or t
  misc_feature (116)..(116): n is a, c, g, or t
  misc_feature (180)..(180): n is a, c, g, or t
  misc_feature (218)..(218): n is a, c, g, or t
  misc_feature (240)..(240): n is a, c, g, or t
  misc_feature (386)..(386): n is a, c, g, or t
  misc_feature (549)..(549): n is a, c, g, or t
  misc_feature (574)..(574): n is a, c, g, or t
  misc_feature (588)..(588): n is a, c, g, or t
  misc_feature (591)..(591): n is a, c, g, or t
  misc_feature (663)..(663): n is a, c, g, or t
  misc_feature (746)..(746): n is a, c, g, or t
  misc_feature (800)..(800): n is a, c, g, or t
cccgtnccggccatccggcactctgtccttccctgccccggggtgggcacccagcgtgtgggggggttgctcttggggntgctctctgggcctcgttggggngggtnacctttgtnttgtgcggtgtctccttgtggggctcggttggggtggccccgtgggagctgccccgtgcgcccnggccggggccccgcacccgtgtttgggcctcgatgggngttgcgatgccctgcttcttgnggcccgggccgctgccctctttccagcccatggcctgcggcttccggctgccaatgttgtcactgcccagcccgtcccgggtgggctgctcggggtctacgggggctgtgggtatgccgccgtacttcctcctcttgggctctggnggctcgggggtgccgtacttttctctgcgttcggctgcacggtcccggtgcttcgtttgctccttgtcattcttctctggtgcttctggctcgttttctggcaagtgggctcgccggtggatctcagggttttgcttgtggggccctgggggctgctggtgcngggtgggcgcctctttgctgggggnctggcgtcggcggngcnggcaggccggcttctgccggtcggtgagcttctcctcccgctcagggcccccacgctcctgctcctcctcantgtcactctccccgctgtaggctgccaccagtcctcgcggagggcttgggcggtcgtcactggccaatttcgggagatccatnctggtgtgctgtctctcggctagtgctcccttcttctcgaggatggcatagcancatctgcagtggctga

SEQ ID NO: 610688 - DNA, 1395 bp, Homo sapiens
  misc_feature (1)..(1): n is a, c, g, or t
ntctcgtgttgtgtatatcgtgcggtattcattggttttgtctcgtagacacccgtttttgtggtggtattttgtttcgcctttctgctctgtacgcgccgccccctgtacacaagagaggttctcttgtgttcccccttggccctttgtgtccctggggcccgatgcttttggggcgcaacccatgttgtgggaattgtgtgcggggggcacttgggggcacgaaggggcaccattgttttaccgcctccctgatttccccggggtttttcctccgtgggccaaatctcgtttcttagcccccgtgatctccgtgtttcccgcggtttttttcctctttgggtgcccctatttccttttctccccagtgtttccctccggggtgacgccattctctgtggggcccctgtctttagagatgtctttggtgtggagttccctcctctgggcctatcttgggcgccccctccacgtggcgcacgttggacccgttgagttccctcgggcggagatttttgtatgccccccccccagttatcaccgggtttctcctcattggtagagcgcccctttcaaacgccccttcggcacagggtttctccgcccgttggcccacactgcgctttgtgttcaacacgggtgctcacaacctggggtgcaacccccagacccccctatcccacgggcgcccgccccccttggaaatggggagactccacgaaattttttggggggacacactctcacgggagccccgagaacgcctggaggtggacccactgtttctcccgagtatcaccgcccgcccctcggagaggaatttctcactttggggggagtccctcgggagattgggggcacccctctgcgggggttccgctgtcacacactgtcagacccccaccaggccccccgggacaacactttatgaggttgggtttacccccccctgtttcaccacaaactgtgacaccgcgttctatctttctcccagagaggtgtccccccaaggtctgtacatttttggtggccaacacaccccccggctcttgggctctcccaaattcattccgagggttcctcgagggagcccagacccgtggctcttttggtgagctcgtgtccctcgaactttcacagtggccaccgccacgagccgccctctgccctctgtgagaacctcggcgcacgccctcgggcctgccacgcccactcacagcttttcgggcttcggggcacagaaggacgatgagcctcgggaggcctcggggctgggcccctgagactccaaaaaagtggttttgagcccagaagagggcccacagaatggagggctgttcactttcctgcagtttcggccttgtttaattaagcctgggcccttgctgatgcgga

SEQ ID NO: 610689 - DNA, 177 bp, Homo sapiens
tgaagttgccagtggaatggagagaagggcctttcagcgtcaagcacacgtttgctgaatggacagacatgcctggcagctaggcagtacgggtttcttaaccgtggggttcatagacaaggagtctatcgatcaggacttcagctggaggcttgtggcacatggcgacgtgaggga

SEQ ID NO: 610690 - DNA, 142 bp, Homo sapiens
  misc_feature (91)..(91): n is a, c, g, or t
ttaccgcagaccttcgcgctgaatgccgaccgctggtaccagtacttaccaagaccgtgttcctgtcgggtctgccgccggccccagcganccgagcccgagccgaacccgaacctgaacctgcgctggacctcgcggcgct

SEQ ID NO: 610691 - DNA, 323 bp, Homo sapiens
  misc_feature (270)..(271): n is a, c, g, or t
tgggacaagagtctcgctctatcacccaggctggagtgcagtggcatgatctcggctcactgcaaactccgcctcccgggttcaagtgattctcctgcttcagccttctgagtagctgggactgcaggcgcgtaccaccaggcctggctaattttttatattttcagcagagatggggtttcaccatgctggccaggctggtcttgaactcctcacctcattatctgcctgccttggcctcccaaagtgctgggactacaggcgcgacannccaagcccagccgtaacttatattttaaagccaccaaaaagcagttgacgcc

SEQ ID NO: 610692 - DNA, 95 bp, Homo sapiens
ctgttgaggcgctgcttcagcctgcacccctcccctgtctcatagttgtacaatttgacattttcaaataaatatggatggcgggcacctaaaaa

SEQ ID NO: 610693 - DNA, 396 bp, Homo sapiens
accctattgtgtggtgttatgtgtaaagacatacgggtagtgactggttgattgtgactctcgactaccaagggctttcgtgcaataattgtaatatggatcatgcctaaaatacatctatgaacttgaactcagcaatatattgactttactttctccttgttattcaggttgctaaatgtgtaaaatcaaaaaaatcgccaaggtcaggatctattcttatcacgcttgacatagaaaagattgattatttacgcctagacataaattctcatactgtgaaagagtcgattttacgaacaccaaggattaagctgaagggagaggtaagctgactttcctcggttaaaggctgttgttatgggggcttctttctttgagaaacctaatccataa

SEQ ID NO: 610694 - DNA, 107 bp, Homo sapiens
gggtgtggctgataaaacctcccatcggtttggtgctcctcctaactgtgcagaagccaaatcacctgtgctccggcggcggcgggggccccggctgcgccggccgc

SEQ ID NO: 610695 - DNA, 381 bp, Homo sapiens
  misc_feature (228)..(228): n is a, c, g, or t
  misc_feature (355)..(355): n is a, c, g, or t
ctatgctgtacaagagatctccaggaacttactcctcctaacggaaattttctaccctttgaccaacatctcatttcccatctcctcctgcagctgctgataaccaccattctactctctgcttctttgagttcaacatttctgtatcccacatataagtgagattatgcatatttgtctgtctgtgcctggcttatttcacttaatataataatgccctccagggtnggctgggcgcagtggcttatgcctgtaattctgggcactttgggaagggccgaggcaggcgggattgcctgaggctcagggagtttgaggaccaccatgttgggccaggggtgggtcatggaacttnctggacctcagggtgatcccgtcccg

SEQ ID NO: 610696 - DNA, 127 bp, Homo sapiens
gactgctcttctcactgagaagtattgcccccatctcaatcatataccaaatctctccctcactaaacgtaagccttgctatgatggataagattgagagagtgaggagaaggcttacgtttagtga

SEQ ID NO: 610697 - DNA, 1401 bp, Homo sapiens
  misc_feature (1262)..(1262): n is a, c, g, or t
tgagccaagattgccccactgcactccagcctggcaacagagtgagactccatctcaacaacaaaaacaagaacttggaaaggtgaacttgaaacaataatcacaagtaatcaccctagcaatgaatcatagatgggaagattgataacagcaacttctggtccagtctgaatgagtggggagagcctagggtccaaggcagctagtgtaggaaatgctcccgagttaccagccattggcatgtgatagggtcaggcaggggccaggggacaccgcgctccatagctccaggaagagtttgggtgtgagggtctccataggtcctcaaactctctggagtccacgcttgggcctcgggtctggaactgctggtctgaaccacaaagccgcccccgctcggttccttccttggctgaccttcggcctcacgcctggcctaacttgctctcctggcccattaacctgtgttccccttttctcctctccccaaggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggcccnttggatcaggctgggcactcgctgtgctctcccctccttggggcgtttaagacttggcgtcttcaacccaccatggcccaaaaggacgtgcaaagcccttggaattttctggcactttccttttatttgccccaccacc

SEQ ID NO: 610698 - DNA, 494 bp, Homo sapiens
ggacctgcggtggtccctctactacctgctcagtgcctgcccatgccaaggccccaggatacatctgccatgtgctcagtccgtgggggcctctccaatgggagccgtgaggaatgctactgtggccacgtcttctgggaccaggtgagcactgtacacccagcaccatgtcacacagcaggctgacacatggaggtccacggtctctgccctcccttggaccatgggctaatggttggggaagcacagggactgtggcaaactgggctgaggccctggaaggttgttgcaggagtttggtagcaggagtgatctaggtacaggggaattggcatggtgcatagaccagaagcttgagagggcctgagggcactttccagagcgttgggatgtggcctccaccaatgcgagaagggctgcagggtccagatcaccagcgtttgtagaccgtactgtggcggcttggaggttaccttagggccagtgagctccgg

SEQ ID NO: 610699 - DNA, 162 bp, Homo sapiens
aaccaagaaatccccgggtgggggcccttttttaggttgggcccgccccccccggctttttatttttaatgggtttttccttggtttaaggggtgcctcccttggtttcttgggttgggcccggtttccgggggttttggggttcaagttattaaaaatttc

SEQ ID NO: 610700 - DNA, 344 bp, Homo sapiens
  misc_feature (34)..(34): n is a, c, g, or t
  misc_feature (41)..(41): n is a, c, g, or t
gaaaattgaagaccccaacatcatacatgtaggnagtgacnaaagtggggatcaaaccctaaggtctggaagttgccctagatagattagattcctttggtttttgtttttgtttgttgttgttggagacagggtctcactctgttgcccaagctggagtacagtgatgagatcatggctcactgcagccttgacctccctggggtgaaggaatcctcccacctcagcctctctagtagctgggaccacggatgcacaccaccacacccagctagttttcgtattttttgtacagatgaggtttagccaagttgcccagacaggagctcaagaccagcctgagc

SEQ ID NO: 610701 - DNA, 159 bp, Homo sapiens
caagactgtgtcatatgtttaaaacttttataatcctttgtggttcataagcttgaattgagtttttggtccacatgtcaatgtgcctccctgagccttgtcatggcacatacctgcctatgtgaacaataaaaataaaaaataaaaatgataagcaga

SEQ ID NO: 610702 - DNA, 202 bp, Homo sapiens
acgtgaaccagacccccggcttctccgcgcgtgcgctggcgctcgtggagcgcggcggcgtgtgggtgtccagcgtgctgcgcggcggcggagagctcggcgaggcatggcatcgcgcgggcatgctcgagcgcaagcagaacgtgttcgacgatttctatgcgtgcgcggagctcctcatccaggagaagctcacgcggcc

SEQ ID NO: 610703 - DNA, 122 bp, Homo sapiens
accagctcgggaccctctttttctgggtggttatgacagttgtgtttgctttataattatacattgagccattcacatgtgttgtggatatctttgtattttattattattattattattat

SEQ ID NO: 610704 - DNA, 739 bp, Homo sapiens
agagcagctgacaagcaggccccccggccagagggaggcccgggccgtgagaagggcccctggacccctgggccccatcaacaggccctccaagaccgcggggttctggggggctccccctggggggcaccctgagggatacgcacctgggatttccaccctgccacgagtctcagaaaaccctccttcgcgcttttcacaccagagttttaccctcgaaacggtgctgtccctgcaagagctcaaggccccactcccggacgtgaatctccgggggtttggttcgcggggaagctggaggccaccagccctggttttcctagtccttttgcgtcaatcttctcttgtaagtgagggtcctccacggagaaggaaatccggccacaggccacaacacgacgggctctgggagaaattatcgggcactatagaaggagatgccacacgctgtcacaggggttcaacctctccagaagacaatctcatccgtcccaattctctctgccatttgaaccaactgttctcccccaccccctcgaatacccgtttagagccagaagccccgccaatactatcttgtcagggaccagatagaaacatattttcggcttccatgggccccacacacagtcatccattgcagctcctcaaatttgctgttgtagcacagaaagaagccatataccctgggttaaccaatgagatatggctttgtgcccattaaactatttcccaacca

SEQ ID NO: 610705 - DNA, 276 bp, Homo sapiens
tgaagagtcgcagctgtgcacaccgagtgaccactaaggggcaaattgagctccgtcaggcactagtcgtccgggacctgcaaatggccgcggctcaggatagtggcgcaaaggcatccatcaccaaggccttgaaaccttatgctcacaaatcgctaggccgatgagcagccacgctcgagtgtgcataaccgcgggtcgcacctctggaataagccgaggtacacacagagagaagggaactgtaggtcccccactgcagaggccaaaaggcgt

SEQ ID NO: 610706 - DNA, 457 bp, Homo sapiens
  misc_feature (1)..(1): n is a, c, g, or t
ntcagtccatcgtcagaacggcccctcgacatgtgcgtggccaacgagcacacggaaaggcacgacgccagcaggcaccgggggctgcagaggaaagccacggcggccggactggctgaagcacccacgggcagcacgggcgagcctcggagcgccccaaaggcccacccgctgctggcggggtcacaaaaggccacgggcacttggagccaccatgggtcaccacctccctataaccaaaggtaactcacagcaccccggcccggcaatctcacacctggattcacccaaggggcatgaagacacgtccccaaagacttacagtaaaatactcacaccggccttattcacaatagtccagagccgcaagcagcccggtgcgtgagccctcaagtcaggggcagcctcggcggggcctgtgcctgaaccggcccttggcggagaggaggagcggccg

SEQ ID NO: 610707 - DNA, 391 bp, Homo sapiens
ctgttcctcaccccacccccatgtgtctcctccacgcttgcaccctctcgtcaccttgcagggacagcagcctcggattcagggcccaccctgctccagggtggcctcatcttaatgttccatcagctaaggccttctctttaaataggtctcattcgggggttctgggtggacgtgaattttggaaagacagcccatgaccttctcctattgcccaaataggcccagaaacttccccgagtcctccgaggtgcagagctgtgctgaggtaccggccttattcacaatagtccagagccgcaagcagcccggtgcgtgagccctcaagtcaggggcagcctcggcggggcctgtgcctgaaccggcccttggcggagaggaggagcggccg

SEQ ID NO: 610708 - DNA, 178 bp, Homo sapiens
gttaacacctgtgagcgcaacactgtgggagtgcacagacaggtagatcacttgaggccagggtacgagaccagcctggtcaacacggtaaaaccccgtctctactacaaagacgaaattagctagggtgtggtaggtgggtgcatccaactcccagtctactcggagtagctagtgg

SEQ ID NO: 610709 - DNA, 284 bp, Homo sapiens
taggctgtgtaagacggggtacaaccatcttccagctggctgttcccagagatgcagcacccccaaacccagggggccaagcttgcttctcccagatgtttgacttgctgtttgctgatttttcactcgacttttgtataaatgaggacactttaccattgagctgaatgccagtcaaagactccacctgttggacaattcacaatcatgctcactaattgtgttgaagagcgatttctgcctacagaatacatatatactcctggtttgagaaactccctcat

SEQ ID NO: 610710 - DNA, 165 bp, Homo sapiens
cgactcagaggatcccagggaatactgggttatttggtaactatgttttgtgtgtgtgtgtgtgtgtgggtgagagagagagtcttgctcctgtcagtcaggctggagtgcagtgacgcaatcatggctcaccgtggcctcgactttctgaactcaagttatcct

SEQ ID NO: 610711 - DNA, 557 bp, Homo sapiens
gcaagcgcgcgcgcgtatttgcagaagccagcgggccgcgtactgagtgtactcaaggtgcccaaaggcggggtagtgacctcgcgcgtgcgctgtgcccgcggcagcgcccgggtcctagtgtgtgggttgttgttcggcacctgcacgtgcgctgtgctccatgtgaggactggcgcgagggatttgcggccgtggacctcaccccctgctccaagtcgctatcggagggccgcgcggggtgggctagaggcagccggttctggtgcgctcgcccttagccggggcgacgtgcaacttcagcactggaccgatgagacgccccccctggaagttggaacgccccgaagccagggagtaggatagggtcgtgcatagaagggggggactttgcccgggcaaggccctgtccctgagtaagcccttcccgtagaacaagaacggcccaatgaagcgaacggcagtgcgcgcctaaccgcggaacatttggcacacagattgaccccaagtatccttgccgcggcccaaccttacttggcgccttcttttggccccca

SEQ ID NO: 610712 - DNA, 914 bp, Homo sapiens
  misc_feature (625)..(625): n is a, c, g, or t
ctttaccagctacgtgcgagacgatatatcgtgcgcgacatcaaggagaatctgtgctacgttgccctggacttcgagcaggagatgggccaccgacgcatcctcctcttgcctctggagaagagacttctatctgcccgttggccatgtcatcagcattgggcaatgagcggttcccggtgttcgtaggcgcctgttccagtctatccattccctggagtagtgtaatctgtgctggtatcccactgatgacctcgcttcaacttccatcattgataggtgtgatggtgaatcattccgcgacatatgaccatgtatccgccaaccagcgtgtgtctgtcgtggcggaagccaagcctagtggtatccggggcatttgcttgagcaggatgcgaagaatgtgagactcaccgtccgtggcgcctcagcatcggcagtgaagatcaaggatctatcggctacaccctccatgtaggcgtcaaaagtaacatccgcgcttgctgcggatcggtgttgcgcgtctccaatcgcctggctcctcagcgtgctcccacacttacacaagctaggatagtggggattagtcgaatgacatggagtgacgcacagacgtcgggtgggcccnttccatacgtgccatcgttaaaaatgcttcttaaagcggggactcagctagcattgcgtaagccattttggttgcagattggtgttcaattggcagaatgaggataattttggccctggtaatatgtacacatctccatgcttattctcaacgaaagtgttaatatgcctttcgaacatgcatgtttgttctttcgaagctgggtatctggatttcagcccttggatttgtagaagttgttagctgaatttggacttgtattgaggttacttgttcccctgggtatttg

SEQ ID NO: 610713 - DNA, 1596 bp, Homo sapiens
tgtgtggggggggcccccggggccccccgggcccccacagacagggggggggggggggacactggcacacacacacaccgcgggggcccacacacaagcaggaggagccggtgcgggccccacacaccccgcgggggcaacacacaccacacacagcacagagagaagcacacctgaggacacacacacaaggggcgccaccggacaagcagggggcaccacacaagcgagagaccaccccacagagaagtggcgcgcgcggagaggcgagagagcaccagcgggggcgcacaggtgtgtgacgccctcacacacgcgcgggggggagaagagagagagagagagggggagcgccccacacacagcactctctcgtgtgtgtgtcgccccacacagagtgcgcgccacagagagaggcgcacacagaggaggcgctctagggggccaccacacgcggggcgtgtgagcaccccgcgggcacacaacagactacacacacagcggggagggagacacacacagcgtgtgggcggtgtgagagacacactgctgtgagggagggaggcgctccgcggagtggcgcgcctctctctcatcacagagcaggggagagacgacactgtgtgtcgatcacacacagcagactctctccccacctacactctctctcgcgcgcgcgagcagaagagagcacacacacaaccgacgcgcgcagcagcagcaacgcgcggggggagagaagagcggtcgtctactcgcgcaggaggggggtggaccccgcggcaggagggggcgtgccacgcacggagaggagacccacaccgcagaaaacaacaccacaacctacgaagcagagcgcacactttgtggtgtgtgagagacgacacaacaacccgcagctggagaacaacaaaccacacacggaggggtgttgtcacaacagcgaccgtatgtgatgaagaacacaaggaagaagaacgaaccacaccgatgaggagaagaagacaacaccacccatcaccaaggagggagaagacagaagtgagggagagacagcaatcaccacaacccacagacgagacaaacaacgaacgaaccggtgaggaggagcacaataccaaaaacgacgaagatgggagacagcgtagagatcaaacacaaacacaacaaaaccacagacaccttgaaagagcaacacacaccacaggaaggggaggaagcaactagatgaagcaacaacacaccacatcacctggcggtgtggtgtagcagtcgacaacaccagcacaccactaccccccaggaatgatgaggcaggcccagaacgcaaacagtaggtggaagcaaacacacagacagacacgaagagaggaaataacaaagacagggagaggggagcaccacccaacaccaagcagagattaaccccagcgcgaagaggaggaggacacacaccacgcgcacgccctaggtagtggagagagcaacaacaagaaacagccacccgcgagatggaggaagacgacacacgaacagaaactactatgaataaaaacacaccaaccaagacaacgagaaaaggaggagaggcgtaac

SEQ ID NO: 610714 - DNA, 145 bp, Homo sapiens
gactctagaggagcttatgtgaattctcctcctactgtatgacgctacttagccttctctaccttgcagactaaacagtttatagtactgagatggaaagttgaaggggctagctcgaggcagggctggtggggctgaggcagtg

SEQ ID NO: 610715 - DNA, 116 bp, Homo sapiens
tgggcagagatttagatctcgctatcttctctggctggcctcaacatggaaggtccccatttttgaaagaaaaagcttgtgagccacagaacaggcgagagagtgagggcccgccc

SEQ ID NO: 610716 - DNA, 837 bp, Homo sapiens
tctaatgtctgcttggctgcccggctgcttgcagcccgcgacacagtgctcccttcgccttcgccctttccacctcgcggcaggtcgaaatgaaggctgtgtcatttctggaaggaaactggcccagcagatcaagcaggaagtgcggcaggaggtagaacgagtgggtggcctcacgcgcgaacaaacggccacaccgtgagtgtgatcctggttggcgagaatcctgccgaagtcacgtccatatgtcctctaacaaagaccagggcatgctgcagttgtgggaatcaacagtgagacaactgatgaaaccagcgttctaggatttcagaggaagaattgttagaatttaatcaaataagactgaataatgatgataatgtagatggcctccttgttccagtggcctcttccagaagcatattgatgagagaaggatctgcaagtgctgtttctccagacaaggtatgtttgagtggcttgtcatgtaagttaatgtaggacgaatgtgtgggatcagtattccatgtgaccggctactccatggggtgtgtgggaaataatcaagcgaactggcattccaaccctagggaatgaatgtggttgtggctggaaggtccatacaaacgtgtgaatgcccatgcaaggttacttgcacacaggatggggacgccctgaacgtccgggagggtgatgcccctgttaccattcatcgcaatcgatatactcccaaagacgccagttgaccaaacatccaaatctcgcacaattttggcacactcggcgacagtattcccactttcgtcaccggacatgtccaaggacaggccagacagg

SEQ ID NO: 610717 - DNA, 87 bp, Homo sapiens
  misc_feature (13)..(13): n is a, c, g, or t
taaacttttttcntttttttggttgttggtagttttggttttttacattaattaaacagcaaaaaacatggttacagtcaagcttca

SEQ ID NO: 610718 - DNA, 218 bp, Homo sapiens
tgaaaaaagtttttgaaaggtatttttgtgatgggctatgttgaggggaaaccaaatatttatgattttaaaccattggtatgaaaacattggccaatgtaatatgctcaactttttcaatttttttgctaatttttttaagatccattaaaaatgttttatatttttttttaagtaaaatgggcccagtaagaaaattaaaaatacccggacatcca

SEQ ID NO: 610719 - DNA, 434 bp, Homo sapiens
gggcaggatcagaccggtcttcgggtcggccacctggctcactgctgttctcagctgctgttgatggagacagtgtttgactttcgtagtgtggcctttattacgcaccagaatgtcctgagaagcggactgaggcccaactctgagaggtgcagtttgggcagaccgggaatttggggcagctgtgtttgtgcttggagaccttttttgcttggtgcttctggagggtcgaggtttctcaaatctgagtgccgaatcaaagttgagttgtactgagagagccgcagttaagtaaatgtatgcagacttcctgtcaggtccagccgcgggagcacattggttgaattattcatttggtttgcccttcaagtgtttagttctctttttttgggaaaaaaaacaactctgtggggacacttggatagagaggattt

SEQ ID NO: 610720 - DNA, 435 bp, Homo sapiens
tattagagagggtgtacgggagtcacttggtaactccagaatcaggatacaatgtctctttgctatctgaccttgtaaaatcctccggcatccaaggattccatagtgcatcaagctggcatgtagaagcgaaatagttttgcctcgtgtctttgaaaaatacttccaattccaagaggagggcaaggaaggagagaacagggcagttatccatcgtagggctgatgagaccatgtatgttgcgtctaaaaaggcacagcagtcacagtagtcttcagcacagtgtttaaggcatgacgacgatgtggtcattggacacaggtgtcatgcaggcagttcaaagaaggacgcagcgccagccacacagccccacaggtcctctttagccacagggcacctcctctggagctgaaagacacagccgccgctgtgggt

SEQ ID NO: 610721 - DNA, 427 bp, Homo sapiens
cgcattcttcaaagctatactctttatatgctctggctcaatcattcatagcctggcagacgaacaagacatccgaaaaataggaaacatcacaaaaatcataccattcacatcatcatgcctagtaatcggaagcctcgccctcacaggaataccattcctaacagggttctactcaaaagacctaattattgaagcaattaatacctgcaacaccaacgcctgagccctactaattacactaatcgccacttctataacagctatgtacagcatacgaatcatttacttcgtaacaataacaaaaccgcgttttccccccctaatctccattaacgaaaatgacccagacctcataaacccaatcaaacgcctagcattcggaagcatctttgcaggatttgtcatctcatataatattccacca

SEQ ID NO: 610722 - DNA, 159 bp, Homo sapiens
  misc_feature (32)..(32): n is a, c, g, or t
  misc_feature (34)..(34): n is a, c, g, or t
  misc_feature (36)..(36): n is a, c, g, or t
  misc_feature (118)..(118): n is a, c, g, or t
agcactgtccagagcttttttttctcattaantntnagcgggtctcaaaattctgtgacaaattttcggtcaagttgtttccattaaaaagtactgattttaaaaactaaaattaaancgccacacgcaaaaaagaaaaccaaagtgatccacaaaaca

SEQ ID NO: 610723 - DNA, 359 bp, Homo sapiens
  misc_feature (241)..(241): n is a, c, g, or t
tttggcctagggggggggaaggggggcccccttccttttttgggccccggaaacattggcctgggggtgtcccccaaaagggggccgtttttaaagggccggggcccctcccctggggttttttggcccaggtttgggcaacccgggcccaggaagccccggtggggtagcctagggcctagtttctgcttgggcccccaaatggggggggggggggattgggtttgggggtttccttttnccctttttaccccccccccccccccaatcccccccccccgtttcccccccaagggcttttcccctgtgggtttggaaagggccaacttaaaaaaaaaggggccgcggtgggttttcca

SEQ ID NO: 610724 - DNA, 284 bp, Homo sapiens
aaaaaaaccggggggggttccccccccgggttttttttttgggggggggggggggtaaaatttttccccggggaaaactttttcccttttggccttttttggggccccttttaacccagtttttcaaaaaaacggggtggggccggggggggattttccgggtttttttgccccccggggggggggggttttccccccaaaaaaaattgctttttgttctccccccccccccccccttcctggggccccccctggggggttttttaaaaggggttgggggggga

SEQ ID NO: 610725 - DNA, 309 bp, Homo sapiens
catccccgcccgcccttcccccggggtcgcccccgccgcctcctggcgcttcctcgctgcggcgactcctgcttggccgcccgagccttccttccagaagcccgcaagtctcccaaggtcactcgggacccttgtgtgcctggcctagcccagaggctgctcacctattcattttcatccgtactccaggaaataccaaaaagaaggggtcctggaggagagagatgggctgccgtgggtaggagaaaggagagggctaggagaccccgtaacacaataaaaagagactctccagcggaatcttaaaaa

SEQ ID NO: 610726 - DNA, 168 bp, Homo sapiens
  misc_feature (114)..(114): n is a, c, g, or t
  misc_feature (136)..(136): n is a, c, g, or t
  misc_feature (152)..(152): n is a, c, g, or t
agtactgggttcgagttctcattccatttcttggatgccactggacactgtatctgctttggtaaaaacctccaaaaagttatacatcaggtatctctgagtcagcttcctccnggtgcccaccctcttgccacangatgacgtgatcactngtgaactggtggtgac

SEQ ID NO: 610727 - DNA, 256 bp, Homo sapiens
  misc_feature (3)..(3): n is a, c, g, or t
tancagtgtgtcacatcttaagtggaacagacacgttcatcgggtttatagattccagtaaactaagttctgggtgttgagaaaaaaatggacatgtacataagaaatttaattccaaccagagtaacagaaactggtaaaaggaatgaacaggtaaatgaggcgaaagcccgatatctttaccagggaagtaaaagactatgtttattttccccatttttcttcacaccagcctgaaaagggggtaccgacgctc

SEQ ID NO: 610728 - DNA, 106 bp, Homo sapiens
  misc_feature (91)..(91): n is a, c, g, or t
ccccgcggcatacgcacagttaccggagggcatccagagtcttctgggtggagtgatggatggcgtgtggtcatgagtccttccacgatancaaagttgtcatgga

SEQ ID NO: 610729 - DNA, 329 bp, Homo sapiens
tggaatatgctaaaggtctacagaatagaagatggttcttttgctggagatatttggggagaaattgacacaagattctctttttgtacggtggcaactttggctttagttggggaagcttgatgctattaatgtggaaaaggcaatcgaagtttgtatttatcctgtatgaaactttgacacgtggatttggttgcagaccaggttctgaatcccatgctgggcagatctattgttgcacaggatgttctggctattacagagtcagttgacatcaagtaaattctgatcttaaattggctggtggcttagtgaacgacaatgaccct

SEQ ID NO: 610730 - DNA, 449 bp, Homo sapiens
  misc_feature (1)..(1): n is a, c, g, or t
ntgaccgttgccttcgtcctcgccaggcatttctggcagctcgggcactccactctgacagaggagagaggccatttcttttactgtctcctgtctctgaagagaaggatgaagtaaaagttgaaaaacaacaggaatgaagtttgtagcaagaccagcgcggcccaccgatgaccaggcctgaggttaaaagattaccccccctcccactctaaccacatgtgatctcaatttatcacgaccctttcacgtggaccccttaaaggagtaagttccctaaatggccaagaactctgctttcggggagctcggttgtggagacgccagtctgccgaagctccgggtcgaataaaaaaaaaacctttcttaaaaaaaaaaacatcggtctctttggccttagtggtggtaatttccggacgcttgtctgcattgaggtgtagtttaggata

SEQ ID NO: 610731 - DNA, 376 bp, Homo sapiens
gtcgtactgtacacaagccccatctccagtcccggctctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaaaagtcgacgcggccg

SEQ ID NO: 610732 - DNA, 306 bp, Homo sapiens
  misc_feature (17)..(18): n is a, c, g, or t
  misc_feature (102)..(102): n is a, c, g, or t
  misc_feature (189)..(189): n is a, c, g, or t
ggcacgagcgctcgcanngccgtgccacctgcccgccgccgctcgctcgctcgcccgccgcgccgcgctgccgaccgcagcatgctgccgagagtgggctgncccgcgctgccgctgccgccgccgccgctgctgccgctgctgccgctgctgctgctgctactgggcgcgagtggcggcggcggcggngcgcgcgcggaggtgctgttccgctgccgccctgacacccgagcgcctggccgctgcgggcccccgccggttgcgccgccgccgcggtggccgcagtggccggaggcgcccgcatgc

SEQ ID NO: 610733 - DNA, 395 bp, Homo sapiens
gcagaacatgatcgctgatagcactgatcctcgtgccactatttgtggctcccaaattatctaagacagtagagcagatagccagattcattgtgaaattcttacagcaaatcgtttatgtaaaaaaatgtttagtttatacctatacctttcctatacctaaccatactcctaacttcctaaccttccatacttctataccttccttaccaaccatctacctataatatcctataccatactacctaccctataccatctaacttacctaacactatccttaccatatatctaacctaaccttacctttcctatccatactaccgtaccctaccttaccttaccaatctactatcctatccttaccctactaccttaccttacttatccgtata

SEQ ID NO: 610734 - DNA, 383 bp, Homo sapiens
atattactagatataagataaggtctcactctgtcacccaggctggagtgcagtggcgcaacttcagctcactgcaaacccaacctcccgcactcaggtcatcctcccgcctcagcctccagagtagctatgaaccacaggcatgcaccaccacatccagttaacttttgtatctatttgtagagataggtcacgccatgttgcccaggctcacaaattaactatagctagtggccccctgaattagccgtcaagtcaggattcagcgccaggttcagaggctggactctaagattcacgctatcatatcacactgcctgacctgttaaaccagcagattcaattctggataagtgacaggccctctgagtgagtgagctcaa

SEQ ID NO: 610735 - DNA, 894 bp, Homo sapiens
  misc_feature (37)..(37): n is a, c, g, or t
aacacgacagcggctgccgagcgacccggaagtattnattttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttgggaggttaatgccatcaagaagtgaggccgggcaccaatggtaggatgccctgtgacagctgatgtcatcaaccctattgcttgcgacaagcgagaggagctgcgggagaagctggcggctgccaaggagaagcgcctgtgaaccaaaagctggggaagataagaccctaggagaggatgaccgtggtttggaggagactgagctggatcgagaggagctggaggtgcagaaggagaaggcctggatagaagagggggaagttactggagggagatgacaagagttggggtgaaatctgttgaggaagagtcgggaaggggggggtgtaagtgagggatggggtatgtggatggcaggtacttcgaggggagagagttacatggatgtatgatagggga

SEQ ID NO: 610736 - DNA, 760 bp, Homo sapiens
gctgagcgcccggggcaaaaccgaagttggaagtgtctcttagcagcgcgcgcacaagaacgggaagccagcatcatggagacaacaggatgtggaaaacgcatctttaggattcacgatgaagaggaagagccccaggctcctcaagagagcacaccagctccccctaagacagacatcaagggatcctacgtttccatccacagctctggcttccgggaatttctgctgaagccggacgctcctgccgcgccatcgctggactcgtggatttagagcatccttctgaggtcccagcatgagtgcattccccaggccatccatgggacatggacagtctgatgccaaggccaacgtcccggggatggcgcaagacagaggaactacggtgcatgacacacccaataacagaaagattgagcactgtcaaaacggaacagggtgaaccgagatcacatggatcaatgtgccaacacgaaggcaggctgggacttaccagaactcagacaacggcaaatcatggagcggctttttccccaaagtaacaattgccgcaggccgatccaacggtggttcctggtgatacataacaggagtgatacatccacccaacaccaaagcaaggattgaacgaccgtgtagaaagacagcacagtgtccccaaatgtcggtgagacggagaacaccacggagcccggacatacatggcacgcacgatgcgaacatagcagaaccagcctcaagcaatgtgagaacaagg

SEQ ID NO: 610737 - DNA, 868 bp, Homo sapiens
  misc_feature (37)..(37): n is a, c, g, or t
aacacgacagcggctgccgagcgacccggaagtattnattttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttgggaggttaatgccatcaagaaggcccagtgggcctggggcataggcctcacgtcttgggccccccttccagaaggcgggcaccaaggaggagcccgtggacagctgatgtcatcaaaccttaattgggcctttggcggaaatgcgaaagagggaggctagccgggagaaggctgggcgggttggccaacggaagaaagcgctggtgggaaacaccaagatgggcgggaggaaaaaaaagccctggggaagatgtaaccccccgttggtggcacaattcggcgtggagttaaagagggcccggatttggataatggaaaaggcttgggaaaaggggcagtttgggggaaggccaatgtgggtgattgggggaac

SEQ ID NO: 610738 - DNA, 225 bp, Homo sapiens
gagccaggccacagggaggaggcttctttgtgcgtctctcctgcagaggctcggggtctcagggtcttacggcgatacgggagacgaacgaacgtgccaggcaggaggccccctgaagtctgtgtactccgacgctggatctccatccccatccacctgtacggacatcttttccgttgtggtttcagaatgtccctataataaacccctccgctttgttcttaa

SEQ ID NO: 610739 - DNA, 103 bp, Homo sapiens
aggctcccccttctcaaggatgagaaattgagcagcatggtatggtgcgctctgagataagtagtactaggacatctgtgtcccagattcccttctacagttc

SEQ ID NO: 610740 - DNA, 692 bp, Homo sapiens
acccgggaggcggaggttgcagtgagccaagacagtgccagtgcactgcagcctcggtgacagcgcaaggctccgtctcaggtaattacagaaaaaaaaaaaacaaagggccggcggcagtgggccctccagaccggcaataatcccccgccacattgggagcaggacaggcagagcggcggcggcacaaccaccgcgaagcgcacacgcgagcattcggaagaatccaagccctgtggcaaaccgacgcgacgaacaagctccccgtcgctcaccacatcaacatatcaacaacgtgacgccgcaacacacgacacgcgcgcacaccagcctgccagacaccgccagcgcaatacatcccgcggtgcagctgcttcattgctggtttctaccaagaacatactggcccgtgagtaaccaccattgggtgatgcggctacacaacgtcgcacggccacttatagttccgccgcgcaatcaatactaagtcccagttgttggcgtcactccccagactctggtgcggtcgaacatcaataggacgttcgtagacataccggcgcatagttctactcacccgcagaacgccctcacatagctcggttagactacgcacgcaagcgatgtgccgctgcttctcgacaaatagggtcagacaccaaactaacgcgccacatagtctactgatgcga

SEQ ID NO: 610741 - DNA, 655 bp, Homo sapiens
tgggccccggggaaaaaccgttttaacggggggggcttttccccccccacaaaaatttttaaaaaggggggaaaagaggggggggggggggggggggggaggggaaccaccccaccacctgaaaggaccaggagagccctcctgtgcgagccggacctacgccgtcggagaacgagggtggaggggaggagggagcacgagcggcgcgcgcaacactacccgcgggcgcaacacagctctcccaccggggggagccgccgcactggtgagagcagcaaagtcctccccatacacatatatatatcacaagcgaaaacgcggtctaaaaaaaaaactatgtattctactttcttctccagaggagagaaaaaagaatctacgctcacaataattatgatggagcaaaagaagaccgccggcggtggtggtcggcgcaccgcgtggggatcattatgtagaggcgggggtagcgagaagaagagacgagtcaacgaagaaagaaggaagcggaggacaacgaagtcgttcgagcgcaccacccaactcttgcggtgtccacacggcgggggcatcaatggcgcgggggcccccctaacaggaaggcgcgtatcaatagaagaaaacgcgcagtaacgcgcgttagtagtacaccgaa

SEQ ID NO: 610742 - DNA, 354 bp, Homo sapiens
  misc_feature (47)..(47): n is a, c, g, or t
  misc_feature (152)..(152): n is a, c, g, or t
  misc_feature (248)..(248): n is a, c, g, or t
ctaaagagatcctttgatattttcaacgcagccctgctttgggtccnctggtgctgccacacttcaggctcttctcctttcacaaccttctgtggctcacagaacccttggagccaatggagactgtctcaagagggcactggtggcccgancagcctgggcacagggcagtgggacagggcatggccagggtggcacttccagacccctgggctttttcacttgctgggctgccttaggaacctttntttacattaggcagttttgcttttgttatggcacttttgttttttttctttggggtcttgtttttttttttccactttaggaaattgcatttcctggacaggaagg

SEQ ID NO: 610743 - DNA, 315 bp, Homo sapiens
gaggcatgaaggcggccatgacaacatggacatcgataagtgatgagttaatgcagggggtagctgaccagcaagaactcgcagaggagatacaacagcaataacgaaacctgtagggttaggagaagagtccgacgagaatgagctcatggcggaattagaagaactagaacaggaggaactagacaagaatttgctggaactcagtggacccgaaacagtccctctaccagatgttccctctatagccctaccatcaaaacccgccaagaagaaagaagaggaggacgacgacttgaaggaattggcgaactg

SEQ ID NO: 610744 - DNA, 120 bp, Homo sapiens
tgaaaagcactcagagtttcgtgtgtgcttccttcagccctaactacagcattagcatcacctcacgggtacatttgtaataaacctcagcaaaccttacctgaagagcacgtcgacgtt

SEQ ID NO: 610745 - DNA, 352 bp, Homo sapiens
gctcccacagaagagcaatccgcatccagaacaatccatcagaggttgaacataaatggctgtaacagacgctcgtgcaagcaccaccccgttgatcgaaaggcgttcgatcgactacatcccggaagcggaaagacacggccgtctattgagtcagttcaccctgtggttgggtgccaacctgcaaatcaccgcgattgtcaccggggccctggccgtggtgttgggcggtgatgtgttctggtcgttgatcggtctgttgatcggtcaactgctggggggcggcgtcatggcgctgcacgcagcccagggcccgtcgacccggccgcgaatttagtagtagtagtcgacc

SEQ ID NO: 610746 - DNA, 642 bp, Homo sapiens
agcggatgaaaaaacacattgcaaagatgtttttcagaatgttcctatctagtatttatgtgaagatatttccttttccaccataggcatcaaagtgctccaaatgtccacttgcaacttctactaaaggagggtttcaaaactactcaatcaacaagaatgttttaactctgtgagatgaatgcacacatcataaagaagtatctcagattgtttctttctagattttatgtgaaaatatttccttttctaacttaggctgcaaagtcctccaaatgtccacttgcagattctacaaaaagagtgtttccaaactggctcaatcaaaagaaacattcacctctgtgagatgaacgcacacatcacaaagatgtttctcagagttcttctatctagtttttatgtgaagatatttccttttccaccattgtcctcaaagcgctccaaatgtccacttgcagactctacaaaaagagagtttcaaaagtgctcaatcaaatcaaaggtttaactctgtgaggtgaatgctcacgtcacaaagaagtttctcagattgcttctgtctagattttatgtgacaatatttccttgtctaccatagtccgcagagaacacaaaaatgtcctcttgcagattctacta

SEQ ID NO: 610747 - DNA, 441 bp, Homo sapiens
  misc_feature (318)..(318): n is a, c, g, or t
  misc_feature (352)..(352): n is a, c, g, or t
  misc_feature (359)..(359): n is a, c, g, or t
gtatcaatctattatgagagtttgacccatccaaggtaaaatgaatcaagttcattttacacacttaaacatgtaggtcttcctttgccatgattttattttgatgtgttttactgaattgcaattctaacaaattgactatagaagtggtggttgttatccaccaatagaatatacaggctacagaagaaggtccacgaattcatgaatgaaaatagacttgtatatgttttaaaaatctataataataaatgttctcatgaatgtattggtgattaaccttttatagatcagatgttcccatcagaatccaaacangagggagatgaagaataatctttggaatccgggnaactggngattattgatgttataattctctaaaaatataaatgtgagtgatgtgaaaatataaaatcagaggctttgacttggttttct

SEQ ID NO: 610748 - DNA, 386 bp, Homo sapiens
  misc_feature (140)..(140): n is a, c, g, or t
  misc_feature (157)..(157): n is a, c, g, or t
  misc_feature (304)..(304): n is a, c, g, or t
taattaaaaatttttttttgtgacagggtctcactgtgttgtctaggctggtctcgaacttctaagctaaagcagttgctcacctttgcctcccaaagtgctaggattataggcttgagccaccgcgcctggccaaaagncttgtgtaatttaaaantaattttagtagaatatcttttattaagcagcttttggtcaaaatgaaaatgaactaagcaggtctttggagatgcaggagctctgtgtggaagtcaagctagagtttcctggggcctgttggtttgtgggctgagtggagaatagngaggagcttccttgggtatctggtcatggaggcttctctgaggttagtcaaggcaccaggaagtggtggggagagtttccac

SEQ ID NO: 610749 - DNA, 199 bp, Homo sapiens
gaccaacggtctccagagggctgcaatgctgtgatgtctgacacatgtcctactgagacagcacagaccaccctagcaagcaacatttgtattagtctgaacaatatatacttatagaattcagtcaaagatacacaatctgaaacagctacatggggtggacacataacaagtagtagcaatagtatcagaatgcagc

SEQ ID NO: 610750 - DNA, 533 bp, Homo sapiens
aaccacattcccgaaacaaaattgttttgtgttctacacttcaatcataagtgagcttgtggggaaatttttggtataataggtggcgcttgaatagcattagcatggataggggatttgaaaacttttattttgtgtatgagctacataaaatgtccctgttatggctgcagtcctgtcgatgcataatgggattttaaaaaacttgtttggtttggtgccactttgaaaaaatttgtagcccccaagggatgttagggtttaagaaatgagttgatggatccaacaagccaaaatagcacaaattaaaagggaattttttgtttttcaaaattttaatacgtaatacgcaggcatctgatttgcatattcattaatggaccactgtttcttgcttgtacctctggttgactaaatttggggacagatttagtttggcttacacaaagggatcattaaggtaaatttatttctatgtctaatactggtactggataaacagtttgtaaagtattttttggaaacaaaacctt

SEQ ID NO: 610751 - DNA, 128 bp, Homo sapiens
ctctgacgatccctcagaccagcggacccccttcttcatgactgcctttgaacccgggtagctcaggcccatggactggagcctccagacttcttcttcttcttgttcttgggcacgcaccatctccc

SEQ ID NO: 610752 - DNA, 172 bp, Homo sapiens
agggagaaaaagcgtacagatcaatgagttacaaactcagtccccgagctgtctcctctgggactatgcagctctgggactacaatatccccaaatgctctcctctccacaccgctctaagtgagtgttccaaaatgcaactccaactcctctcctctctccgtgtttaata

SEQ ID NO: 610753 - DNA, 727 bp, Homo sapiens
caaggttcatcctagaagtggaaaaatgttgggtcccagatatctgttatgcagttttcccaaagggactttccttaaaaaaaaaaaaaaaaagagtaatgataggtcctttggtttaggaagcactggaatttgaacatgggacaacagatattttaggaatgaagtccctggtggattagtacttcttttctaatacatttgtatacattacattcagatcatcatgacttggatgacaagagacattatggcctcgagggtggctgcctcagctctggtttgccatgtaggaactgacagacagtactttatactcatttcctggttttcatcaacagaatgggagctcagaaagtccatttccctggaaaccactgggtcagcaaaggcggctgaaggtgcagcccatcaaagaagaaggggcatgggatggtggcatgtcaagcatggggagtaccttgtggcatcaacacccatcctccagtacactctaggctgagctcaggaggacccagaagccacagacacacccagccaagtggccttgataatatggcagccaaaaagggaactagatgtaatattgactttatttataaattggggcctctcctgatgtcgggtattccctttagaatgcccatgatgatataccttacctccaagcagtatggactggacctcgttataagatacctaccaatacccacagcccctgagatga

SEQ ID NO: 610754 - DNA, 1723 bp, Homo sapiens
  misc_feature (1031)..(1031): n is a, c, g, or t
  misc_feature (1530)..(1530): n is a, c, g, or t
tttaagggggaatgatggtatgtcttgggatatcctacagcgatggctatgtgaggagtactcctgaggcttggtgggtcagggtgttgaggctttggggtgaaggtgtttaagagtggggttatagcgaagtgggaggtaggaatgtgggtgctgggggtgtgaaaagaagtttatgagtgggggtgggtgggtgtggtgtgtaaactttatacataggtgttagagaacgcatagaatataatttatatatagaaggagaaatggtcgctccacaggggtatagaatctccggagatgagatctccctattgtgggcgcgaggggcgctcttcgggtattagatctatattttggcgcgcttatagatatataagcgatagatatagtgatatacgcgtgtgtgtgttagaacccattatgtgtgatgtgtgtgtgtgggtgtgtgtatatatatatgtgtgggatacatgatgtggacaaaacttgttgtgccgccgcgtgggggaaaataatgaggtgtataatgtgtgtggatatataacgggagagtaatacagagaggtgtataaagaagaatagtagaaccgttgttgtgagaaaacagaacaaaaaaacaacagacaaagaaggaggacactgtaatataaagggtagtatcaaaactctattattattgctaccctataatatatggaggggagtaattatgaagagcggtgtcgtacaactagtaaccgttggtggtcaacggtggtagttatgcagtcacaaaacacaaatgattggttggcaggagtcttggcgccgcttggtgtctgccaaccaccaccagtgatggtggtatatatacaaaagaagggtaatctaacaaccaactcaccgggccacccctcaatgttactaccactacagagaatctctactcgacgggtgaggtgactaatacgaggcgggtgctctcccaataaccaggagaagaacgatccgataaccgcattcatctaacgggcgggtcgtgtggccaccgnaaggaaaggaatattaaaataaggtggggggagcacccattcccggatactaaacaacggacagcaaaagcaacggtggctgtgccccccacatctacggaaccaaccactgcagcgcaggggcgagaggacacacacaacacatgtatggtgcggaaggctgacccgagacgaatgaaagtgaccaatagatgactctgacaaaagaatggcagccccataacggcagggagagaaaaaaataaaaaaaaaacccttcccccgaggacaagagagcaacaaccgtaggcatctagcggacggccaagcagcaaaaaaaaccactattacacacacacaaccggttgtgcgtgggcggcccaaaaatctaaaggaaggaggaggggagagcaggaaaaaaaatactaacacaaaccaaactattctatgatatagaaaacgggacgaatatatcagagagaattacgatgaacgaaacccccccccggtgggaaataanaaaacggacgacaagcgactatgagacaaaaagaggagtggtctatacccaacacgaccgcccggaggcgcaacaagccatcatacacagtcacaacccacaatcacgattgatgcatgggggcacgagcaagatccaagcgcctccccacgacgggcacgcgcgccgacgtagaacgagaccagcacaccaa

SEQ ID NO: 610755 - DNA, 385 bp, Homo sapiens
ttttatcctttcctttttccccttaaggttcccctgaaattttaaaaaaccggggtttttttaacggtggggtctttctgttttttggggtcccttttttaaaagtttaaaaaaatgttgcccagggggttccgtttttaacccatgacttggggatgaaagccaaccatttccggcggtggggtttaaaggggtttagtcccccctgtatggggaagtagtttcggggatgctgttgggaaatttaaaccggaaaagtaaatggtttaaaggcctgggttgttgctctgtatgggaaaaactaattttggttcgtcaggggcaaaaatactaatccctttttttccccctttcagcccaaaaaaaggttgggtttttaacccca

SEQ ID NO: 610756 - DNA, 216 bp, Homo sapiens
  misc_feature (131)..(131): n is a, c, g, or t
  misc_feature (147)..(147): n is a, c, g, or t
  misc_feature (155)..(155): n is a, c, g, or t
  misc_feature (191)..(191): n is a, c, g, or t
cgcatggtggacacgttcgaaggaccccgcctcttcagcggcaccatccgatttaacctggacctgagaggaagtgctcagatagcacactgtgggaggcctggaaatcgccagctgaagctggtggtaangcactgcaggaggctngatgcatnattacagaaggctgggagaatttagcagggcagagnagtgtctgctggccggccttcgtag

SEQ ID NO: 610757 - DNA, 1420 bp, Homo sapiens
gtgaaatcgaggctcggtgagacgcataagagaggcgtagtcgatgtaaatattgaatcggaaaggagagaagcaaggtagtactggacgacgctatggattagctggtaggtgtgcagatgtcgtaagtcgctaggtaggatgtgtgcgcttctggaatctagcaaaagtccgggtgctactcagttagcctgggtaagaatataactaatctcgtgacagtcacgacttgctatctggagttgtcgtgaaagaaaaggtcgacttgaacgcgaagacaattatacccctccatggaggcttagtttgatctcgcagggacctagggtcgacattccactggttgccttcctttgcaatccagacttgtctaccaactcgcgactggtggaatgggaatcacatgggtaggcctaggggacacctgggtgacaggagtgacaggaggagagagaaatgcgtcaagacgccaaaatggcacatggctggtggcggaaggatcacccaggacaaaagacgcggagaaatgatccgtgtgggcgccttccaaagaatcggggcttcttggggtccattgggacgagactgtggacagatgggactttcatagagttgaatttggccacatgggagagagaaaacttagtccatacgggaaggcttgatgttcggtttaaagaacaattaaacgaagacagtggaaacggttggttgtccaggaactcgtgtgatgcttgccaccaaccttagattggaaatgaaatggtgggtgtgtgcgtggcaggtcaacacaaggggacatgttgccccattccagtacggaggcaacaaggggcaagaaggaagtaatcggttataagtggcagccaaagaatacaaagagaagtacaaagcggtggtaaacacacaaggtacaaggctggggaccccagccgtaacccagggtaagtgccatgtaagaagcaaataccactgtacgcagggaatcaaataaccgcagcaacaaaggacagtctggcacacagggaggtaccgtgaaaacaacatgacgagggggaccaaaacaagggggcaaaaaagtaagaagaactaaagaacaatgggacgaaggccagataccgggggaaaatacacacgtggacccaacgaaacatggggggccaccaccgtgagaaaataagaagcacagaagaaggagaaacacaaaaaacaggagaagaagccgagagaccccgacaagaggagacgaaccaattatgatagggagcagatgagcccacaacagacgaagagcagactcaacagaagataaagcaaaaccaaagccagaagaagataatgtctgcacaaacaagcagccagcaacacgaagactgtgaaagaaactagagagacaacagacataaagagcagaaagatt

SEQ ID NO: 610758 - DNA, 949 bp, Homo sapiens
gaaaaagaatggaaaatcttgaagccttagaattaggtaattgtggccgggcatagtggctcacccttgtaatcccagcactttgggaggacaaggtgggtggatcacttgaggccaggagtttgagaccaacctggccaacacagtgaaactccatctctactaaaaatacaaaaaattagcccggcgtggtggtgcgcgcctgtagtcccagctactcaggaggctgaggcaggagaatctcttgaacccgggagacagaggttgcagtgagccgagatcgcgtcactgcactccagcctggcgacacagcgagactccgtctcaaaaacaaaacaaaacaaaaaaacacatgccgggctcggtggctcatgcctgtaatcccagcactttgggaggctaaggcaggtggatcacctgaggtcgggagttcgagaccagcctgaccaacatggagaaaccccgtctctactaaaaatacaaaattagctgggcgtggtggcgcatgcctgtaatcccagctacttgggaggctgaggcaggagaatcgcttgaacctgggaggcagaggttatggtgagctgagatggcaccattgcactctagcctgggcaacaagagcaaaactgcgtctcaaaaaaagagaagaaagaaaaagaaaatgggggccggacgcggtggctcacgcctgtaatcccagcaccttgggaggccgaggtgggcagatcacctgaggtcgggagttcgagaccagtctgaccaatatggagaaaccccatctctactaaaaatataaaattagccgggcgtggtggcacatgcctgtaatcccagctactcaggaggctgaggcagaagaatcgcttaaacctgggaggtggaggttgcagtgagccaagatcgtgccattgcactccaggctgggcaacaagagcgaaactcatctcat

SEQ ID NO: 610759 - DNA, 550 bp, Homo sapiens
  misc_feature (86)..(86): n is a, c, g, or t
  misc_feature (96)..(97): n is a, c, g, or t
  misc_feature (166)..(166): n is a, c, g, or t
ctagctaactacgtaggtgtcactcccggcgcttgctagcgcagatatctgtgcaccgcatgggagtaggagacatacgtagctcngcaggagttnnttttgtgttcttttgttgtttccatatatgtcacgaaagtgttttaatataacacactctcatatatantaaaacctctttttctgagaaatgtgtatatctgtgaaaacacatgtgaaatatctcactcttatacacaagtatatagcgcctcgtgcgctatttctataagagcactctatatctttacacattataaaaaactctgtgtttgatatatatagcgcacaaaatatcctccacagagaggtatatcacatcgtgtgttacacacagagcgctgagaagatttctgtgctttgtactcttttcctctttataatatataccgagagggttcacaaaagagctgggtctcaaaagagccttacacccttggttggggtggggagaaacgctgtacgtggtgtgttctcgaggtctatgtgcgccgtggcgatggtgggcgtgtgg

SEQ ID NO: 610760 - DNA, 125 bp, Homo sapiens
cggaaaccgtatatggagagagaggtgacagggatcaaagaagtatgtacagcaaagaggaactggaactcaagacaagaatgaggacaagaaaaaaagagaataagggctttgttattttctta

SEQ ID NO: 610761 - DNA, 420 bp, Homo sapiens
  misc_feature (57)..(57): n is a, c, g, or t
  misc_feature (243)..(243): n is a, c, g, or t
  misc_feature (377)..(377): n is a, c, g, or t
  misc_feature (397)..(397): n is a, c, g, or t
atcttttctttttgagacagtcttgctctgtcaccagccttggagtgcagtggccgntctcgcctcactgcaacttccgcctcccaggttcaagcaattctgcttcagcgtctccaacagctggaattacaggaacgcgccatcacgacccgctaatttttgtatttttagtagagacggggttttccgtatgttgcccaggttggtctcgaactcctgggcctgaagtgatctgcccacctncagcccccaaagtgctgggattacaggtgtgaatcactgcacccagccaaatgtttgtatttctttgacattattctttccccaactactggcttaaagtttgagtgctcaaataaattgacttttaaattttncacatatgggtatagggttnccgtgtgtttaaggagggacggt

SEQ ID NO: 610762 - DNA, 572 bp, Homo sapiens
atacatactgcgagaaccatcatgagcttctgggaggccgggctgcatacatgtgctgctgcgtgcagtccaaagaagttcttgttgcgcaggacggggaaagttacctgcagccaatacctaatattcatagtgggaaagggagagagagtggaaaagcgctttaatctttgagggccaggcattttctgtgacttggaaaagaggaatctctgcccagagccgaatccacatgtcagaacggtgtctgggatgtctgccctcaacaatgacatctccctcatataatgtttcaggaccgggcagaaaaccctccaaattgccagaaggacagactgtacctccaacagctgtggcaccaaaagtcttcttaggaggcacccaaagccctcccgagatgggggcgggccctcccgatgaggttgtaagggggccagcctccaggtgcagggacacctaactctggccaagcaactgtaataagcaatttacctatctcactccatccccacaacagccccttgtaggcagacactacagtcattccccttttataaaggaaggaacaggct

SEQ ID NO: 610763 - DNA, 243 bp, Homo sapiens
gtccgggagccttacccttgaggaccagtcaagctgacttcacactccccacacagaggatggaggtccttctgccaccgagagggctgctgaggatggagcctccagtcagctcccagcagcatgagggctctggtggagcatggacttcacctattgaaacctcggtgggagaatacgggctgtagtgggccgtggatgcctgacctgcctggaaccatgtcccctagtggaatcatgggt

SEQ ID NO: 610764 - DNA, 921 bp, Homo sapiens
ggaggaggagggggaggaagcggagctggacggagacctgctggagtgaggaggagctggaggaagcagaggaggaggaccggtcgtcgctgctgctgctgtcgccgcccgcggacacctgcctctcagacccatgcatgatcccagtgcgggtccctggggtctgtgctgctgccagcctgcatggttctgatgccctgggaggctggcggctgggctggcggctggggggggtgctgtacgtgaggggacgatgcccagtggcatgatggcggcgatgctgtcccacgcgctacggacccggacggtagtggaggcggcggatgtgacgacctgaatctggaggagcagtgcaggacctgaatcccggagaaagagcgtcaaacacacacacgagtgacgtcccggtgcacacaagcttccgagacaacgtcagcacgagatcgtacggccgccaagggttgtaacaattaaaagcactgagagccaagacaaaaacacggtatatcaacgactccttgtacgatgggtgaagagcccatataggaggtcacgtgcgaaggaaacagaagatgttgacatggccaaaagagagatcctactcagacgtgaagaagcagcttctccaatgattcgtgcaatctcggaaaacaaagattgggaccttgccctgggaggcattatcatgtaggtcctaaatcatgacccggtaaaaacacaacggcccaagataaggggtccttaatcgagtggaaaggaataagtgagatggagccaagaggacgcaatattgacaagaattaaaaaatgaagaacaagaagtaacatagaaagataggagaaataaataaggaagatgagtagaaagcgacaaggattggatggagatgagaacggaaaggaaaaaagagatgatatgca

SEQ ID NO: 610765 - DNA, 416 bp, Homo sapiens
ctagggtatatacccaaaggacatgcggtatctactatttgcacttgcttattcatttcagcattattcactacagctaagatatgaagacaacctaagtactcgctgacagatacatggagaaagaaaacgtggtgcatatccacaatggaatatcatttagccataaataaggcgatcctatcatttgcgacaacatggatcaccctggagcacattatgctaagtaaatgagacagagacaaaaagggaaatactgcatgatctcacttagatgtgaaatccacaaaagtcaaaatcatagaatcagagccgtacagtggttgccagggggtgtgggaaaggagatgttggtcacagggaacaaactttcagttatgtcagatgagtcagttctgtggacccagtgtatagca

SEQ ID NO: 610766 - DNA, 130 bp, Homo sapiens
ggatcccctcagggcgagctgcactcaggggcgagctccagcgtcagctcgtctggctgctgagccacgtatgggtgcacgcactggacctggggcagccagcagccggatgtgacaacaaactggcctc

SEQ ID NO: 610767 - DNA, 275 bp, Homo sapiens
  misc_feature (78)..(78): n is a, c, g, or t
accaggaaggagtaaaccaattgtcaggatctgaaagagtgaaaaggaaagtcactttggactgaaaaaagtaaaaangaatccagttaatcaggcttggagagacagatatagataaaaatcagccccaaagttaacaggggaccttgtattacctgaggtcatgcagtggctgtaaaatgagtgactactacttttctttccacaacacccccaggctccctttgttaaatccttctattactgagattactcaattgctaaactgccctggc

SEQ ID NO: 610768 - DNA, 666 bp, Homo sapiens
  misc_feature (8)..(8): n is a, c, g, or t
  misc_feature (67)..(67): n is a, c, g, or t
  misc_feature (183)..(183): n is a, c, g, or t
  misc_feature (205)..(205): n is a, c, g, or t
  misc_feature (216)..(216): n is a, c, g, or t
  misc_feature (245)..(245): n is a, c, g, or t
  misc_feature (255)..(255): n is a, c, g, or t
  misc_feature (267)..(267): n is a, c, g, or t
  misc_feature (278)..(278): n is a, c, g, or t
  misc_feature (285)..(285): n is a, c, g, or t
  misc_feature (309)..(309): n is a, c, g, or t
  misc_feature (324)..(324): n is a, c, g, or t
  misc_feature (326)..(326): n is a, c, g, or t
  misc_feature (331)..(331): n is a, c, g, or t
  misc_feature (336)..(336): n is a, c, g, or t
  misc_feature (491)..(492): n is a, c, g, or t
  misc_feature (497)..(497): n is a, c, g, or t
  misc_feature (499)..(499): n is a, c, g, or t
  misc_feature (503)..(503): n is a, c, g, or t
  misc_feature (505)..(506): n is a, c, g, or t
  misc_feature (508)..(509): n is a, c, g, or t
  misc_feature (514)..(514): n is a, c, g, or t
  misc_feature (537)..(537): n is a, c, g, or t
  misc_feature (567)..(567): n is a, c, g, or t
  misc_feature (663)..(663): n is a, c, g, or t
cgcctggngcccggcgccgcgccgccctgccgcccccgccagctgcgccgtgacgcgggcatgagcntgctccgcggcgccgctgagcaggcgctcctggcccgggcctcggcgcccagcaggcgcggggcgaaggagctgctagaacaatgctgaggcgggtgaggtgaggagcagcccctngcggcagccccgacagagtgtntggaacaggtnattggaggagccggagacccaggcacctnggcatccttnccctcgcctctnccaggccccgngcccctnaaaggtgggaaaaccatggggacnaatttcagtgacatngncaagnaaggntacgtgaagatgaagagcaggaagctcgggatctacaggagtgctggctggtgttccggaaatcctccagcaaggggccccagcgcctggagaagtatccagatgagaagtcggtgtgccttcggggctgccccaaggtgactgagatcagcaanntcaantntgtnanncnnctccncaaggagacaaagcggcaggcgntggccatcatattcactgatgactcggcangtaccttcacctgcgactcagagctagaggcagaggagtggtacaagacactatctgtggagtgtctggggtccgcctcaacgacatcagtgtggnaga

SEQ ID NO: 610769 - DNA, 638 bp, Homo sapiens
  misc_feature (155)..(155): n is a, c, g, or t
  misc_feature (177)..(177): n is a, c, g, or t
  misc_feature (188)..(188): n is a, c, g, or t
  misc_feature (217)..(217): n is a, c, g, or t
  misc_feature (227)..(227): n is a, c, g, or t
  misc_feature (239)..(239): n is a, c, g, or t
  misc_feature (250)..(250): n is a, c, g, or t
  misc_feature (257)..(257): n is a, c, g, or t
  misc_feature (281)..(281): n is a, c, g, or t
  misc_feature (296)..(296): n is a, c, g, or t
  misc_feature (298)..(298): n is a, c, g, or t
  misc_feature (303)..(303): n is a, c, g, or t
  misc_feature (308)..(308): n is a, c, g, or t
  misc_feature (463)..(464): n is a, c, g, or t
  misc_feature (469)..(469): n is a, c, g, or t
  misc_feature (471)..(471): n is a, c, g, or t
  misc_feature (475)..(475): n is a, c, g, or t
  misc_feature (477)..(478): n is a, c, g, or t
  misc_feature (480)..(481): n is a, c, g, or t
  misc_feature (486)..(486): n is a, c, g, or t
  misc_feature (509)..(509): n is a, c, g, or t
  misc_feature (539)..(539): n is a, c, g, or t
  misc_feature (635)..(635): n is a, c, g, or t
ggggaagaggaaggcaaaaagagagcgagacagcgagacggaacgagacagatgtcactgtctctaatctccctgtcatttttatttccagcaggcgcggggcgaaggagctgctagaacaatgctgaggcgggtgaggtgaggagcagcccctngcggcagccccgacagagtgtntggaacaggtnattggaggagccggagacccaggcacctnggcatccttnccctcgcctctnccaggccccgngcccctnaaaggtgggaaaaccatggggacnaatttcagtgacatngncaagnaaggntacgtgaagatgaagagcaggaagctcgggatctacaggagtgctggctggtgttccggaaatcctccagcaaggggccccagcgcctggagaagtatccagatgagaagtcggtgtgccttcggggctgccccaaggtgactgagatcagcaanntcaantntgtnanncnnctccncaaggagacaaagcggcaggcgntggccatcatattcactgatgactcggcangtaccttcacctgcgactcagagctagaggcagaggagtggtacaagacactatctgtggagtgtctggggtccgcctcaacgacatcagtgtggnaga

SEQ ID NO: 610770 - DNA, 247 bp, Homo sapiens
tcgagtcggccttacttccacgatcacagtcgcagaacatgtccatataatgctaaactgacacacctatagatcatgtgcttgatgcaccacttcctaccaacccccacatcctcaccacctgcttctttgtttgatcaccaatgctagtatggaggctgcaaaagacccaagctctggaagcccacactatttattggtgatcaaacaaagaagcaggtggtgaggatgtgggggttggtaggaa

SEQ ID NO: 610771 - DNA, 738 bp, Homo sapiens
agagaacattctggaagagagtgagcacctgcacaccgctgaacagacactggtgtacgtggctgcatcctaactctaggtggaacgaatggatgaagaatttaccaaaataatgcaaaatactgaccctacactcccaagagtacgtggagcacttgaaggatgaggcccaggtagtagtagccatacatacgagcgtgtagcagcgctacctaggaggagaagggcactaccgaggaggtctgccgcatactacctactgcgcatacctgcacacctactacaagtattgattacaaggcccatacagcgacagctgaccccgcctgagggctcctacaaagtacgtagagcaagaccaggcagaaaatgagggcgaggactcggactgtgtagatggagagacctagtagcaagtacatctagcgccaaggaccgcacagaccggatccgcacatgtagccatcctctgccacatctaccaccatgctctgaactcgcggctggtaaccaggcccgagaactcatgctacatgagccacttgcaggacaacatatcagcatgcagacccgccagtgcaggatcctttacaacgcaccatggtgcagctgcgcatttgtgccttccgcaaggctgacaaggacgcaacacaaagcccggtggaatccagtacgagtggcgaccagaggttctggccaggccgttgtaacactgaagaagacaggaaaaaaaggagc

SEQ ID NO: 610772 - DNA, 434 bp, Homo sapiens
tcgaagatggcggttggagtaacaggatcttatagccccacatacaggagggtagggtttgtccgtgagtgatgaagagtcagtaaagggatgttaaggcaggtagagggatacgtgtcagaaagactgcgtggttgtggggagatggtacagggcaaaggcagaaaagtgggaggctggtgggaggacaacgatccagatgaaaaacatatagtgtcctaggccagaagagagaaggtagagactggcagactctagaatccttggatgagctgggaaagaccagacttagaagctggggcacgagatccggtctagtacctactatggggtagaccaagtgggtcaccaattgcatgatactgtcagtcagctagacgctcatgggccagcatatccaatgctccccagtggtcccaagcgaacatcttcga

SEQ ID NO: 610773 - DNA, 870 bp, Homo sapiens
  misc_feature (366)..(366): n is a, c, g, or t
tggttgtgttctgctcactctgtggccttcgggcccgtatgggtttctagacatcgggtcggcgacccctgggttccaaggcggtggatatctcccttacagtgacggttccaccccccgctgggaagattattgtttggttgcgccaatcggcgctcttttaggcccttgcccaatttggcgcccctaaaagatggggaggaccccccccttgggagcgtcccgttgtccccctggctagtatttctggatatgcaatttgtgggacctccccctcactctgtgatgaatctgcgccagtcattcttccctcctgaaggccgtgcgtttagcccctgtcttgtccgcccgtagttgcccctgtcnccggtgctggccaccccccggggggttcctctgccgctgattgtgtctgtcaacgcgcgcgccctaatactccccgagcacccattctggcccccccactcctttagctcagctccctctgaggagggcccccccccccccgtgggcccgaggtgtcccgcggttgccccccctgggcccattgcccgccccggatggctttctagagggttggcccactgcctgtcctctaaccgcatccccccaagcgtttttctccccacatggctttttttctcacatttttttttccctcccttatctccctgattctgatgagataaccgctcacctcccccccccaccgcggtgtaaaacgacgaactcatctaccctcttgtgatacgactcactactagcgcgcccctcacccttctccccaacacagacaccgatccgcacgcccaacgagtacatgaccgaggacccgacaccattcttcgtatgcatacactaccccaagtc

SEQ ID NO: 610774 - DNA, 356 bp, Homo sapiens
  misc_feature (356)..(356): n is a, c, g, or t
atttcctgcttgagagtcctggaatgatctcatatgaagcagttactttatagaaggatgctaattatcttcaaaacccaacccaccaactctcctggcctccaggattataaatacaactcaatttcacagtatcccacaggaaaaaaaagtacaaaaattggatctggaggacattaaacaacaaaaggatgctaaaattttgctaagacatcagaatgcacctgcaaaatatggttgagataaaatctaaaagtactaaaacaagggggaaaaacatagcactggagtggactggattaatccatataattagtttatggcatattctgaattcaataaactaatgaacagan

SEQ ID NO: 610775 - DNA, 281 bp, Homo sapiens
gggagtggagagagaacgagaaatagtagctgagagtaaacaaataaatgggcaatatgagacgactcaaaagagtctcagggcaagagatgacactgcctcttagctcaatgattccacatgcctgagagggtgaagctgtggtatttacccagaccactcctgcttgtggaacctgacaatattgagaggaaacctgcaaacctgagtgttctcatcattctgggagaaattcatacactatgatggactggactaattatgaagtgattgggtttatt

SEQ ID NO: 610776 - DNA, 920 bp, Homo sapiens
gtctgcctgtgtgtaccaggcggggcgtggtctacgccgaggtgacagagacgctcaggctgtgtgctcgggatgaccgttgttagacagagcaccatgcggtggcaagaatcttgacatcaggctcattggggaaagtggagcgtcggatgaggtgcgagatcgatagtgactatgtgcgctggagtgatgactcttgcgaggttgaatggggatagtagtgctcaagatacgtgtgcctcacagtgcaggggggtaatgcgcgggataaagctccgtataggtgagggtgccattgtggtgtgcttctagtaaatccgatgatgagttgcgaggcgtggaaacggtgggaagctcatgactgtgcgcatcgtcaacgtgtgccttcgacgatcaagatagctgtgctcacagggggaagatgcctctgaaggtcctagtgtggagcgccattcatcaatagcggtccgcggggaggacatccattcgtcattgtggcgcgccgggactgtgtagaacgacaggcttgtggtgatttggtctcccctggggcacgggtgaaaccaagggccaactggttgttgtgcacgggcgccccgtgagctgccttgcggaacattagagcgctgctgatgctggaatggcgtgcatcatgatgccaagggtcgtcgactctatgcatggagaacagtgacttgtgtttgtgacagtcaaacgttgtttccagtggtggccataaactgtggcttggggtgccaaacaacaacggcgaagacaagacgttggcgcgggacaaacaaaaacaactggggggccccaagacaacgaacgccaaacgagccagtgggccaaacaacggacgggaacggcgggtgtacaagcaatccagcgagaagcgcacacatccacgaatccgcccc

SEQ ID NO: 610777 - DNA, 609 bp, Homo sapiens
taacccctccttagttttatgcgctcaaaaaccaaattaaaccccccccccatgtaaagggggggagggaaaaaaccaaaaacgccgaaaccgctgggaaaccaccattcttgcccccgcgcattaatcgccctgatggggtattttggttgttttcatctggtccctgttggctgggtgttgatgttagagggtggacgcctccgggggggcactgggccattcgagccccctgggagaatctcagaggggatgtggagaaggccattgtccggcctggtttctgggggacagtgggttgggtccccagaatgtcttgagggcggaggggggggtggggcagggctctccctcagggtgtcaggaggggtgcctcgggaggccacaggagggggctccgtggattggcctgaggttggccggaggggaaggggctaccgggtgtgtaaccagagggtctccactcaggcgggggcaggtgggccgccttccgcacacttgaggaaccctcccctctccctcggggaacttcttgcccgcccttacagaccctgccttgtctccaggaggtccgagctctggtggacccctttgggggccagggtgcta

SEQ ID NO: 610778 - DNA, 644 bp, Homo sapiens
ggacggcgtctgctggcggcgcggagacgcagagtcttgagcagcgcggaaggcaccatgttcctgactgcgctcctctggcgcgtgacgttttcccggccgtcagtggactcgggaagcaccggcggccgggttcgtgtcgttgcggcgcaagcagaaacatgatccggcgcctgggagatcgaggcggagaaccattacttgctgagcattgcccttattgaccccggggagcagggatgcggcggccaaccggccggtggttgcgccaagagggcgaggcctttcggagaaaaggtttttcttaggacccaatttctgtttggggtgccgcggtgccccaggtacgggtaaagcttgacacagtgggtcccataaggctgggttcccctaagggaaggatcccgtgggctcccattagaccattaagggtggctggagagattcttcaaccagaatttaaaaaacaacgggcccggggtgtggcaaacaccggaagcgcggtttcctgtggaaccaaaattcccaagaatgggcgagggttcctggagaggaccattcaacttggcattcttattaaagcgagggatgttcccaaaggcagagtctcgattatcaaattaacgcccggttctggggaaaga

SEQ ID NO: 610779 - DNA, 203 bp, Homo sapiens
tgactcctgagggtaaaacaacctccggggaacccgcctgcagctgcatggccggttccaggggagcaacatcacacctgccctgcggcatggcacagagctgcgctacctgggcacccatcaagatgcgggggctctgcagtactgcgtggtcaacatcctctctgtcacttccgccatcgtggtcatcacttcaggcatcg

SEQ ID NO: 610780 - DNA, 119 bp, Homo sapiens
ttcgacggaagcagtttcagtatcactgagcggatgacaggagtcttatccacaacatcattgaatggagagagagattttgtgtgttcacacgatgtcgtctgcctgcagcctctctt

SEQ ID NO: 610781 - DNA, 557 bp, Homo sapiens
  misc_feature (1)..(1): n is a, c, g, or t
  misc_feature (22)..(22): n is a, c, g, or t
  misc_feature (37)..(37): n is a, c, g, or t
  misc_feature (60)..(60): n is a, c, g, or t
  misc_feature (92)..(92): n is a, c, g, or t
nagccgggccgggaagccatcnggcttacaacggttntttggcagaaccttccaagccanaaaaagtgggggccaatattcacactcttaangaaagattttcaacccagatttcctatccaacctagctaaattccataagtgaaggagaaataaaatcctttacagacaaccagatactaagggattttgttaccaccagggctgccttacaagagctcctgaaggaaacactaaatatggaaaggaaaaactggtaccagccactgcaaaaacatacaaaattgtaaagaccatcgacactatgaagaaactgcatcaactaacaggcaaaataaccagctactgtcataataacaggatcaaattcacatgaaacaataattaaacttaaatgtaaatggactaaatgccccaattaaaagacacacactggtaaattggatagagtcaagacccattggtgtgctgtattcaggagacccatctcgtgtgcaaagacacacataggctcaaaacaaatggatggaggaatatttacaaagaaaatggaaagc

SEQ ID NO: 610782 - DNA, 949 bp, Homo sapiens
gttgtcaagactccgacacctgaaccagttgaggtggacgattcgcaaggtggtgcttatgcagtgcgacattgagtcggatggaggagggagtcgaacaccacctgacacttctgctgcatttggaggacaaacgtgataccggctcctgacgcctgtgaccttgatgccaacatgacgaaatatctcctcgacgattggcgcgcttagctggatgcagctggacttcatatagctgaggctgacagatccggttgattctctcctagctacaagaagacctctgaacaacgtgcaattgtgtggccagggacagtaccctcgactcagccgttgtcaccgtactcctcttagagctcactcgggccaggccctgatctgcgctgttggctgtccctggacgtgctgcagccctcctgtcccttccgcccatgtcagtattagcctgtgaagccccttccctcctttattattcagagagggctggtggggtgctcccgtggttctgagcatcatcgctttcccctcccgctctcttcctcccactctgcacgtttgtctacttgttttgcacatgactgtgggcctgggccttctcagcagccgccttctcagttgggggctagtcgctgatctgccggctcccggccagcctgtgtggccacggaggtccacgggcactaggggagccgaattctacaatcccgctggggcggccgtggcgggagagaacggtggtgctgcagctgggtaggccctgggcgccattcgattcggcctcagctgcctgctgtactcacacgtctactacttgctacccacacccaccaccctccaccccccacccccacaccacacccacaccacacccccccctactcacaccccactccccctctcctccccccctccccacacccactcccccccacccaccaccaccccccac

SEQ ID NO: 610783 - DNA, 159 bp, Homo sapiens
taatgttaatatttacatataactgtaaacttattaggcatgaatcatcagaggagaaagaaaatgctggacatgcttgatgtattatgtaaaagcatattaaacaagggtctcaaccctgactacaggtaagatcacttgggtactacaggtgctaca

SEQ ID NO: 610784 - DNA, 1106 bp, Homo sapiens
gcttttacctcgttgcactgctgcgagcaagatgggtcaccagcatgctgtacttggagccacccgcgaaaattcggccatgggttctcagctctatgtcagttgtcttgttcaaacctggcactggtctgatcctggaaatatggcctcaactactgtgccgccacgtgatttccgtcagataccgcgacaggatatcggtttcacttaagacaagaccctgagctgtcttccattggcactgcctactggaggtgaccacccatcatccatccatcatggaacatcctgagaccggatcgcgacagccaaagcatcatcaaaaagagcaaccaaggttcacatgggaaaccagtcagcactgcctatgtcccaccatacaagggtcacactgggtggaaacaacaccagcagcgtcatcgcaccaacaggggacccatcaaccacaggaagcagggcccagcatcccatgccccaaacatggggactcatgggcacagcagcaagaccaagcaaaggacacaaaaagacgaacaattcacatggacaccaagcagaggcgatcacatgggacacagataccccagggcacccacacacacgcgttcacaagcgaacgccagggcaacacatcacatggcaaggagatgacagacccagcaacacatacacaccatggagtgattcggacagcaattaaccccacagtggccaacgggtagtcctagaccaaagaggacaaccgtgcaacaaagcaccattcccatgggggaaacaagaagacaaaggcacaaaggtgagaccaacacgacacgtaacacaaaagagcgcaaagatgacccagcagggacaaaaaggtgcaaccacacggcgccacgcagcaccactacaacatcgaggagaggaccacaacccggggaggcctgtaacacgccaccaaccccaatcaccaaactgagtacaaaacaacaacaacaaccaagacacacaaaacaaccaaaaaacaaacacaaccaaacacatagttggcaccaccccgcgtccacacccaccacaacaacgctagaccgacaacacaacaaaaccaaacagcagccaccaccaag

SEQ ID NO: 610785 - DNA, 164 bp, Homo sapiens
gactagtctcgagttttttttcctttttttggcctttctcagattagtaaaaattctatagatgactcactcgatactaagacacagaggtttagcctgctttctcaccaaattcatgttaccagactgtgttctcttgcgtcctggactgcctgtgatgatgg

SEQ ID NO: 610786 - DNA, 104 bp, Homo sapiens
aatgggaggtgattccttggggttgtttgatcccgtttcgtgcaagaagggaggtggagtgctgctaggctgccataatgaagggcaagatgaagtgaaaggta

SEQ ID NO: 610787 - DNA, 183 bp, Homo sapiens
ttgactgtcctcaggagaaatgtgaacatgtgtgtatattgtgtaaattctttctcatgttgggagtgagaatgccgggaccccgtcaggttctgtcggtgtgctgtcagccatcccacagagtaatacagaacgtgcactaccagatgtcgtgtactagctgatatgtgggcaccgttgtta

SEQ ID NO: 610788 - DNA, 390 bp, Homo sapiens
ttatctcggttgcactccatgcacacatccatgacgtaagtatgcacatacccattcaaccttagaaaaccaaggctcaggacagtgaagagacttacccaaggtcacacatcttgtaaatctcacaagctgggtgagtgcctagttcgtcttactccaaaggcttgcttttagcacttcaatcttattgaacccgttagtagtgccagcgggcaaaacagacatacatacgtaagtaccacataatgtgctaaaactgctgtccaagcgattcatgaacaggattccagaggagaacaagcggctaagagtgggtagccacaactttcttctggagggaaggcacagggaggttgcacagggacggtggaagctgagctggacttacaa

SEQ ID NO: 610789 - DNA, 150 bp, Homo sapiens
gacaagctttacgatacagagagtagagcactcgagtcaagcgatcttcaactgtacacacagacgacctgtatcgaagtgtgcgctcctctgcctctcccttgtaggatggtgtgggtttcagtaagtgcagacgacagggatgggtac

SEQ ID NO: 610790 - DNA, 1808 bp, Homo sapiens
  misc_feature (603)..(603): n is a, c, g, or t
gactacctctctctgtgattgccatgtgcagattcaggggcccggccaagcccagttgctgcatggtgatcggcgcgagtcggcagtgtcggctgaccagtgagcagtgcttatcgaggctacttgtgcgtgcctgtgggccgtgggcctcttgagtcgcgcttgctctgaggccttgtagtcagattgcctggagttcgctcgtccggacagcgattgccggattgttgcttgcagtagtagtagcgcacggtctgacaacgctttgcaggcccgactctgggaccgcgtggaatagtttaatagactgcaatgtaatctctggaatgattaggtctaatcttcgtatctttcccatgcgcgtagtatatgtcgatattcagtggactcagtccgactatccaatctctctatgtgttcgagcgcgctccgatcctcttagaggcggaatagctgcgatgctgagagagtactcgagttcgctcgaagggcgcaagaaaaacgcaaacactcggcgaggcacagtgctctcaagcgtgcattgcattggcgtcgtccagaggcgaacttgatgcgtttgcgatagatccagtttcgtaaccnttaaacgacaaggggcgtgcggagtaggatacgggcgtccaatcgtgagagtcgcttggacaaaggtatgacttgcactaggaagggtaggccagatggtggaatctacatcgggcctacggaaggtgccccgttctgaaggtgggggcccaattcccacctctcttagtcgttactgaatgtgctccctccccaggttctggaatgggccccagggtagggccagcccacaggacaattggaatcgtacattagttgagccccattggcgcaatagccaaaaggggattctcgggggccaaaagaggctcccttcaatagaacctgggtgctggccctttgaaccgaaagcggtagcattagaggggacctctggcctttccgaagccctatcctgagttgcacagtgggccccttacatggcccttacaaaatggcccgcttggaccactgccaggtgggggccaggcttgggaaaggatcccgatacataagccgttggaccctttgtttgcccactttaaaagttataacccatcgcgtgtccaaagtgccagtgaagtttcgttgggcacttcgcgaactcttaagggtgggccttaaaaaacctctagagggaaccccgggtgtggcttgtgcaattcgttgtgcggcccttttgcccgtgtggctacacgatattcagggccaaacatgaaacccgacgcgatttaggataagtcccccgccggcggtataaaaggagagagccctcacgaaaggaggtgtgagcctgtgtgattgacccccggcctaaccatccctgtggagaaaaagggaggaacagtgagtattctcatacggcaagaaaatatttccgcccgatgagtcgaaaggagtgagtgttcccacatcgtagaagacacctcctcgttttgtgtgagcacccaaaactatgggagtctccccccgggagaggagggccaaccacaggaatccactcttatgagagcaggctagagaacacataagggccttataattttcgtggaagccaaaaaagtggacgatacaccgtctgatgcaaaacaaaaagaacacaacacctgattgcgtatttatgatgcgtgctgcatcatacggtataaatcagagtgtgagacagacagtataatgcacctctcaaagacagagaagagggaggtaccacagaagtgacactatag

SEQ ID NO: 610791 - DNA, 261 bp, Homo sapiens
gcaacccaccattgcaatgcaacacaaccattcattccaagcaatctgcaagtcatgtatttttccccttccatctgttttcccttcaatgtattgcaatcatcagggcaggcaaaaacacaacatggtcaacacttacaacacacacaaaccagcacccaacaatccagcgtggactggtttgtggcaagtcatcaacagcgtggcagtgtacgtcaggcgcagcggacgccacgcaccttcatcacacagcgatggcag

SEQ ID NO: 610792 - DNA, 321 bp, Homo sapiens
ccgccaagcgcttattttctggccgctctcagatgctcgccgtggcccgttgcttgttcaacgccggcctcctgccgccatccggcatgcgcgcggcgatgatatggtcagaacacccgtcgcgcgcggggatgcggttgtggcgccaacgccgggcacggcgcggccgatgagcgatccgatgggcctgtcgatgtttgaaccagacctcaaggcggccctcgcgacggcaatctgcctcggaaccgcgtttgtgctcggttgcctgatcggccttgaacgccaaatccgtcagcgtaacgctggcctgcggaccatggt

SEQ ID NO: 610793 - DNA, 336 bp, Homo sapiens
ttttttaaaaaaaaaaagggccctccccccccccccgggggggaaaaaaaaaaattttttttttccccaaaaaaaaaaaaaaaaaaaaaaaggggggggggggggaaaggaaaaaaaaaaaaaaaaaaaaaaaaaaaaaaaaaaaaaaaaaaaaaaaaaaaaaaagggggagaaaatttttttttttttttttaaaaaaaaaaattttttcacgtttcccccttaaaaagtttttgaagggggtccccctgggagtgaaaaaaaaacccccatttaaaaaagggggccccctccctggggggggggaaaaccccccaaaaaattttttttttttta

SEQ ID NO: 610794 - DNA, 689 bp, Homo sapiens
  misc_feature (35)..(35): n is a, c, g, or t
  misc_feature (101)..(101): n is a, c, g, or t
  misc_feature (109)..(109): n is a, c, g, or t
  misc_feature (160)..(160): n is a, c, g, or t
  misc_feature (165)..(165): n is a, c, g, or t
  misc_feature (185)..(185): n is a, c, g, or t
  misc_feature (238)..(238): n is a, c, g, or t
  misc_feature (278)..(278): n is a, c, g, or t
  misc_feature (284)..(284): n is a, c, g, or t
  misc_feature (291)..(291): n is a, c, g, or t
  misc_feature (297)..(298): n is a, c, g, or t
  misc_feature (317)..(317): n is a, c, g, or t
  misc_feature (327)..(327): n is a, c, g, or t
  misc_feature (332)..(332): n is a, c, g, or t
  misc_feature (358)..(358): n is a, c, g, or t
  misc_feature (363)..(363): n is a, c, g, or t
  misc_feature (536)..(536): n is a, c, g, or t
  misc_feature (578)..(578): n is a, c, g, or t
aaatccccacaactgtccaacagaatctatttcanactgattctacaggtaagaaaaataaaatttaggaggttaggtagttgataaatggaggagttggnaatttganctaaattggtctggattcaaagcccattcttcctttatatcaaagtttatnccatnaccatatagaaatggaaatnctcttctaattcttaaataggttatagttaccatgggagtattctcccccttnctctgactcaagccacatgctgaagatgatgtgttacggntaaggnttgaagncccagnngactgggctttctgggtcncaagcacagnttccnaactaagcaaagtttgcacactggcnactgnaggcctcaacaccttttgtcccctgtggatcattttcagagctatattctataagtttgaggacaattattatggctccttttatattagtatctactgtatgctcggcacttgataggttatctcttgtacttaaactaggatacagattgtctccaatttagaagtgaaanagctgaggcctggagatttcaagcaacatgcctaatacctcncagtggacaaaatggcaaagctgagatttcgcctcaagtgtgtctgactctaaagctcatgttcttgccatcttaccagctgcctcatcctcatctatagcctcatggtgg

SEQ ID NO: 610795 - DNA, 846 bp, Homo sapiens
caggtcctggtgcttgatggtcgatggccatctcctgtggccgcctggcggccatcgtggctagagagtgtactgctggtggcctggaaggtggtggtctgtacgctgtgaatgtgcatcaacatttctggcaatttctacagaaacaatgttgaatgtacctgtgctttcctccgtcgaatgctggatgaacgaccaacctcttcccggaggcccctaccacttccgtggcccccagcctgcatcttctgggctggacctgtgcgatggtatgctgccccacaaaaccaagcgatggccaggcctgctctgtgaccgtctcaatggttgttttgactgtgcatcccacctgccctacgacaatgaaaaatgctggattgtgtgtgttccttgctgccctcaagtgtctgttgctgtctgaagcctacaatgaaatgtttgcctatctgtgggctgccttggctcactgatggtttggcttggaatgtaccagtgcatgtgacatgccaccctgtgagtgagaagatgtgaactgagaaatgccaatgatccactacctggaagaagaaaacatgctcattgagtgctactgtgaaacatggcccgacgaaataaacggttggatgaacgaaaactttgacaagatacacaaggagtgtcctcaaggaccactggactccctgggtcttgaggccaataaaagacttgttaattccttaaaaaaagaaaactgagaaaaacacaagtcgcgggctcttttcgtgtggtcggacaggcggttccaacatgggcctggccactgtgtttctgcccgttttgcagggggaatggggccccaaaggggga

SEQ ID NO: 610796 - DNA, 204 bp, Homo sapiens
gtttcggttcttgtgttgaattccttcttgtgaaataactaagatattttcaggacggtatgccctggtagttgcaggagatattgctgtatatccacaggagatgctatacctacaggttgagttggagcaatagctctgctaattgggccaaatgctcctttaatatttgaacgaggtgagtgcttgagaatcatggcgaga

SEQ ID NO: 610797 - DNA, 435 bp, Homo sapiens
gaggagacctcgttgaagtgcggagcacgtgctcctgcgatgagaggaggagacttgtgtggaggctgcagggtgttccctccttggaacctgcccagttgttttctttccccttggagccaagatggttgaccagatatctatcctccttcagtgtacgaccagagtctttcatccgccagagcctgacgcccaaagcacctgctcactctgtgtccttgccagggtttctctcattggttcccactccttcctttcatttcaaaagttgatgccaatgacttagagttcctatgttgtagtgacatggcctttggggacagtacatgatttctcataatttgaattcatagtagatatagttaagggaacagcagtcaggttatgaatcttttcccatttttctttttaagtaaatttatttttttaattctg

SEQ ID NO: 610798 - DNA, 204 bp, Homo sapiens
aggatcccagaggaagaatgtgccatcggtagaggaagagtaaataacaagatcatgatgttaaggtagatctaaatgtgttaacaagaagagaaagtgggggaagtcctaagtggaaaagagaaagaggtaaattatgtagtatcatactactaacagtgtgtaaaaagatacatatgtttagcccaagcacattctgccaag

SEQ ID NO: 610799 - DNA, 152 bp, Homo sapiens
atggaaaaagttgtggattttctttctttccttttttttgggggggggtggggggttggttaaagttgtaatggacccaaatggaacttgtaacgtgggccccccatgataaaactaaattcagatatcattaaataaacttttgtccccta

SEQ ID NO: 610800 - DNA, 954 bp, Homo sapiens
gagcaactatggggcggaggcatgatcgttggtacaggcgctagggagccatgagtatgtagatgcaccgcagcattggtggagaagattgacatcgagttagattactgtttactgttggtcacagaagcagtcactgcaattctcgcggaacgggagtttgctacattgaggcatctcataatgcaaacgtttaccgatatcggggatcgatccacttaactgacgcattgcttgcctaccatcggatctcaacctcctgcaacaagtgcaaagagtagggatcctggtctatagaaccatgatctgccagaagtgtgtcagcataattccaaattcgtttcattgtggatctttgagaccgtacgatgtggagaacaagatatgcagatggaactcgaataataaccaagtcgcaccttgatcatatacaggaacatggatatgtgctatctcacatacgtatcctgtctgcaggtaaacaggaacgagggggtataacctttttgtgtgctccctggaggcagttctcttccattccgatctactgcgcctcgtatcatccgaacgactcgttcgattcatccatcctaaagcaagagccaaagccacgacggttcatggccgttgttacatcccagacagatgacctcaaggaggggatgcataggtagatcgtgctcaacactcgcatagtgcccctcctgaggctcagaggaagggcgagcccttgtatgacaatactgagattgagcagactatcatactatgagatcgctggagcgaatttgaatcccgttagcggcataagtagctcatttaggagttcgcccagtggtttctatggatacagcatttaggggggaagcccttcgaaatggttggaccgtaattaattggggctcccgcgggggggggatttcctctttggtccccatccccagggcccctttc

SEQ ID NO: 610801 - DNA, 163 bp, Homo sapiens
tcttgtttcctagcttcaccgaccaaatcgttagcagctccttccttcttcctagacttcctgtcaccaaaatcgcactggctcctggactcttttcctatcttcaacacgaactgcgtgcttgctcgcttgtctctctccatcctagctttcctcctgttgt

SEQ ID NO: 610802 - DNA, 164 bp, Homo sapiens
agccctttggtatgagcagtggaaggagagtgggcaccagcttttgaggctcgggcttcatgcccgccgtaggccagattctgtgctctcacctacccgtggcccgtgggagaaagcccagcgtcccagtgccctcatgggtaagtgggcacatcattatggag

SEQ ID NO: 610803 - DNA, 552 bp, Homo sapiens
ggttcgatctagaggatcccgatgctctctcgtgttagggaaatggtagaggcatccttcagtgtcaattgcagtgtggagggtggtgttggtagcgacgagagagagaattggataggggttatggactatgggatgaatagggaggacagcttgactgatggctcggaggttgtgaacgagtcggtctgagccatcagactttttaacagggaggataggggtgttatatggatagtgttttggtctaagaagattgcatgagcagagcttgtatacgatgggctgtcggcccttttggtgggttagagagatggggtatagaggaaggtagggaaatttggaagagtctttgaactgtattctgatgaagtcatggtgcgcagctacggaagggtaaatgcgcgaggcatggaattgtgtactggggaatggggtcaggtgccagaactagcggagaggcgctggagtgggctctggttgatgggggcacagatactggtgctcgaagctttgactttggctaacagtgtctcagcctagacttggggt

SEQ ID NO: 610804 - DNA, 118 bp, Homo sapiens
catttatgtggggagggtagtatattgagaataagccgcatgacgctagtgctgcggctggtacctgctctggcttctacgataagccccagggtatcccgaagccgcttcgctttgt

SEQ ID NO: 610805 - DNA, 509 bp, Homo sapiens
  misc_feature (3)..(3): n is a, c, g, or t
  misc_feature (69)..(69): n is a, c, g, or t
  misc_feature (103)..(103): n is a, c, g, or t
  misc_feature (170)..(170): n is a, c, g, or t
  misc_feature (184)..(186): n is a, c, g, or t
  misc_feature (189)..(190): n is a, c, g, or t
  misc_feature (197)..(197): n is a, c, g, or t
  misc_feature (203)..(204): n is a, c, g, or t
  misc_feature (209)..(209): n is a, c, g, or t
  misc_feature (215)..(215): n is a, c, g, or t
  misc_feature (253)..(253): n is a, c, g, or t
  misc_feature (274)..(274): n is a, c, g, or t
  misc_feature (280)..(280): n is a, c, g, or t
  misc_feature (298)..(298): n is a, c, g, or t
  misc_feature (306)..(306): n is a, c, g, or t
  misc_feature (386)..(386): n is a, c, g, or t
  misc_feature (392)..(392): n is a, c, g, or t
  misc_feature (401)..(401): n is a, c, g, or t
  misc_feature (411)..(411): n is a, c, g, or t
  misc_feature (413)..(414): n is a, c, g, or t
  misc_feature (455)..(455): n is a, c, g, or t
atnatatggtttcttgggggatagattcaagaggagttgagaatgttttattcatttacaatgtccctntcctgtgaagggctggacagccagatttagcgcncaagccaaaatcatcccctatttaaaaaaaaaaaaaaaaaaaagtcaccagcaagtagtcccggagngcggaggcgggacnnnaanncacaaanaaatcnncaatnattccnaattgtttttcaatacagaaccctgggaaggggttccncccactctcatgaggaaggcncaactnccaggtagtgttggggangggtatgngggcctatgccggccggcctcttatcccccagatgccaagatgatgtctaccggcagcccccccaaacttctggctgtcncccgcnttgtcactntttccaaaancnncccccgggagccccccaggctgtcatgacccccccggaacncaccagccaggggccacgtgtgggtgttcttgttatccggcactttgtctgacc

SEQ ID NO: 610806 - DNA, 883 bp, Homo sapiens
  misc_feature (883)..(883): n is a, c, g, or t
ggaagaagacggcaaaagatgaggaggaggatcagactcttgtgaacctgggacacgtatacctcggatctgcgattttcaagtgagcaaagacctgttatggagggcagtcacgttttctcagagaagttctcccagcctttgtgtctggggcaagggagtacttacggagtgacaaagggaaagagtctgctttgaggcaagatggtaacccagaatctcccaatgatatagaacggctgcacagaggtctctctccgttcgagttggggtggtctgttgcatgttttcccgtccagcagccttggtgaagatgaacttcgtcttacggtttacgagtggacgaggatcgtcaaggcgacgtacaagatggcatcaattacgacggaatctggggaccagactatttgggggagaaatgatggttaagtagggcttgcgtttggctaatcaatggaagactagaatgacagtaagaaagcatttcctttctcgcaagcaaactcgagacgtaaacgtaccttaggagtggatagcgtcactcctctgggcagtccacgcgacaaggaaggttccacatgggccacgaacctggggccccattgctttaacctcgcaatgatcccttgcgttgtcacatacacattggcgtcagtccacgttaggaacacttttgggataacttttcccgcgttccaacgcaaaaggagcaaggggaagacacgcataatgccttttgcccctaaccccaatccctaaggaaaaggaagatatggggatcggtttgcaagttatccattgacgtgtgttgacccgttggatacgaagggtaaggcgctgggtaaccaggcaaagctgggcaaagatttcgcgccattcggcn

SEQ ID NO: 610807 - DNA, 338 bp, Homo sapiens
tgagttgtgatcggtctctttacatatcccacagttttggaggtttgttcatttctaaaattctttgttctttcgtctgcctgagcttgactttgcaagaaccagtctttgggctctgatttctttcctcagcttggtttattctgctgttaatacttctgattgtgttatgaaatttttatagctgagttattcagctctatcagctcagtttggttctctcttaaggtggctatttcatctttcatctcttcaattgttttactggattcctttgattccctggaatgggtttctactttctcctgaatctcaataatcttgattgtcatccagat

SEQ ID NO: 610808 - DNA, 222 bp, Homo sapiens
tctcaaatgcgccagaacttgataggacatgtcaacagtattacaaagacagtagatgcctctctagtatatcgtgagctctggattaaagcttcccagacacccttagcttccttatctttttcctgtcttatgctatttagcacgcatttcggatttactgtctaggaatggcttcttgtcattgtattctattcaacattcttaattgtgtctttctct

SEQ ID NO: 610809 - DNA, 865 bp, Homo sapiens
tggcttctgacttaacccgttacaacttctttttactctatgtattactccaatattgtattcgtgtctgcttgaatagtgttaatcgtagctgatattatatagccatacctattaatcctaaagtttccctatctctaacaaacccagctctatctcctttgtttgctctctcatatatagtgcctcttctccgtcatttatgctgggggcatttatatctctacttttgatctagctcttctagtgataattatatgtgtatgttcttttctctatgttcagttttgtgtcttgtagtcctatttgtgtactcctagcgtgcgctagagctattagcacgcacatgatcctctctcgcatatttttagtgtaaggtgctatcattgggcactctctcttagctatggctagtcatcccccgtcttgtattcctcctatgtaagtctccaactccttatatagcacatatccgtatataactcgcattcatggatgtagtcaatgtcagcgctgatgctcagcacagtaagtgcgtaatgagaataagcaagctcgagaatccaatatgaattcaatgcacgtgcttcattagcaagtatttagctgggtctctatgtttacaccgtcactagcaagcctcagatgtagcttcgagtctcacccttcaccagtttgccgacggcatctacggctgcaacattgtttatgtagccacaggcttgcgcatcggacgttgcacgtcacttattggctcaactttcgcatcactatctgcttcatccgccatactaatagtctcaccgtttacagtccaaacatcactttggcttcgaagccgcataacctgatagctgacagttta

SEQ ID NO: 610810 - DNA, 582 bp, Homo sapiens
gcacgagctcctgacacggagtccgatacatcccattgacccagcgactcctttttgcccaagcctggactttctgcatcagtcacgttgaccagatgactttgcctgtgaccaaacctcatgcatccacgttcgcatcaggggaggaataaaaagacattggcgccgcttctgcgttcagttattcctacaggcgtcataggaatcatgacactggctgaacgttaccagcaccccgagaacacatttcgatagaatcagagtagaggacatggctgtcttctaaaaagccacgacatgaaaatgacaatccctaacgtctccttcctggcgctgcttccacctaacgcagactcctgcctccgcctttgtttcatagtgaggattttattatgcacggcgccctgcctctaaatacctaccctagatgatttcatcctgccccttactttttaacatatacctgtggtctttggaagggccaaatttctccctacactctgccgcacggtccgtcttcatgggaagtcatttaattccttacactttccttgtacccacagtccctaaaaccatggtaca

SEQ ID NO: 610811 - DNA, 393 bp, Homo sapiens
  misc_feature (27)..(27): n is a, c, g, or t
  misc_feature (34)..(34): n is a, c, g, or t
  misc_feature (72)..(72): n is a, c, g, or t
  misc_feature (105)..(105): n is a, c, g, or t
  misc_feature (125)..(125): n is a, c, g, or t
  misc_feature (199)..(199): n is a, c, g, or t
  misc_feature (223)..(223): n is a, c, g, or t
  misc_feature (284)..(284): n is a, c, g, or t
tgcaaagtgaacaggtatcaattcctnacctccntcctccagtcccggttaattccccacatgaaaataccnacatgttggtggaaaagtgtaatgttcaagaanttggggccggccgtggtgtntcatgcctgtaatcccagcactttgtggggctgaggcagatggatcgcctgaggtcaggagttcaagattagtntggccaacatggtgaaaccttgtntttactaagaatacaaaaaaattagccaggcttggtggcaggcccctgtaatcccagctantagggaggctgaggtgggagaattgcttgaacccaggaagcagaggctgcagtgagctgaaatcgcaccactgcactccagcctgggcgacaaagcaagaccctgtctc

SEQ ID NO: 610812 - DNA, 202 bp, Homo sapiens
aaatgtgtcctttttttagtgtaagacatcaaggtcaggcgcagtggctcacacctgtaatcccagcacttttgaaggctggggtggcaagactgcttgagaccaggagttggagaccagcctgggaaacatggagaaaccccaactctacagaaaatacaaaaattagctgggtgtggcagaacatgacttgtagtcccag

SEQ ID NO: 610813 - DNA, 765 bp, Homo sapiens
agcgggtggttggtgtgcgggtttcggttggaggactcgttgtggtgaggatggcctgtcgcttgctatgagacgtgcatcgccgagacgatgactggagcggagataatcgcatgcaccagacctgactggacgtgcaagagacgtgcaggtctgagaacgaacaggctgtcaggatgaggcgagaagatgagtgcctgagtggcatgactaaacgtccctccgactgggaacatgagcctggtttccatgctggacatcaatgggtgtggtattctattggctgtttctgagttagtctactagtctagagtccactctgttctgtcctgaccgtctcctgtatttgctctaatgatattcttgtgcattgagtgttgacatagccttggttcccaattcttatgcgctctatgaacttttaggctccatagtagatatgagaggcactgaacaacagctaaagattcccattgtaagatattgcaagcaaatctagtaaaaactcgaacgcaggacgctgtcgaggatagtgtggaacaccggcctcttcacactatcagtgagagaaacaaccttaggattgtggcttccaggaccgatgactcagttgcccttgctgcggattgcgttgggtagggacatacaaatgtgcatcagagtctgcttctcatccgtacctgactagtgaccttccgttactattgcttccatggacttataacagagatggaagtcattttttgaagtaccagtttggcaatg

SEQ ID NO: 610814 - DNA, 135 bp, Homo sapiens
  misc_feature (71)..(71): n is a, c, g, or t
ctctatgcttgttttgtttagttctgtgtataattgaatgttgtggagattacccctccctgtgccggctngtcctctcccttttcccctgtcacggctactcatggaagcaggaccagtaagggaccttcgatt

SEQ ID NO: 610815 - DNA, 274 bp, Homo sapiens
agtggaaactgcctcctggcgtgcagacccacgaagactcgctcacggtacggttgcacagaacacagcataggaagaccagtaccaccctgggttggctggacatagtccttgtacagggtcaccgaaagtaaagagagccacgacagccacggtcaccagcagctgagtcagccgcgatggtgtagacctttctgacaaagactcgacgatttatctggtcatcccagctgaaagtggtgaagagctcatggactccgggtcctccggccta

SEQ ID NO: 610816 - DNA, 167 bp, Homo sapiens
gcctggttctggttctactacacaatgcacaaccacttacgggtatccctctctgtcaatttaacaaaggcctacgattctcctagtacttgtgtcatcaaccttaataaggttgatttggtgtgcagcacaaagggcctccaccaacttgacatacataggctcat

SEQ ID NO: 610817 - DNA, 144 bp, Homo sapiens
cacagaccgacgagtaaccctattgagctataactattattaatgcaaacagctacctaacaaacccacaggtccttaattaaggaacaagtgattatgctacctttgcacggccgcggtaccctaatcgtgcaacacgaataa

SEQ ID NO: 610818 - DNA, 2264 bp, Homo sapiens
gtctccatttcctgtctgcatctgcatggttttgtttccttaggctcttcatggtttgaggaatatggccattagcagctctgggaccacagccctttagctgcagaggtctttcccagttgtgcagtaaaaaatttcaaggaacaattctgagctgtttcagccaaatatctatacctgcattagtcactgttctgcagatagagtgtgatgattagccagaagtggagcaaggtgctgtgattgggaactgcaccagaatcacaagatctgaatagaggagagcaattccccaaatcatacttgagagatcactggaagattctaacaggcatttggcagataaaaataacatgcctactgtgcttttctatttagatttatattttctatagtttattcttaacctactagtactgctaactaaaaatcgagtgtttcttgtgttaaaaaaacatgcttttacaaaaaaaaattaaattttaatacctttgcaactgaaaggagatataaatgaggatattcagaatttcagcattaatgtttaagtttcagaatacacaaacttgtttttattggttaaagaatgtttttcacttcattgcaaacttaaccaaaaagaagagtagttgttttactttagatgttcatcatatattgttcaaacagcttctttttcaaaagaaagtctatgtcaggtaaaattctatttgttgctttgcaagctgtacctctagatgatagatttcatgtatcttagaattagatttctgtgttcttagattcctgtgttcctagcaacttgtagggaataccttaaaaagtatctacttgggggtggagccaagatggccgaataggaacatctccagtctacagctcccagcgtgagcgacacagaagacgggcgatttctgcatttccaactgaggtaccggattcatctcactggggagtgccggacagtgggtgcaggacagtgggtgcaacgcaccatgcgtgagccgaagcagggtgaggcatcgcctcacctgggaagcgcaaggggtcagggaattccctttcctagtcaaagaaaggggtgacagacggcacctggaaaatcgggtcactcccaccctaaaactgcacttttccaacgggcttaatggcacaccaggagattatatcctgcacctggcttggaggatcctacgcccatggagcctcactcattgctagcccagcagtctgagatcaaactgcaaggcagcagcgaggctgggggaggggcgcccaccattgcccaggcttgagtaggtaaacaaagcagcccggaaactcgaactgggtggagcccaccgcagctcaaggaggcctgcctgcctctgtaggctccacctctgggggcagggcacagacaaacaaaaggcagcagaaacccctgcagacttaaatgtccctgtctgacagctttgaagagagtagtggttctcccagcacgcagcttgagatccgagaacgggcagactgcctcctcaagtgggtccctgacccccgagtagcctaactgggaggcaccccccagtaggggcgcactgacacttcacacggctgggtactcctctgagacaaaacctccagaagaacgattagacagcagcatttgcggttcaccaatatccgctgttctgcagccactgctgcctgatacccagacaaacagggtctggagtggacctccagcaaactccaacaggcctgcagctgagggtcctgactgttagaaggaaaactaacaaacagaaaggacatccacaccaaaaacccatctgtacgtcaccatcatcaaagaccaaaggtagataaaaccaccaagatggggaaaaaccaaagcagaaaaaccagaaactctaaaaatcaaagcgcctctcctcctccaaaggaacgcagctcctcaccagcaacagaacaaagctggacggagaatggccttgatgagttgagagaagaaggcctcagaagatcaaactattccgagctaaaggaggaggtttgaaccgatggcaaagaagttaaaaaccttgaaaaaaaattagacaaatggctaactagaataaccaatgcagagaagtccttaaaagagctgatggagctgaaaaccacggcacgagaactatgtgacgaatgcacaagcctcagtagccaatgcgatcaactggaagaaagagtatcagcgatggaagccaaagtgaatgaaatgaagcgagaagagaagtttagag

SEQ ID NO: 610819 - DNA, 237 bp, Homo sapiens
cacgggtcagcatggcaccagctctcccacagtgccaccatgcagcatgggccatcatcaccagtcactcacctgccagtcacaaggcatctgcctgtctccctgcgtcggggggcccaaccccgggcttcccatgcaggcccatgtggggcactgtgctgggcgactctcggtctcccactccgtgcaaccatctgccaccacacttgtcgcagcattcgggggctatcctctcag

SEQ ID NO: 610820 - DNA, 301 bp, Homo sapiens
ctggagacccaggggggcccatggtggagatcctttgtaaggaatggatcatggtttgggtttcccaaactcccctagtccagtgaatgagagaaatctgcctggaaattgtttcagacccctggccctttatgctttgggattgtgaaaccttgccttttttgtaccccccaaatgaaacctgtttagtaaagggggtctattttgggggttttgaaacttaggggcaatgtcccctggaaaaagctaaaaaaatgtatatgttcaatgcccttttaaaataaaattttttatttttgta

SEQ ID NO: 610821 - DNA, 949 bp, Homo sapiens
  misc_feature (289)..(289): n is a, c, g, or t
tgtaggatagcacagggaggcattatttgactcgtcccgcatcatgtgttgttcacgaggctccggcccattactcggttggtttggcaccccttgaccccggccgtctcggaaacccgcgctgtgttcagtgtctcgccgcatagcgatatgtcaaacacctcgggacactattgaatctccctccaataaagagttaacaaccccttctctcgtgggtatactagtgggaccgatgaattggaaattgcgtgtgtgtggctattgtaagtacccgttggaggctacncaccccgaagtaaatgggaatgggtcgctcccacttgggaccggaaaattttgtagcgtgtaacaaacctttttaccgcgaattattgggttttttaaaaaccccctctttctgcctccccaacttcacacctcactgtttatgaaccccgccttagtgtaaatgcacgcgcttactttcccgggaaactcaccccgcggatatagtatgaaaaaaggttgtgttaaaagaaatacttgggtaccacaaccacgaggaatttaatttttttacttgaggaaaattatatcttctcgggactataggggaaaacccccgacagacccctgggggattcaccaccacatgaagatttcgcccaaagagggccctctctcccggatagttatggtagagttgaaccccaataagaaagaattggcccccccacttggccttccaccgggatcttcttgttttgccgataaaaaatacgctggatatattggagttaatgtagatcatgcgccaccacatcacggaattacctctcctaaggacctcctctgtgtggggtgtgagccgtgtggtggcgcttgggtttctccctgtttggaaattttcccctaatttttcccaacccattttttttttccccaaaaccccaaaaaccccaaaaaa

SEQ ID NO: 610822 - DNA, 375 bp, Homo sapiens
atcaccgatgatgcgcctgcacgggccggcgtcattacctggagaaagctgcagcccagagaaaggcgaggctgggtgagaactcggccttccttcagttcaactggaaggcggacgtggtggagtcctggatcggtgaaaaggagaacagcttgaagacagatgattatggccgagacctgtcttctgtgcggacgctcctcaccaaacaggaaacttttgacgctgggctgcaggccttccagcaggaaggcattgccaacatcactgccctcaaagatcagcttctcgccgccaaacacgttcagtccaaggcacatcgaggcccgcacgcctccctcatgaagaggtggagccagcttctggccaactcag

SEQ ID NO: 610823 - DNA, 874 bp, Homo sapiens
aacctatttcaagtctgagttagaaaatttacatttcccaagtatcgcatcatggatggtattaagaagatgattgttgagagaaagagatatttctcatttgatatagattggctctgtctcactgtgtgaataaaagaagatatttcccataaattggggaagttgcccatgtctcacgaaatgtgtatttcagtgacaatatcgtgggtctttttagagagtatatcccaatagattgtcctagtatttttaggttatgcaactaataaaagctaccttacattaattaattacatgttttctacacatggtaactacaggatatgctactgatttaggaggtctaaagttcatggtatgctcttgattccaacgaagttgtgatttgctctttgtatttagcttacttactatgggtttacatgtttgatttctcaaaattgagactgaataacttggctctgcgaagaccactttgataggcgttagggaagacagtatgatccgttcgtttcagactgaagttgactgagagatccatcaagttgaacaatctgttgtactctacaaattttggccacttgttgcccacgccttgtgacctcattcttgctgaattcaacgttgacatgtttctcctcgccgatggcctgagggggaccatccggtttgcggaggtaagcctgcgtttccgttgggacccagacctattacgtggctcgctcggaaggcttcggattgttagggtgcggccctagagggttggtcgcgagcgggtaaacacctttttggaccctccgggccggaaattgtcaccacaggttttcccccacacgcggacaatcttgctctatcagcccagcgaatctct

SEQ ID NO: 610824 - DNA, 327 bp, Homo sapiens
cacgagaggaacacaagagcgtaatgccagaagcagggggactgtgaaaagaaatcccaggatagatgcttagacttggtccatatgcctcgtatatagccaaaaacttcattacaatgacaaataacactgtatatatttatcatgtccagcatatagttctgaaatatgtatacattatggactagctaaattgagcgaattaacatatgcattacctcacatactttttaaaagtttctgatgagaacaaatctactctcatcaattttcaagaatacaatacattgttattaactgcagacaccatatctcacagtagacctc

SEQ ID NO: 610825 - DNA, 155 bp, Homo sapiens
acgagcaaggtgtggcccgtgggcgccgaggtcagctccactggctcgtccagtgcagcctgccgttgcaggcttacgatcttgacaggctggccacgggactccacgtacactgtgtatggtagggcttgccctcggagatccgccagcacggg

SEQ ID NO: 610826 - DNA, 137 bp, Homo sapiens
gactctcagcaggcatcccccaaaatcatcatcaaacatcgggttccaagggggtcaaaaattttcaattcaaccatcatctccaatcatcatttcaacacatcaaccaacaggcatcatatttcaagcccaacatt

SEQ ID NO: 610827 - DNA, 473 bp, Homo sapiens
tgtctcacggtcgcccaggctgagtgcaggggtatgatatcttaatccaccttcttaatccgactcactgcaacctccgcctcctggggttcaagcaatcctccggcctcagccttccgggtacctgagattacaggtgcacaccaccatgcccagctaattttggtatttttagtagagataggctttcatctggtgggccaggctggtcttgaactcccggcctcaagtgatcctccctcttcagcctcctaaagtgctgggattacagtcatgagccaccgcactcagcaaaagctccttccttttatggctaagtagtatttccctgtaggtctagatctcaattggatggacatatgggtggtttccagttttgggcaattatgaatcaagctacggttggtatttgcatacaggtcagtcagtggacgtatattttcatttctctagtttgagagcccgtctccaga

SEQ ID NO: 610828 - DNA, 381 bp, Homo sapiens
attcaacatccctttgtaacttaaaaccctcaaaaaaaaaaaactgggtatagaagggacatacctcaacataataaaagccctatatgacagacccacaactagtatcatactgaatgggaagtaactgaaatccttttctctaagatctggaacaagacaaggatgccaactttcatcactatgttattctatcagcactatgttattcaacacagtccttgaaagtcctagctaaagcaatcagacaagagaaagaaataaaggacatccaaatcacaaaggagaaagtcaaattatcctcgtttgtggatgatatgaacttatatttgggaaaagcctgaagactccaccaaaaaatgattaggaactgattaaaca

SEQ ID NO: 610829 - DNA, 286 bp, Homo sapiens
  misc_feature (197)..(197): n is a, c, g, or t
acattcctgaagcgcagctctggcgctcagttggactctgtgtcccccatcaacccagggcgaccccccgtccattcaggccccactctggcccccgtagagcatctggagtgcgcgcttgggttaggccagggtttcggtttcttttttgagaatcgggggggcggggcctccctttgcggcccaggatgaagggngtagattatttggggtcacggcaggttccccctccaagattcaccccgttttccgggctaagcttcaagaggggctggaactaccggcc

SEQ ID NO: 610830 - DNA, 210 bp, Homo sapiens
cctcatcctcccgagtaggtgggattacaggcatgcgcctccaggactgtctaacagtgcatatccagcataaatgcggtttcgccatgaagatcagactgcctggtgtctccagcatgtggtactccgcccaacagcggcatgttaaaggtatctgttagctagtgcgtcccaccgcaatgcactgagcgcagtcgcttcatgccttct

SEQ ID NO: 610831 - DNA, 1006 bp, Homo sapiens
gggtgtggtaggagcgaggacatctgcggcggcgggcgagggagctccgtgccgctggtcctatgtgtgtgctaggaggcctcgtgggtcctgagaacctgggtcggattctcgacatgtacagccgacattgcgttggccggccgatcgtttcggacgcatgtctgatgatggcggattcgtgatggtcattactgtatctatccagagcgagtggaaagcgatctcgagtatgaatataagcgctccgtggtttgcttgccgaagctgggggggcgaggcgacgacagggaggtttcgaggaagcgccaaatcccggggcgccggtttctttaggaaattcagacccagtgtgaggaaccggaactctcgcccttagaaaagcaaaatgcttgccgggtgggcccgagacaattttcgcgaaggtaaccggcagggcccgcttgggggtatggggagcggcacacacccatgttgggtgatctacaagacgcccaagcagacaccaagggggccctcttaattcccggcccaggcaccgatctgtggagtgggaatttggttccggggggctatttcgagcacaccaaacgccggtgttaacttgcatttgattgggagggcccaccggaccattggtgtttgccgccatggagacctaccgggattaagctccggggaagaagccaaagttctccccgccggagttcccgagctcagttgaacccatctttattcagaaacctagcggggcacttcagggaaaccgtggaaacacgggcgcatacaggtgggtgaccccgtagacaattggagtgtcggggcacgagccagaacccggaaatgattgacttgcaatccaggtacgtgaaactccttaaagattctacaggtggggaaaagccgtaacatacgccttgtcagaaaaagagctgttagcagtgcctgtgctggacacgtacggaggtcctgaacaaggcctcagctggagaaaacacgcagtaaa

SEQ ID NO: 610832 - DNA, 88 bp, Homo sapiens
tgggaggtgggagggggtggcttaggtctgcctatgcttaagcccacgtgggagtttgttttcctttttgtataataaatgaaaacca

SEQ ID NO: 610833 - DNA, 802 bp, Homo sapiens
tatgtgagtgcgactggaggcgcaccataatataaaactcaaaactagactgctctgattgttttaagaaaatggcacacaaaccagacatgggggatatccccagcttctataaggccaaactgaggacaaccgatacgcacgagaagaacaccctcccgtcctaagagaggggggagcaagataagccgaatgaaatttactaagatcctgcacgattccctacccccgtcctctcctagaccctactcgtgatgtgcaggaagacccacctacaagatggacacgagccacaagctgcactgggaacctgggcactccgcgctgatgccaccggcctgtgagtctctgaagggacccccccccaatcggactgccaaattctccggcttgccccgggatattatagataatttttcgtatgaataatgaaaataaagcacacctcgcggcgatgggccttcaaactaagatattaaccataatgcccaaaggcctccatgtgggtcggccgataccgggagagagaccttatcttttttaaaatttatggccttattaataaattgtgaaaactcttggcccaaatattttaattttaggaaaagtttttgttgttagccggtttttggggtctttgggcatttcccctttaattgaggccaattaaaaaccggcggggaaataaaacagggggaggggaataaccttgggatacccaattattaattttaaaaagacccctttcccccttggtttaataaaggcgcccacataacccctctttttaccccctatgggt

SEQ ID NO: 610834 - DNA, 425 bp, Homo sapiens
ctcattcaggctgctcaacttttgcaagtgaaaaagaaaacagatgatgatgccgaagccctttgttttatgggcaatgctttaactactgcccagattgtgaaagtgttgaatttgtatactccagttaatgagtttgaagaaaaagtctttgggtcggtcattcggactatccagatgggtttacgagacaggaaagactctccccagctggtcatggatggtaaacacatttttcctgtcacctttcctttcaacccattttccctcgccctagaaaccatccagattccagccagcctcgggctggggttcatttcacgggtttgaaagtgatgtccaggcaaaaattggcaatacattttttggccgaaataagaaccccttatttccagtgaggtactgaaaatacatttttaaagaga

SEQ ID NO: 610835 - DNA, 850 bp, Homo sapiens
gttatctacattgaacgggatgctgcgggaaaaggctaatggcacaagctgtccacgtaggcgttcaccccagcaaggtggttatcactaggctaataactggagcaaagaccggaaaaagatcctcgaacggaatagccaaatctcgccaagtaggacaggaaaagggcaaagtacaaggaagaaatccattgagaagatgcatggaatagagtaatcttatatacaagctttgtattaaaacttgaaacaaagattgaaaaaaagaaaaaaaaaaaaaaaaaaaaaaaaaaaaaacaaaaaaaaaaaaaaaaaaaaaaaaaaaaaacaaacaacaaaaaaaaaaaaaaaaaaaaaaaaaaaaaaaaaaaaaaaaaaaacaaacaaacacaaaaaagaaaaaacaaagaaaacaaaacaaaacaagagacaagcgagagaggggcgacgacgaggaggggaacgcggcacgacagacgagacgacgagcgaggcagccacagcagaacgctagagacggaagaaggcgagaggcagacgaggcgagacggggaaagctatagaaggaaatagacgcagaggaatagttccggcagggatatgaatagaagaaggggagaaatagagagatggacatagaacaagcgaggctgaggtaacgattaagaaggcgaaagatagataagagaggaggagggggcgcagaaggagagaagcggagagaagcaagagaagagggaggggaggggggaggaggaagcggagagaggccgaggagaagagaggagggaggatcggagagaaaacaacggacagggggggagacaaaagacgggagcggggagaggaa

SEQ ID NO: 610836 - DNA, 119 bp, Homo sapiens
ctcgtcgtccggtgttatcgatgccacccattcgtagccaacctgtggactatgtatacgtgagggatttcaaactcatgcgtgtgtgtgcatgcgtgtgcatgtggcatctgataaac

SEQ ID NO: 610837 - DNA, 138 bp, Homo sapiens
atataatgaccttgtatcctgtgacctagccaaatgcacaatgctttagtagctttttttgtgtgaattctttaggattttctacatacatgatcaggtcatctgtgaataaaaaccttatattctgaaaaaaaaaaa

SEQ ID NO: 610838 - DNA, 321 bp, Homo sapiens
acctagtgaaagatctccacgagaaacacgatggtcaccagaacatcactaaaagctcaagcatgaggtaagaccgagacaattgtggaaacaagccctatgtccacaatctgggcaatgtttacaagttgtacccagctttgtactcatcaaccttccctagtacaaatttaattacatcatcttactgaacactactgactttactgaatctattccttgatttgatgttacctttcatacaaatcacagtagaaaaacgtatgaagttttttcaatacagccaagatgctggcttctcacctgtgaatatagttccca

SEQ ID NO: 610839 - DNA, 596 bp, Homo sapiens
ccgcaacacccaaatggcccccccacccaaggtccccacaaagggtggatttattttggcctttgggtcccaccttaagcgccagcaaggccaagaaggaaaaggaggcaggtcctggggccccatttctggaaactgttccccacacggggaataaaaaggatgtcagggggttcccggccccagccaccccccccccctgttttcgggcccctatgggcccctttttaaaaaaaaaaaaaaagccatttggcccggccctgatttcttttatttgggggggtgggcccagcttggggggccccccccccccccccgggcctttccattgtttcccttttccagggcccattaaagtttttgttttgagtaaagggggttccccgcccgcgcccccccctcagcatttttccaaaggcccgggggtccggggaagggcaaaggtcccccggggggtttcccagggagttggggggggcccccccccaaggggccggcttttgtcccgggggtttgttttccctgtttgtttgcgggtggggttttttttttggccacccccaaagtttttcccaaaaaaaatttcaaaggcccca

SEQ ID NO: 610840 - DNA, 535 bp, Homo sapiens
caagaccagcctggccaacatgatgaaaccccatctctaccaaaaacacaaaaattagccaggcttggtggtgcacacctgtaaccccagctactcgggaggctgaagcagagaattgcttgagcccggggggcggaggttgcagtgagccaaagttgcaccactgcactccagcctgggcaacagagcgagactccatctcaaaaaaaaaaaaaaaaattatctgggagtaggggcatgctacttgggaggctgagaggggaggatggctcgagtctaggagtttgagactgcagtgagccatgatcgtgccactgtattctagcctgggtgacagagaccttgtctcttaaaaaaaaaaaaagaatatgcttttcatagatatctgcctggctggctcccactcttcactcaggggtccactccaatgtcaccccttcaaagaggccttcccgggcgggctgtggaacctcggacctggaaactccagcacttttggtaggccctagcacggcagatcattttgaggtcaaaa

SEQ ID NO: 610841 - DNA, 136 bp, Homo sapiens
tccattacatcgcaacagctcaaaattaggacctagggcaggagcagtgtagagctgctgagcctaaagactggagaatctgggggactgggagtgggggtcagagaggcagattccttcccctctgaactgtcca

SEQ ID NO: 610842 - DNA, 753 bp, Homo sapiens
ggaagcagtgattctaaagtgtatgcttaaccagtcagtcgagtgtctactcttgtgtgttcacaagtgtgcacaaagtttctggtaaattaagaatattatttcaaataaattaatttcatctcataggagccagtttatcagataattcgtttctcatttctgcaaatcaatacacaatgagctcatattcagataaatataatagtttcttctttatttcatcattgttcattgattgcaacccatttctaaaacaaattatttaatataaccaaactcctttaacttctcaacttttcccatgaaaactgtgaaacattatataaaatctttaatcacataggatatgatacatatttcatcatttcgtttcaggttccggctctgtgataaataacactgaaaaacatcctaagtatcatgtattaacctttatcacttagaacacagggcgcatcgttcaaaacagacaactcaatacacagaaaacctttctccgaccaatctaacaacacatttaagaaaacttcttgtaaattcaccaaataatctggaattcacgtaatctttcttcagcttaacgcagtcgcatcctcttaagctgaatatcagtaattaatccattaacattgatgctctaatttctgctttcaagttcgaactgaggctcgatcaacgttcagtcaattctcctttgagcagggcattgggtgtcaattccaagacaaatcacacaagtgattgtccagg

SEQ ID NO: 610843 - DNA, 164 bp, Homo sapiens
ctaatctaatatagaaatggataccagatatgtatacatagagaatggtacatggagtaacttgtaatacagcaacatctcatggtaatgctcatccaactacgttaaataaggatctttacatgtgtacctaggtccttcatccagattagtgcctggcctgt

SEQ ID NO: 610844 - DNA, 283 bp, Homo sapiens
tcctgtgtactatcattaattgacagctgacccagttgctacgcagaaatggcatctcaacgactcttatacttccaaggctagcttctttctagcaccatatacactgaaccaggataaaatgctaaccaagaatttgaaagctaacctgcccactctttccatacattttttctgggcactgtttatttgcgagaagacgttccccctgctgccatctgctcttgtcctgtattctttgctagtccaatgttcatacggtgcttttgcatatgtgacatct

SEQ ID NO: 610845 - DNA, 385 bp, Homo sapiens
ggggtttttttttattttttaattttgaaaagaatttttgcccccgcccccccgcctgggccccaatgtgagaccctgttttggaaaaaaaaaaaaaaaaacatgttttagtagaagttttttttgaaaaagaaaaaaaagcataaaaaaattccccgggctggaaagggggggcttagggattggggccagcccggcccccccaaggcctttgtttcccccccccccccccctcggtgccattttttgggggggaaagggaagccccagtccctttaaaagaaaaatttttttttgaatgttttgtatgtaaaaaagcaagggggtatttttaaagttaagtttggaaaaaaagttaaaaattttaaatttaccttaaattgta

SEQ ID NO: 610846 - DNA, 93 bp, Homo sapiens
tgaacccttctttattttttgcccccaaaaacaaattaaacccccccccctctttttacaggggggctagtgaaaaaggcaaaagcgcagaaa

SEQ ID NO: 610847 - DNA, 115 bp, Homo sapiens
atacatgttcggtatattacaatgatatttataaaaatgcagatcctaggacatatatgcaatggttctcttttggtggtgggcttatggatgatttaactattatctttattat

SEQ ID NO: 610848 - DNA, 380 bp, Homo sapiens
cacgaggggggccgtcggcgaacagctcggcctccgacggcgcgcgggcggcccgagagaggctggcgcccaggtaccagccctcggccggacgcaggaaggcgcccagcgtggccgacacattgtcgaagtcccggctgaccgctgcggtcttcagcgagcggcggtccaggcgcaggccgccctcgaccccccaaccgccgcgatccaggcgctgaagggtgaagaccccggcctctcggatctccacggccggcacataggcctcatcgcccagcgcctcgaagtcgcgggtcaggccctgaacgcccacggcgccctgccagccgtcgcgctcggcctgcaccagttccagccgggcctcccagccctcggacagg

SEQ ID NO: 610849 - DNA, 361 bp, Homo sapiens
tgattcgtttctgcggataagtagctgcaggtacttcctaagcttatgtcgtgtgagatataagtcaggctgggagacccagtgtggctgtgggtaaaaaacaaatcaaatatagcagcactcagacgctcttgctgcgggcgcgtgtaccgcttgagctcctgaggttgtgctatgtccagtgtctgcacgggccgtgattgcaggagaagcagctcctctagagctcgacgctgctcagatgcaagatcaggtgctgctccgttggtgcccaagggcccctgactctgaaggaggtggaggagctggagcagctgacccagcagataatgcaggacatggagctgcgtctgctgaggag

SEQ ID NO: 610850 - DNA, 115 bp, Homo sapiens
  misc_feature (110)..(110): n is a, c, g, or t
tttatttttaccttcttttcccaaacctggaagcatttaatgcctagggcttgtcaaagaattctggtcaggtcccttttcctttctcaataaaaagcaatcttcaagcnttgta

SEQ ID NO: 610851 - DNA, 462 bp, Homo sapiens
  misc_feature (33)..(33): n is a, c, g, or t
  misc_feature (38)..(38): n is a, c, g, or t
  misc_feature (46)..(46): n is a, c, g, or t
  misc_feature (65)..(65): n is a, c, g, or t
  misc_feature (69)..(69): n is a, c, g, or t
  misc_feature (83)..(83): n is a, c, g, or t
  misc_feature (92)..(93): n is a, c, g, or t
  misc_feature (103)..(103): n is a, c, g, or t
ctataaggtccttttattaagccccctaataanctganctgttacncatatatattaataatatncatngcattattatatcnctattgtannggtatacttncccagagtgctagggagaactttacaatttcatccagaaatttaattttgttaaaggcttgacttgagttcatatagtattgtgtgagttccctctggattcaatcatttgttcttagtggggaatggaaggcttataagtctcgggaaactgatgaaattctccatcacaaagtccaaagggtctttggacaagggtccaaacatgaagtgctttctggaggagcttttgtttagtccaacaggagtccaaggatgcagattagagttttgtgagtttgcctcccttgctgggctaggcatttcattgttgtaactgcctctgagtaactgatgatcctataagtaaccccaataaac

SEQ ID NO: 610852 - DNA, 421 bp, Homo sapiens
  misc_feature (1)..(1): n is a, c, g, or t
  misc_feature (29)..(29): n is a, c, g, or t
nggaggcttcagattatacccgaaaagangttctccaggaaattaatgggaaaaatgtgtctccaaaggctatgtctttcagatggaaatgattgttcggagcaagacagatgaattacactattggtgaggttccaatttcatttgtggatcgagtttatggtgaatccaagttgggaggaaatgaaatagtctcgttcctgaaagggttattgactctctttgctaccacataaaagaaatgattcacttatgcttcccgtgttcatttcaattaaaagtagagaagcccgggtcactgatttttatcaatgttgtcttaacacatgagccaaaggtaagatgcatttaatgtggatctttttctctggagaagctccattttatatttcaaattaaaatttaaagttcttggtttaaa

SEQ ID NO: 610853 - DNA, 430 bp, Homo sapiens
  misc_feature (38)..(38): n is a, c, g, or t
  misc_feature (250)..(250): n is a, c, g, or t
  misc_feature (307)..(307): n is a, c, g, or t
  misc_feature (339)..(339): n is a, c, g, or t
  misc_feature (356)..(356): n is a, c, g, or t
  misc_feature (394)..(394): n is a, c, g, or t
  misc_feature (406)..(406): n is a, c, g, or t
  misc_feature (424)..(424): n is a, c, g, or t
gctacctagttacatagatataaccagggcactgcccncaactatatctggtcaaccatcaaaagtgccttcccaagtctcacctgtttttcacctcttctaggacctttgacaactgtcttgttacaaatgtttggtccttgcttctttaacctcttagtaaagtttgtgtattctaggattaccacagttccagaggacaatgctgggcacaagggcttccagcccatcctgtccactggacacgggngaatggaaatcgttcctgcctctgggggttccttaggatcagggtattccaggaggnttttttactcctccagtggcagggggaggggncttacggtccataaaanttaggcaggggaggtaggttttacgggggaaaacaggntctttccggccnttttttggcagggccccntttaag

SEQ ID NO: 610854 - DNA, 291 bp, Homo sapiens
caagttgttagaaaaaaaagggaatgggggctgtggcatgtactgtaccggtagctctggctacctgggaggctgaggtgggaggatctcttgagcccaggagtttgagaccagcctgggcaacattgcaagaccctcatctacaaaaaaaaaaaaaaaaggaattaagtcctggttacaggcaaaaacattgctttaaccgttggaaagctatttttgtcaattagaagaaacccaggtctctctataatggttttgcacccactttcggcattgttccacttcatatat

SEQ ID NO: 610855 - DNA, 1012 bp, Homo sapiens
  misc_feature (1012)..(1012): n is a, c, g, or t
agcggagttcccggcgcgccgcgggctggtgggctcagcggcggcgccggcactgggaaatgaccctgcccgggggccctaacgggcattgctgcggcctggggtggctggctgtaggcctcgtgcagacctcggggctggagctgggcccctgctgcctggagtgtctggtggaagcatgcgccttgcgtcttcgagtgcgcgcgtgtgccggtgggtcgctgacgcgcctgtgcgccgacggcggagcctccagagagtccccgtctccggcgtgccgaagctgtgtctgctgggggcacgatggttccaccagacggggtctttcgccgtcgttggcttccaccgcggacctcgcgggtgtgtccgcatcgaagcatgcactctggtggatccacgtctccggaggaaggacccgtagctgtgcctcgccctttatccgaagccccttgggggccctggctccgtggacgtctgcggggaggcaaggggaagcgtggtacgtttcgcccagggtcaccgtcagcgcgtctccctttgctgcaatccctttggcggggtcatgtcacttgtctggcccggcgccctgtattctcggcccttccggtccgtgtcgtcacttgccggtgtgggccgttcccctccgttccggcctggccttgcggaaggggaacctttccctgcgcacggggaactggcaccccctttgaccttcgaagcaccggcatttgcaggtctgcaatggaaccgccgcaatgggaacgccccctgttgggcgatgagatccctggctaggcaacaggcattggcgcacaaggcaatgagccgtcggagaaggcagactcgatccgtgtggattcacggttatgctgaaatgagccccccctcgtgtccaaagtaaagaggaattcgccgaaggaacccccacttcgggtccaatagatatcttttgaccacgcggtccaatttgatcgcccgcccttctctccgaaatgacacagctgtgcctacn

SEQ ID NO: 610856 - DNA, 775 bp, Homo sapiens
gccgcacaatcccgggttgtccgagtcctgtcaagtgtcacgttctgccatgttactgcaatagccacatctgtgtgtcacggcccaccctgtcgccggcttcagtcatgccgctcatgcctcatggtgaaaaggtggagcggtgccatcaagatcagtgggattgtggccactgtgtttggagcaccaggattcctggggcgatatgattgtcaaaccaccgttgggacgcatggggtcacaggtaatcatacccgtatcggtgtgataaagtatgacatcatgcaccttcgtcccatgggtgacctgggaccagcttctgtactggaatgggacgacgagagaataaacgattctatccgacgagtagtacaagacagcaatggtggtcagtctagatcttattggacgagactgggaaaccaaataattttgattgggaggatgtcatgtgaagattccccaagacaatggctcaactgtctcaaggaaggtggagtttgaaaacatccattcatgttttccgatctgaagtgcgaactattacaagctcttctagatatagggaaataacgctgtggagagcagagtagtgacgagatgcatataccgggagggccattatcgtaaggccggcgacactcttgccagagtggctagtatccctcagtccgctgcaaggtttgcatcgggtgggccgataccgtgtcctgggctgggacaaggtaacccagaattgtggatttccaggttggatgcgaagagcttggccgga

SEQ ID NO: 610857 - DNA, 283 bp, Homo sapiens
tccagtatcataggttaaaggaagaatgcggtccaatactagttactgtgtactgagtgcttactcgtacccccaggccacatgaagcacttcaaatacatgatctccttggtcttccacaatataccacttttccattttacagatggggaggctgaggccccgcacgattattagtttctctcagatcttgtggctataaggaaactatggtagagctagggtttgaacctgtttatttctcaactccagagcttgattctttaccacttccctgtctgcc

SEQ ID NO: 610858 - DNA, 966 bp, Homo sapiens
ggagccgcaggacgtaggcagccatggctgccagccggaatggatggtcttgaagccccacttccacaaggactggcagcggcgcgtggccacgtggttcaaccagccggtcccgtaagatcctgagacgtaaggcccgggagtggccaaggcgcgccgatcgccacgcgcccgctgtccgtgtcccatcctggccatcgtgcgctgccccaggttcggtaccacacgaaggtgcgcgccggccgcggtttcagcctggaggagctcagggtgggccggcattcacaagaaggtgtgcccggaccatcggtagtttctgtggatccgaggaggcggaacaagtccacggaaggtccctgaatgccaagtgcaggggcgttgaaggagtaccgttccaaatcatcctcttccccaggaagccctcggccccaagaagggagacatgttctgtgaagaacttgaaaactggcacccaggtgaccggacccggtcatggcccgtccggaacgtctatagacaggagaaagctcgagtcatcactgaggaagagaagactttcaaagccttcgctagtctccgtatggccgtgcaacgcccggtcttcggcatacgggcaaaaagaggcaaggaagccgcagaacaggatggttgctcgaccacataagccctcctggggacttggaatcagtcggcagcatgcctgggtctccacgtgctgtgttccggggaacaactgggcctggattggggtttactgtgtggaattccttctgacgagggattggggcttcttgaaaacagcaagcgccggaacggctactcttgggtgaagccgtggtgtcgtctgcgccgcgcaacagtcctgtgcaggcaccggcaaaaaacaacacacacctccccacatagcccacattacataacaaatacaacaccaacaccaacagccaagaccaaatcactgaatgg

SEQ ID NO: 610859 - DNA, 131 bp, Homo sapiens
acactcagcagactgttgtacactgtgtctctctcattgtgagacagtacttgttagctctctcggttcttccgagcagctcgtatattgtgcctgatgtctgcatgatcttggcgaggtcctgagatttg

SEQ ID NO: 610860 - DNA, 423 bp, Homo sapiens
  misc_feature (4)..(4): n is a, c, g, or t
  misc_feature (13)..(13): n is a, c, g, or t
  misc_feature (97)..(97): n is a, c, g, or t
  misc_feature (183)..(183): n is a, c, g, or t
  misc_feature (225)..(225): n is a, c, g, or t
  misc_feature (228)..(228): n is a, c, g, or t
  misc_feature (417)..(417): n is a, c, g, or t
  misc_feature (420)..(420): n is a, c, g, or t
caantgtaaaaancggggaaagggccttgagtagaccatttcctcagaaaaagatatgcaaatgcccaacaagcatatggtaatatgagcaatattncccagtcattaggaaaatgcaaatcaaaacccataatgagctattaccctcacacctgttaggatggccactatcaaataaacagnaaataacaagtattgacaagaatgtggtgaaattgggacctnttngccttgcacatgggaatgtaaaatgatgaggccgctctggaaaacagtacggggggtcctcaaaaaattaaaaataaaatgtactatatgacccaacaatcccacttctgggtatagatccaaaagaattaaagacagggtctttgaatcttaaattcagctgattaaaaaaaaaacaatgaacaacanccncat

SEQ ID NO: 610861 - DNA, 123 bp, Homo sapiens
tccgtgatctaccgatccttagtggcatggtcttggctcactcaacctctctcccaggttcaaccaattctcctcactcagcctccagagtagttgggacaactggcgtgcaccactatgccc

SEQ ID NO: 610862 - DNA, 384 bp, Homo sapiens
  misc_feature (231)..(231): n is a, c, g, or t
  misc_feature (358)..(358): n is a, c, g, or t
gaatttgtcaagaactttctaataataaaatacagaaatagattaatagttgctacaaacataaagagagactccatggtagaacactttaggaagcacattttatcttttttgaaccaacatgtatttccaaacatgtaagtaataatatcaagcgtggtgggaagattggattggaggctgattctgatctgtgtgttgggatgaactgtggcattcacagcattgagnaaaatcatcttcaaggacagcgtttaattctgttgttgacaagtcttttaaggaaaaagtactagtttggggaatttttcacagatacaaataagcttgacccctaaaattttaaaatattattttnaaaaaattaaaatgtccaggttttat

SEQ ID NO: 610863 - DNA, 470 bp, Homo sapiens
tgcctgaccttgtcacaagacatttcccttttagcactcacttggatttttgtactgagtggaagttggaaatgattgcaaaggaaggcaatttcttttgacatctcatgtatgacccatttatctctttatggaatatagtgaagtattggaggggagcattagagaataagaaatagttctataagtgtatagggctatagtttcatcttagtgattatataaatatataaatatacacacacatactatatatatatatatacacaatgtatatgccaaataatatagtataggtataattatatgaatgtttattggggatatggagacctggtttgccttgtgagagagacagagtaactgacaaaacatttcctagatactggcctctttttaatctttcatttatttttattatggaacatttccaacacataggagagcagagggaagaagagtacaatgca

SEQ ID NO: 610864 - DNA, 240 bp, Homo sapiens
tgtggtcgtgctgtacgacgctcatgagtacagctgttgttgtgccagccttctggagagatcgatgtgatcagcaggggaatattacgagcgatcaggactgcttcgctgcgtgttctgacttctggaatctttgagacccagttccctgttgaccaagtcaacttccacatgtttgacgtgggttggcagcgcgatgaacgccgcaaggttgatccggtgcttcaacgatgggggatc

SEQ ID NO: 610865 - DNA, 236 bp, Homo sapiens
ttttgtttgttgggaagttggggttttggggggagggggaagatattagacgttgcataaaaagcctcctttaaaaaaaaggaaatgctttttcttttgtcttgtgatttttttttttaaaatgaaatttaactttttgtgcaagtaggactattaaacccctcttcagtgttttacttgtactgtatcccattccaaacccccctttaatttttaataaaactgttcccttgtta

SEQ ID NO: 610866 - DNA, 160 bp, Homo sapiens
cccccccccccttttagaggccggtttccccccttcccccggttaaaattttggcaaaggaagggccccccgccccttttccttttccgttccttttcaggaaggcccgccccccccaatttttgggaggggaaaaaatttttttttttttggggccaga

SEQ ID NO: 610867 - DNA, 248 bp, Homo sapiens
  misc_feature (38)..(38): n is a, c, g, or t
  misc_feature (83)..(83): n is a, c, g, or t
  misc_feature (107)..(107): n is a, c, g, or t
  misc_feature (149)..(149): n is a, c, g, or t
  misc_feature (154)..(154): n is a, c, g, or t
cccccttgtcccacggctgctggggccccccagtagcnataggctccggtgtccgctcacgcagcccggataggaggcctcgngtcggggggaagacgtcgcagttngtcgaagagtccgaagcccagcaaatctgcccgctccccgcnggctngccgctctcgctcgcactcttgctctcggtccggggacgaaattggactcacccatcagctgggtggcctcagccaaggctcccgaaaccagtc

SEQ ID NO: 610868 - DNA, 246 bp, Homo sapiens
cctgagattgttcgctactgcactccatccaagggtggcagagagagactttgtctcaaaaaaaaaaaaaaaaaaaaaggaaaaaaaaaaaaaaaagggaaaaaaattaccacccccaagggcggggtttcggggaacccagaaaaaaagtgacggggaataaaagaaagggttttcgggtctcctgtaaagcctaaagagaggcttgtgtggaaaatgtgagggttaaggaagaatgaggggtta

SEQ ID NO: 610869 - DNA, 184 bp, Homo sapiens
acgggcggcgatttggcttggctcaggtatgggctttcggcgtgtgcagtatggactctcggcgtgtgcacacgccgagcccccaaaccatagtcgccgatcttcacgaaagcgaaatcgccgatcttcacgatcggcgattttggtttggtgcctcggcgtgtgcatgtggatattcggcgtg

SEQ ID NO: 610870 - DNA, 154 bp, Homo sapiens
ggcatgagtgagtttacaaatatgtatcgtctgttaagcagcatgtgcaggattattcataatataggagttaaaataagtattagtgccattttcaggtatttatttttgcacaggaaacacattatctggggagtcggacaggggaattttt

SEQ ID NO: 610871 - DNA, 199 bp, Homo sapiens
tgttgggagtgggcagtggggtggctaattgttttcggccaaccaggggcctgttgcccaggcaactcaccagctccgccttttttgattggctgccccggtgggagtcaaccaaaatttaaagggaagccaacgattgcttttttcaaaacccaccagtccccctgtggggggaaaaataaatggtttttttccccca

SEQ ID NO: 610872 - DNA, 551 bp, Homo sapiens
atcaaaccggctttgttcgcttgggtattttgagttctgtgcatccccatctgttacatgcacggcaacaaaagaacactgtgcttggcgcaccacttttttcccccttttaataattgtatttagagcttatagtctaggggcagatttggaagctgtgtgtgggagacagtcacagatgggacagtcacagtttcctcacttaatgcttctgtgccagcataccattatcagagggacttcaagttgaggtttaactcaggatgaatttcctggctggatactatcctaagaattttccgtatacattcaaacattaaacagtttcatgccagtcgaagaaatttgcctctgcgttggcatttcttcattgtgggtggttggaagcctgttaagaggcgtggtactggaggtactgtttgtcttcaatagtagtacagcttgtgtagtggactggtgcccttattgctgacgagggggtggtacctggaacatggaggacaacctcacttcagctgcagtgcagtgacttggagtggtctcatcccttt

SEQ ID NO: 610873 - DNA, 137 bp, Homo sapiens
gtgaagaactgcacactgaatcttatgcagaggacagctgttggacaattgtcattgaaatcgggtactctaacatataccgtgtgctgtagaagttttacccgtgtattcatctatggccagaaccacaaatatcg

SEQ ID NO: 610874 - DNA, 1472 bp, Homo sapiens
  misc_feature (614)..(614): n is a, c, g, or t
tcatccccctctccccaaagttcgtgaacacacgtttccaaagcgagaggggaagtgttcaaaccggggggggaccacaagaagcgtgtctgcacgcaacaagccactgttaacaccaacgcccgggcgggcccccgccccacacggagcgggtcaccacggcagaaaatgaccccaacggccgaacaatggtttgttgggtggaaaaatacaccacgcggggagaatgattaaggtcgcccccaccacgttcgcccccgtctgggatacaacaacggggggtttgttctctgtccctccttaaaaaagggccgcccacggaacatctttttgtaagagggaacgccaccccacaaaaagggggggaaatgacccctgcgttcgttgtggggaccccggttggagcccactcaccctttatataacccacccgctttgtgggttgggggaaacaccacgtgttgtggaaaccacaacgaaatttgggtggataacaccccccgtggtgttaccacgctcgtttggggacactatacaaattatggagaagccccgcttttggaattggagacactctcttcttttaaaactcgcccccacaaagggaagttatnccccacagcgagatttatttttcttcggggttttaatattcctccgggagaaggcccccactctttgccgcgaaataaatagtctcttttcacggagctctgccttctggagagagaaaagacttcaaagggtgtgagaaaactctggagaggagaaaactcctttacagtgtactatacatatcggagtcttgagaaaagaaattgttggcgagagggctctaagagcccaccaatattgagagaggctctctcaccacacataccccacctcgagaaaaatggagagcttctcgtggatatatataaaggggctcttcgctttatagggctgttataattgtgagagagagagtgagattgtgtctctctccgttaaagagaggagaaagagagtgaatagagtccacacaaaaccctgtgtgagacgcaccgagaagctacccccttctcgagaaggcgtacacactcctttccacacagtgttcacaggaattgggggctctcctcgggagcccctgtaaactctttagagtcacatcgtaagctgagagaacactataaatctttgttgtggtaactaacgctttggtgaattttgtttcttatattggtgtttctttatgctaaagagaacttcttttcttaaaatgtgggtttgttaactcgtagcacctttttaacacctgagaaactaataacttgagaccacgttccacacctggaacacataacactaactgtactgaaggcttgtcctctgagactaggtttttaaattttctaatgtgggaatttcctatttcttgcagcatccctgtaaataaacattcaagtccaccctttttttgacttcca

SEQ ID NO: 610875 - DNA, 1451 bp, Homo sapiens
  misc_feature (1451)..(1451): n is a, c, g, or t
gtctcagtctagccttgaatgtcagtgctgaggcctcttgtgtagcataccagttagtccaggaaatgggttgggcgtgtcttgagtccagccttgaatgtcaggctgaggcctcctgctgtctgccatcacaacagttcagtcccaggtctggcatggcaatgacggcatcaacacgcagtgagctggatttgcatggcagtgagcacctgttgggagaatcaaggatggtctaaaagggctgtggtgagacctggaaagaggtctggagcagttgaggataaagactggatgataaatacttaagtagatatggattcaattgacatgacatgatagaatgctagaatgagacgaaggcaagcgcacgggacatccggggacaactacggccagaaagacgacattcgatgcgaggaccaacataaacacgaagaaaccacaataactgaacagaccccatacatggcaccaaaacacgggacacagccagaaggaaccaagcctgattgagcccatatgacaccccatgaacagaaagtagacaaagaagagagacatggcacttagcatgaaacgtcgactaccgaataggaacaaaccagtacacacatgagcaggaacacacagagagagacagtacagagaacaaacatagggactatgagcgatatgagacaccccagcaaaaaccaccacatccgagagcagagaaatccataacggagacaacccagaacaacaggcacagaaacagaaagaggcgatagtaggcgcgatgacaccaccgccaaccgccgcgaaaccgcacgacaaacaaaaaagccaggaacagcaaaaagcaacccaagaaaccacagagccccgaacgcaagaaacaacaaccgagacaaacaaaagcacagacaggacaaggcaaaaacccacacgacaaacacgccagaacgagcatgcaccaacaactcagacacacgcaaaacgccaaaaaggcgaggagacaagcaccaacaaagaaaaaagcagaacaacccaacaaaacgacaaacaacacacaaaagagccacgaaaaaagggaatagaaacgagcgagaacaaaacaagagacaagcagacacaaaactcaagaaaaacaacagcaaacaaaacaaccaaaacaaaaactacaaaaacaacaagcctcaaacaataaattcgaccaatcacaagtcatcctcaacaaacacagtaaaaccatcagtacacaaaacaacaatacactacaatcaataactaacaaaacataaaaaccaaaaacatatacaacaaaaacaaaccctaaaaacacataacgatcacaaaaaataatagcaatcactcaacatcgaataatatacaaatataatcataatataacataaaaacaagacaaaaaatacatacaacactaaacaatacaaccacttcaaaaacan

SEQ ID NO: 610876 - DNA, 130 bp, Homo sapiens
agagagaagggaagaaagaagctcagcccacaggaatggccccagaggccccatgaagaatacgctgtcacgcaggaggaagacagcggaaaacgaggaagagccggtcagcagtgggaacaggaagggt

SEQ ID NO: 610877 - DNA, 194 bp, Homo sapiens
ctgcttgatattcatatgcccataaccatggtcatgagcgggatctaacatgtactagtgctggacgtagttctggagtctaaccatatcaccccattaccagtctagtttgcaagagcctctagttagctttcttccacctcctttgtctattttcaagagagcaccaggttgatcttgataaaatggacaaa

SEQ ID NO: 610878 - DNA, 252 bp, Homo sapiens
tggcatcctatccacgtgatgcatcatgttcatgtatacacgtatctagatagacttaccctgtaagcagcagtgcaaagtgtagatggaggactctccctaaaaagctaagtttacgggattaaatatcatcgtcctcatcatcgcccgggtgaataaagctgctgccagtggataggggcccttcttcaacactcccaaaaccacccaaagtccccctctcatcagaatcgtcaaacaacttctcatagt

SEQ ID NO: 610879 - DNA, 970 bp, Homo sapiens
  misc_feature (6)..(6): n is a, c, g, or t
  misc_feature (159)..(159): n is a, c, g, or t
  misc_feature (344)..(344): n is a, c, g, or t
  misc_feature (346)..(346): n is a, c, g, or t
  misc_feature (425)..(425): n is a, c, g, or t
  misc_feature (464)..(464): n is a, c, g, or t
  misc_feature (537)..(537): n is a, c, g, or t
  misc_feature (544)..(544): n is a, c, g, or t
  misc_feature (555)..(555): n is a, c, g, or t
  misc_feature (584)..(584): n is a, c, g, or t
  misc_feature (639)..(639): n is a, c, g, or t
  misc_feature (678)..(678): n is a, c, g, or t
  misc_feature (683)..(683): n is a, c, g, or t
  misc_feature (726)..(726): n is a, c, g, or t
  misc_feature (746)..(746): n is a, c, g, or t
  misc_feature (749)..(749): n is a, c, g, or t
  misc_feature (769)..(769): n is a, c, g, or t
  misc_feature (776)..(776): n is a, c, g, or t
  misc_feature (810)..(810): n is a, c, g, or t
  misc_feature (814)..(814): n is a, c, g, or t
  misc_feature (816)..(816): n is a, c, g, or t
  misc_feature (844)..(844): n is a, c, g, or t
  misc_feature (870)..(870): n is a, c, g, or t
  misc_feature (874)..(874): n is a, c, g, or t
  misc_feature (880)..(880): n is a, c, g, or t
  misc_feature (884)..(884): n is a, c, g, or t
  misc_feature (910)..(910): n is a, c, g, or t
  misc_feature (932)..(932): n is a, c, g, or t
gatgtnggggggatggggggcgggggggaagggggctgattatattttcataggagatatgggacaagaaagaggctaagttaccgacaggttcacacaaccctgcttccagagttcaaggtttggggaacccatccaacccctcctcacccgttaaanaaaaaccaggagaaaattgagaggggatgggtgggggaggaccaattccacgacctgttaaattcgagagctttggagggagctctcggtgtgaccccttccgactgggtgttttagggccatttaccacttcaggctacagccagttagaccgtggtggagacgaaatgagggtgcagtccgtncnaaaaacgaagcgctggaagggaggaatcgtgacggcggctgtaaatggcgtgtgttcattaagttacgctccgcttacnccactgcgggcaaacaggaaacatcaggaatctgacgcncaaggagggttaggaccatgctgagcgcacccagaaccagcagaggccctgggcaggaggtccccaaccaatncccactngctcaagaatnaaaaggtgttcagccccctcctccctganaaccaggagttcacgaacccaggccctccttcctcagccacaaaagcttggggtncccagttccacttcttctaggcttagtcctggccctctnctctnttagaactaggatggtcccccagccccctcctccctcagagcntgatgcccagttcgagaacnttnttccctgaaatctcgaagtntggggtnccagcttcttcagggtttcaggtgaatgggcccncgtntncttcccaaccccacacggaagggcaggnaaggaaacgggtttattcacagtttnattnacaggnagcncccaccccgcggcaccaaatcccggngggagggccgaagttgctaaanggtggggacggcctttgaagggggggggccgggccgga

SEQ ID NO: 610880 - DNA, 2825 bp, Homo sapiens
gttgggggagagcggggtaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggcgcgtagagggggcgggcctgagggcggcggtttcccgaacggagcggggcctgctgagcgggcgctcgcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgcctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttacatatgcagatgctatttgataccaagggctttttaaatgtcatgggggggaaaaacccaacttggttgaactcccagctaaacaaccaagacttcactgaagatttattccaattctagaattgttctttttttattttttattttttcaactgactaacttcattaccttaaagcctagaacattattctgctttatttatatggctttctcaattttattttgtagcatgggttgaatcgaactttttactagagaattttactagatatttgtcattcaagttttcatctgctttataattgatacaccttgagggtcacttttctaatacttttacctataatgtggtacccacctcagcccctaataaataatatttttaccctaatgtcaaatctttttcccaggctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctcta

SEQ ID NO: 610881 - DNA, 126 bp, Homo sapiens
taactcacgagggcccccaagcatatcgtggcggaagattatcgatcgacgtaccagccaaagtcctccagaacgtgatctgaggtacagacgcacagcagcagaaatgccggtgcataatgacaa

SEQ ID NO: 610882 - DNA, 284 bp, Homo sapiens
gctatagtaggtgccgcatgcccagctaattgtttggtgggtttgtcttgtttattgagacagagcctcactctgtggcccaggctggagtgcagggcgcgatctcggctcagtggaacctccacctcccaggttcaagcaattctcctgcctcagcctcctgagcagctgagattacaggtgtgcaccaccatgcccggctaatttttctgtatttttagtagagacggggttccaccatgttggccaggctggtcttgaactcctgacctcaggtgatccgc

SEQ ID NO: 610883 - DNA, 2947 bp, Homo sapiens
  misc_feature (592)..(592): n is a, c, g, or t
  misc_feature (648)..(648): n is a, c, g, or t
gttgggggagagcggggtaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggcgcgtagagggggcgggcctgagggcggcggtttcccgaacggagcggggcctgctgagcgggcgctcgcaccagccgccgcaacccaaagccccgggcttcctgcagccaccgccgctgcgccagcccaggacgaccccgccgccaggggcccagtgcgaggtccccgccagcccccagcggccttcccggcccggggcgctcccaggtacggagcagctctaagggccccagtcctccttggcgaacgcttccccacggccctccacgcgtgccgaggcccgacncgctgtctgcggtccccacccccggttccccgaaagcattccccgagagggccgcntgaccggagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgcctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgagatgctatttgataccaagggctttttaaatgtcatgggggggaaaaacccaacttggttgaactcccagctaaacaaccaagacttcactgaagatttattccaattctagaattgttctttttttattttttattttttcaactgactaacttcattaccttaaagcctagaacattattctgctttatttatatggctttctcaattttattttgtagcatgggttgaatcgaactttttactagagaattttactagatatttgtcattcaagttttcatctgctttataattgatacaccttgagggtcacttttctaatacttttacctataatgtggtacccacctcagcccctaataaataatatttttaccctaatgtcaaatctttttcccaggctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctcta

SEQ ID NO: 610884 - DNA, 1197 bp, Homo sapiens
gtggaaatggcggctgtagccgagggggcggccggaaagcagcggcggcgtctggggcgctttcgcaacattcagacctcggttgcagccctggatgccgtgagctgaagaggtttcacatcttactcctgtccccacaccctgggcgttgcggcagttggtgctcgttgctgctagctcgtgaccctgctcgatgggcactgactgcgtgctggcagagtctgagtctgggggacctgtggaagacatgcccccgaccgtcacgctctagatgagcgcctagtcccaggaccctgcctgaatgaccatccggcaaagaaggactgttgctagtggaattggagaagatgtgggacgaacgatgatggaagcaatactgatgactatagaaaggaagggcaggtgagatgtaatcgccttgactactagatgaaaccgcattcgacgtatctgcctcaggctaatggctagctaactggcacgcgatatcacgcacatgtccggatagacgctcttgttaccacagtggtgggactggggaacaggaggtttggtggaacgccaacgcagggtctactctctggggcacatgaacaggcatgggagaggactatggactggtggttaacgttttaattactatgacacgcacgaaagggggaaccttggacagcctatcggaggaatctcgatagtagaggtttcagcgttttgggcgttagagttgcaattccttgtcgaccagacaacaacacatggggcatgcaggaacgtttgtccgtcgctatacagatggccgcaaggtaccacggaacgtgtcatcggcgaacgtgtgtagtagccgttgggctaccactattttccttaacacgaactaggggggggcttacattccaaagagggtatcgcaatggcaacatacgttcgagacggcgaagcgttggtgacaagagccaatttggtgcctagaggatccccgcatggtaacacaacttcacgcccaaattgcgttatcccaacaagaaagccgacaagagccgtatagaagccaaagatcttgccaaggaacctgggtgaaaaccccgttccacgggtgtgacatcctcgagaacataggtcgcacaatgggtgtgtccaaacaagcatacggtggcaactaggtaagtggactagccatagtatggccaccaggccacg

SEQ ID NO: 610885 - DNA, 2565 bp, Homo sapiens
  misc_feature (73)..(74): n is a, c, g, or t
  misc_feature (89)..(90): n is a, c, g, or t
  misc_feature (105)..(106): n is a, c, g, or t
  misc_feature (114)..(114): n is a, c, g, or t
  misc_feature (131)..(132): n is a, c, g, or t
  misc_feature (137)..(137): n is a, c, g, or t
  misc_feature (143)..(144): n is a, c, g, or t
  misc_feature (147)..(147): n is a, c, g, or t
ggtggccccagtgtgctgtgtcggggcctggagcctggggcctggtgcctgcggagtgggtgcgggcctgagnngctggcgtgtttccnngaactggatgcgtgnngccatgantgatgctgggctgctgnnaccangccgcnnganaccaaatgccccgtggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgcctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgagatgctatttgataccaagggctttttaaatgtcatgggggggaaaaacccaacttggttgaactcccagctaaacaaccaagacttcactgaagatttattccaattctagaattgttctttttttattttttattttttcaactgactaacttcattaccttaaagcctagaacattattctgctttatttatatggctttctcaattttattttgtagcatgggttgaatcgaactttttactagagaattttactagatatttgtcattcaagttttcatctgctttataattgatacaccttgagggtcacttttctaatacttttacctataatgtggtacccacctcagcccctaataaataatatttttaccctaatgtcaaatctttttcccaggctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctcta

SEQ ID NO: 610886 - DNA, 910 bp, Homo sapiens
acacttggttacggtagtgtgtgtaggttttagctgctgaaaattactgttattttccctttccatacttctgttcttggaaaacagtcactaagtccagtcatgggaggtggtgggtgggaaagattacattcaacccctggaagtgggaatatccatatgtagtatttggaatttttctatatggaacaattgtttctccctccacacctaattggtttacatccagtatggactcatgtatatttagtattatgggtaacaagtatttatttcgtgcttaagttgtccagcattggctatcaggagttctgcaggttggtactatgtcccatttgatgtgcccatcacatttagatatttgagcacattcttactttctggcacatacaagatgctccaggttcatcttggatattccctggcaccaacccatagaatccctagaatcaatccacatgatccaaaagagcccatggttcctttgtcaggagaatcatacttagaaaccacgatctgggcaatgcagaatggtgctggtgcatactgggatgtcaacatgtcagtagcagagttgagaacatatgtatgtatattaatccatgcaatatgtaacaacatctatcaatcatcaatgtggtgtccaaagcctaacacattgagtttggtattggcagggcattcacacgatcgaaaacatggtccacaaaaacatcagggtggcacataaggcttagcactcgacaaagggcgaccagtgacccctacaatgacaagacagctacaatccgtcaaaaaggacgcaagcacacacaccagacagcacaaaacaagcgggcacaacaaaaacatcacgagacaaagccaccacacaacatgtgaaacgagacacacaaacaaaaacacagca

SEQ ID NO: 610887 - DNA, 2827 bp, Homo sapiens
  misc_feature (472)..(472): n is a, c, g, or t
  misc_feature (528)..(528): n is a, c, g, or t
gttgggggagagcggggtaagccgagggtagccgagcggggcgggcgctctggagcggcgggtgctcgggctgccgtccgctccgccagaagcaccgagcagccgaggaggcggaggaggaggagcatgtcggacggtttcgatcgggccccaggtgctggtcggggccggagccggggcctgggcgcgtagagggggcgggcctgagggcggcggtttcccgaacggagcggggcctgctgagcgggcgctcgcaccagccgccgcaacccaaagccccgggcttcctgcagccaccgccgctgcgccagcccaggacgaccccgccgccaggggcccagtgcgaggtccccgccagcccccagcggccttcccggcccggggcgctcccaggtacggagcagctctaagggccccagtcctccttggcgaacgcttccccacggccctccacgcgtgccgaggcccgacncgctgtctgcggtccccacccccggttccccgaaagcattccccgagagggccgcntgaccggagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgcctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgagatgctatttgataccaagggctttttaaatgtcatgggggggaaaaacccaacttggttgaactcccagctaaacaaccaagacttcactgaagatttattccaattctagaattgttctttttttattttttattttttcaactgactaacttcattaccttaaagcctagaacattattctgctttatttatatggctttctcaattttattttgtagcatgggttgaatcgaactttttactagagaattttactagatatttgtcattcaagttttcatctgctttataattgatacaccttgagggtcacttttctaatacttttacctataatgtggtacccacctcagcccctaataaataatatttttaccctaatgtcaaatctttttcccaggctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctcta

SEQ ID NO: 610888 - DNA, 375 bp, Homo sapiens
cctgcgtgagtgggtcagctagggaagcagaaggaggaagacgcgtggaatcgatcctggtctgaacttgggcgtgagccaccgtgcctggacaaaatatgtattctctttctttctctctctctctctctctttctttctctctctctatcttcccttccttcccttcccttctttgcctggtcttgctatgtctctctatcttgtcttccttgcccgtgcttcccttctcttccctagcctggcttcttgctctttctttctctccttctgctcttgctgcccttccttcctttccttcccttccttcctttctttcccttccttcctttccttcccttccttaccttccctcctaagttcagagccaggggg

SEQ ID NO: 610889 - DNA, 788 bp, Homo sapiens
  misc_feature (1)..(1): n is a, c, g, or t
  misc_feature (114)..(114): n is a, c, g, or t
  misc_feature (124)..(124): n is a, c, g, or t
  misc_feature (235)..(235): n is a, c, g, or t
  misc_feature (242)..(242): n is a, c, g, or t
  misc_feature (258)..(258): n is a, c, g, or t
  misc_feature (273)..(273): n is a, c, g, or t
  misc_feature (281)..(281): n is a, c, g, or t
  misc_feature (283)..(283): n is a, c, g, or t
  misc_feature (320)..(320): n is a, c, g, or t
  misc_feature (347)..(347): n is a, c, g, or t
  misc_feature (350)..(350): n is a, c, g, or t
  misc_feature (360)..(360): n is a, c, g, or t
  misc_feature (369)..(369): n is a, c, g, or t
  misc_feature (371)..(371): n is a, c, g, or t
  misc_feature (375)..(375): n is a, c, g, or t
  misc_feature (390)..(390): n is a, c, g, or t
  misc_feature (417)..(418): n is a, c, g, or t
  misc_feature (422)..(422): n is a, c, g, or t
  misc_feature (442)..(442): n is a, c, g, or t
  misc_feature (518)..(518): n is a, c, g, or t
  misc_feature (613)..(613): n is a, c, g, or t
  misc_feature (652)..(652): n is a, c, g, or t
  misc_feature (698)..(698): n is a, c, g, or t
  misc_feature (760)..(760): n is a, c, g, or t
  misc_feature (787)..(787): n is a, c, g, or t
nccagcccctcacttctggctgtggcaggttccccatcctagctccccggatctccatagggagtgtccagggaccctcaatctccagggccacttctgcaggagctcgggttngaggttccangtggccagaagagctcaggtctctgagggctggtgtgcccgggtacccatccgcatcactgctctcctcctgtccggctacgcccagggctgagtgacggtggtggcaagnacttgtnctcagggcagcaaggncttctgttcttacancagcaggnantccttcatggccaccagtaaccccagtgggcggaggngctcctgggctcggagccaggacaaancgncgagggtagnggttaccangnttanactgagcaccgcagnagctgcaataaccccataggcagttgnncttncagactggtctccggcagangaggatttgggattgccgagagaggggagagtgtgcagggtcacagggggccccatggttgtggcattcctgaganaggtgacactctccagggtcacagggggcccatggttgtggcatcccttccgggaggatctcattggttccacagccgagctcgtcgctggagtngggacagtctgggtggccgtcgcagcgccacgtgagtgnaatgcagttatcgctcagcgtgcaacggagctcgcctgctaggcangccaggcggctgcagttgcccagtttcttgtcagttcccccagagcagtgactgacgccggngcaggggcaggggaggcagggggcggng

SEQ ID NO: 610890 - DNA, 145 bp, Homo sapiens
tatacgggttcctagtttccacagtgcacactaccactcgttatctctgatctttttgataacaggcatcctaccaggtgtgaggtgatattatatttccatgtggtctgagatatgcatttccctggtgattaataatgttgag

SEQ ID NO: 610891 - DNA, 216 bp, Homo sapiens
  misc_feature (99)..(99): n is a, c, g, or t
  misc_feature (145)..(145): n is a, c, g, or t
  misc_feature (185)..(185): n is a, c, g, or t
  misc_feature (190)..(191): n is a, c, g, or t
acccaggatcgggagactctcccacccctcctgcagttggactgaattcttccctttcatccgaagaaacccacttgctgtttccatgccgctgaatcntgctgagtgtgcagcctgcatcaccgtgctgtatgcctgatcatcntcagaaatgggcttgtgtagatgtagtggcccgtgttctnccttnnaggatgttgcttgttcctgctgggt

SEQ ID NO: 610892 - DNA, 838 bp, Homo sapiens
  misc_feature (699)..(699): n is a, c, g, or t
aagaagaggaagaagatgatgatgaagatgaagatgaagaagatgatgtgtcagagggctctgaagtgcccgagagtgaccgtcctgcaggtgcccagcaccaccagcttaacggcgagcgtgggacctcagagtgccaatggatgatgtggtcaatggatgtgtgaccccctgctggacctgcaccatgggccagtgactgaagtggcgtgtggtgccaagcccctggtgcatgctgtgctaccctgccagatgtgttcctccaatgtgcatgccactgacacaagtgaacgtggtgtgacacagacttactagtatgcacacccgtgtgcacatgagctccgcctgtcccacctgtggcctttttgccccaccatgtgcaataatcattgcgccttacgctgtgtgtgcctgatctgtgtgaccccccctatttggcttgtcactaccctgtgtgctgcaattatggagacaggccgatcgtgactcccctgtccgtagttgggacctggtgactgagattgtacgtccgacatactttctactagagtgcttgtgatctccctggaggcaggtgcgaacagtcttctcccacatgacgcagtgaacatctgcatgagcacaacatccttttgtctaggctacattgcaaggcatgcacgcatgactagtgactacacacgggaccttgtcacaatncacggcgcttcgtgtgactcaggccgcttgaagtacatatccttaacgagatgcacacacaaccaatacacagtgcgtgtctctcacggtcaactgagcacaccttgtcgaagtgaatgaatagaaccctcggactggc

SEQ ID NO: 610893 - DNA, 972 bp, Homo sapiens
gggcctgctgaggtgatgagagtccgggagcccgaacttgagatggcctgatatgaaggagtcacgcctcccggctcccggatctgcccagaggactgcctcgtccttacaatgtgcagagagctggttcagatgtcatggaatgggaagccatgtgtgaccagttcccaagtcttggcaaaacgaacgcgcacatggggcttgctcgaagtgtagtaagaagaattgggaccaacctacccttgacgccgtttgcccgggcgtcctttgagatcctgacccaagcatctcgtggaccttgtgtttgagagatgtgcccccagtcacctaacctggcgtgacatctgctggattgctgcggatgaagaggagacatatgcccgggtcaggagtgatacagcgccccctgaggcacacctggaaaccagacctctgattgtcatgcaggcgcaatgcctctgttcccaagctgcgtgggtccgaggagaggttctggccctgaagaagccagctctgcagcgcctaagccgcactacatgagctgaggacgagctgaggcacttgcgcagccatgattgacacagatagtggcaggtggatgcaagttcggttcattaacgcagattcttatgtcaggaagttcaaatgtgtcttctcccttacttgttgggatcctcattccattctacacttcgtttgttattagtgcattacgagggagacagggtgggaggtcctgaggtcataggtcccctgttgtttggaagcctgaatggtgcaacaaagcaaagtggtgaggtggtgaaaggttgccagggctttgcaagcagagttgaggatggattgagagtacgataaaaggaatgaaggttgaggaacgggatttgagcaagaaaggtagaaaatgaagacagataagctgaaaagagaaattaaagaggggaaaggttcaaggttttagtgttctttttg

SEQ ID NO: 610894 - DNA, 344 bp, Homo sapiens
cagcgatacttttcctcactagaacaatccggctaagcgatactaatgctcacggttcatatctgcacgatactagtcattaattcatcctgaacgacgcgctaggactgagtacgggttgcttcccaggtttggaaacaattcgtacacttgccattctctgaatataccggtatcgctgaggtcagcctggtcagctcttctttgcgcttagctatagctacataccatggcttcgtggccaccatactagcgttgatttctgtcactgcttccgtgtcttcttctggggaggagaaatatacaaaaccgaaccctttgctacaatcatcctcctctttcga

SEQ ID NO: 610895 - DNA, 207 bp, Homo sapiens
catggagaccagtgaggtaaagcaggtttggggagttggttccagaaatcctaaatatgagatgtctattacaaatccaagtgaaaatgtagagttggtggttcagactagaggtctgaaattccatctagattatatcaaagggacattaaaattgccatatccaagatatgtatgatcagcgggggtagatatcatctcgtctga

SEQ ID NO: 610896 - DNA, 164 bp, Homo sapiens
  misc_feature (135)..(135): n is a, c, g, or t
  misc_feature (155)..(155): n is a, c, g, or t
atacctgggtgtgacagctctatatggagtgggggcatcactcaagtctgtatcagagtacatacagccaacaccacaggagggacgagcaccctgggcatccctaagtgctggttggctcattgggcctgaccntggctcaacctatggatccntaggatgac

SEQ ID NO: 610897 - DNA, 124 bp, Homo sapiens
gcttgataacggtagtgctatcacagctcactgcagccttgagctcctgggctaaggatcctcctacctgagcctcctgagtagctaggactggtctccatgggtaccgagcttcgcaattcgt

SEQ ID NO: 610898 - DNA, 570 bp, Homo sapiens
tgcccagcctgagcgtcgcggggcctgacccccgccctgccggccgcctcgccgagcctcctggggcgcccgggccctgcgacccctgcacccagctccgcaggaccggcgggcgcgcgcgtggctctggaggccacgggcatgatgcttcgggtcctggtgtggggctgtcctccctgccatgctactggctgccccagcacccatcaacaatgctggcactgttcccagataagagtgcctggtgcgaagccaagaacatcacccagatcgtgggccacaggcggctgtgaggccaagtccatccatgaacagggctgtgcctaggacatgttgcttcagcgtacatgctgtcccccaagcaccgttcccaacagtccacatgagtccctggtatcactgtgaactacctgcattgccaggcccatgtccagtgtggggagatttgtgactgctggaggtgcccgggccacgacggaggtgcccagcggtggacaacgctgggtggaggaacgatccttgcactgtaggctgccaggcctgctggcaaggcagcctaggtcacgacgg

SEQ ID NO: 610899 - DNA, 201 bp, Homo sapiens
gggcccctggtgaccccttcctccagagcagccagcccagcccgggaacaagagggatttcctttcccttgggattcccagcctttgcagagtcaaggtccccttgaaggtcactcagtaaaatcctttcaatgggttttatattgttttggcggcctttttttgtagaaataaaaattgcccttagaattttttgtcaga

SEQ ID NO: 610900 - DNA, 170 bp, Homo sapiens
ggtcaggcagaagcctgggcgacagagcggggcaccgtctccaaaaaaaaaaaaaaaaaatttttgagaacccttgaattaccaggattctagctagggacctcagcaagggggcacttagcacatattaaaggcctcattaaaccaccatgtgaccttagggaggtttc

SEQ ID NO: 610901 - DNA, 527 bp, Homo sapiens
  misc_feature (91)..(91): n is a, c, g, or t
atttaataaatatgttgggaaaactggctagccatatgcagaaaactgaaactggaccccttccttacaccttatacaaaaattaactcangatggattaaagacttaaacgtaagacttaaaaccgtgaaaaccctagaagaaaacctaggcaataccattcaggacataggcatgggcaaagacttcatgactaaaacaccaaaagcaatggcagcgaaagccaaaattgacaaatgggatctaattaaactaaagagcttctgcacagcaaaagaaactatcatcagagtgaacaggcaaactacagaatgggagaaaaattttgctatctattcatctgacaagggctaatatccagatctacagggactttaattatgagaaaaaacaccccatcaaaagtggtgagcatttgacagacactggcaaagaagacattattcgccacaacaatgaaaaaagtatatactgtcatagagaatcaattaaaccccagggatcctttatgcacattgatgggacat

SEQ ID NO: 610902 - DNA, 111 bp, Homo sapiens
tttgtctgtccccagtcctgctgttcagcagcagcgggtctcctgcctcaggccctgcgcctgaccacctggcatcgtgtcatttcccctcccccatgcgtggattgccag

SEQ ID NO: 610903 - DNA, 311 bp, Homo sapiens
  misc_feature (157)..(157): n is a, c, g, or t
  misc_feature (196)..(196): n is a, c, g, or t
tgtgactctagaggttcccccccgactagccctgacagccgctctgagtagttgtcacggtcacagccctggccacatggctggtctgcagctctatggtggcctgaatgttccagagtggttcatcacatggtctccagtgcgtgataccatgggnaacaaatgccaatgctcccatgcacctgtgtgcatattncgatcgcttttgttccatgccttgcgcagctgggtttacagtgtgggcttcaccgtgaatctccacctcagcatcatctgctgcccgcctgtcgggctagtcgggggggtaccga

SEQ ID NO: 610904 - DNA, 124 bp, Homo sapiens
tagaggatcccccagggaaacatgctatactaaagaaagcttcagtatctccttaaagaagttatggttaaactagtatctctggtattgaagaggtgaaatatgttcacaatacccaaggtaa

SEQ ID NO: 610905 - DNA, 881 bp, Homo sapiens
taaaaaaacccgtgtcctggggggggtgggggtttaatcctaattggaaataatatcatttagggggaaaggcccttgggaaaataggccttatttttttttgtcctttcgtacaaggagaggatatttggatgtaaataaaaaccggcacctggtattaatccccggtctggacactccagtatccacgtcaggattttatatctgttggaacaaacaaacctttaatagcgggcctgcaccatggggtatgtccttgatccaactatcgaggtctgtaaacccttatgggtggtggcggggtgttatgtcttctgcgactgtgttgtgtgggagatctggcgttagataagagaagatattgttctctcacaagagaaattgtgcgctcacaatattggggggccccctggccccccaaatctttacataagcgccacatgctgtgttttatgcgccactagatggtgtcgccctgtataaaaaaagatgtatcacaaccgcctgtgtgctgagatctaacacaaggcgacaacattattgtgtcggtggtccctttctttaaaacccccttctttcggaattctccactcttttgggtggtcgcccccagggggagcaattcattcgcgtgtctctcaggttagattaggagcgccaacaaacgactttttaaagaaaacctacaacgtggcccaacgtagacttgggtgcgctctcctggggggactccctacactttcttggtccactcataaccagtgggtgtcaaatacccctttaggaaaaaccggggggggacgttgggaccccattgaaaccattccttttgggttatccaaaacccccgagggcgcccacattttcgtccaggattatgg

SEQ ID NO: 610906 - DNA, 476 bp, Homo sapiens
cggcacgaggggccagttggaggtaaacgactgcatcacgtcgaagatggtggccttgtgcagcggccagctctggatgagattcaggaaggttttcttcgcctcggccggcgtcgtaccgcgcaggctctgatggtgcatggccacactgtcgcgcggtatgttcggcacgaagcgcggcggcaaacagtgcgccgctatgggccgatagtcctgcacgatgtcggaactgtcgccgagctcaagttgtccttgtagagcagttaacataatagcctccatttcggtgattggaaaacgttcggtacgcaaaccgtgtagcacctggtgatagagcaattccttttcgacgggatcgtccaggttcatgtactggtcgcagaacagatgcttcttgaacagaaacagatggtgctgccggcggcaggcgggcggtaagttggagctctgattttgctgcaccgcctgggcggccg

SEQ ID NO: 610907 - DNA, 216 bp, Homo sapiens
gttaccctgaaggttctccgagaactccagtttgccattaacttgacaatccacagctgcaaaaagcacaggttggcgattagcgttggcggagagccctggaaaacatatgggggtgttcttctcagtctcagggctatccaatgtggtgctttaattcaaacgacagacgcctggcttaaaccatcaaaggcctcataatttctgccggcctgg

SEQ ID NO: 610908 - DNA, 109 bp, Homo sapiens
aaacacaggctcttctgcacagtatcagaagcagtgtggaagatatgggagtccactttatggtggaacaggagccttcctctagttccaagtcctgttgcctgaacag

SEQ ID NO: 610909 - DNA, 337 bp, Homo sapiens
ttgtgtgcacatgtaggtggtgtcatcatggaccatcaatctaatctttctatgttcagatacccaatattactagttgactgtatcttttctgtgtttagatacacaaatacttaccactgtgttacaagggctgcagtattcagtaccgtcccctgctgtacaggtttgtagcctgggagcattaggctgtagcatacagcctcaggtgtacagtaggctataatatacaggttggtataagtgcattctatgatggttacaccaagaccaaatctcatcatgatggctttctcaaagcctattcccatcattaagccatgcatgactgttattc

SEQ ID NO: 610910 - DNA, 427 bp, Homo sapiens
ctacaggatttttaggcccattcccatccttactagaatagcttgggaaatttcaaagtaagcccaattatagttggcatggcttttccaaaggtttcaaataatcatattctttgggattttctcggttaacattataccgaatcttttatttctgcctcacaccgggcaggttttatattttaaaatgtatattctatatggtataaatatttatgagacagattaaattacctagtataaaaacaatatacttttacacagaactcggtatcccctcagtctaagcacaggctggcttttcacaagaaacgatgtcaaagatcctgaagtggttcatacttttcccacaaattaaagctctatgcatcatttatgaaagcagcgtgctgctatgatcttaaggcgctggagccgggcaacccat

SEQ ID NO: 610911 - DNA, 221 bp, Homo sapiens
acaggaccaggtgagtgtgggaggggcacagagacttccgtgccctctgtagggcacactaccctcccaagaactccttgttgtttagcaacacagaaagctgctccaatatcctggctgtgttgggatgtttaatggacggcatgtattgactcgacatcactggtccattgtgctaggtttacgctcaactactccagcttgcctttcggggcctcctg

SEQ ID NO: 610912 - DNA, 372 bp, Homo sapiens
  misc_feature (344)..(344): n is a, c, g, or t
cccaaaataatttcattgacatttaaagagcagcagtggtgccctatcaataggcaacataaaaaattacaggccgggcacagtggctcaccctgtaatccccagcactttgggaggttgaggcggacagattgtttgagcccacaaattcaagaccagccagggcaacatggtgaggtcttgtctctacggaaaatacaaaaattagccaggcatggtgacgcacacctgtagtcccagctacgtgggaggctgaggtgacagaagcacctgagcctgggaggttaagactgcagtgagccattattgcatcactgcatcccagcctgggtgacaaagtgggnccctgtctcaaaaataataaataaattt

SEQ ID NO: 610913 - DNA, 186 bp, Homo sapiens
tttgacctatgtttacatccccgaggggtttttgccccccccccccccagggcagggggtggtccaacagctttctgtggggggtttacatgtgtcccccctgccccccttgcccccgggggggtcatggtctcctcctggatgctgccccctgaatttttttttttgataacccttttcccatta

SEQ ID NO: 610914 - DNA, 319 bp, Homo sapiens
tcttcaggtgaagtcctaaagcttgcttccaccagcattctacgatagccggcttattactaaagcagatagatatctccttcagctctctgcttgtggtccacagtagtttcccgtaagtctaggtcctcattatatttcctaaagcttggggtccatgactagccagtatgatgaacatgtattctcggttgccatatagctgacatttgaaggcagtctgtcgtaatagccatgcatttaacatttgttaagtagagcaaggaaaaccatttactgcagtcctatcctagctagccgcctctgcagggtaccgagc

SEQ ID NO: 610915 - DNA, 462 bp, Homo sapiens
tcatcgagctcggcctgatttacctattacagtacctgatgcaacaatgttgctgcccacaatgtatattactatgctgagactttcatgaatgggcgggtcactgtcttccctggtaaatgtgccttcgaaactgtgaatgcccattagtaggtttctgagcataaacataagcacagatagaaaacaggtcccccaaagccggcagctgtgcatgcagctcactgccaccttcagcttccagtcagtttcaccatctagttgatcagttcgaataaaacacgaacctgcttttactgaagtcctaagaaacaccatgtccgatggaattcatatgattctttaccactatgatgaggtctccaaattgtctgtctgaactcttaacttgcactttacctcttactgtccgcttgctatatagttgtgaattcacttccttgtcacgctggtggtatcgct

SEQ ID NO: 610916 - DNA, 199 bp, Homo sapiens
  misc_feature (141)..(141): n is a, c, g, or t
cctcagccagtgggcggttctactcaaggggaggcccgggtcagagtctctgggtccagcctgtcccgtgggcaataggtgcagggtgtccccgtggctgtggagggatttcaagcctggagacggggctgtgggtcccancattctgaggtcccgttcccactgtagtgcatccagtgtgatgtgcttcctgcgccaa

SEQ ID NO: 610917 - DNA, 376 bp, Homo sapiens
ttaagtcaggcatcacgtcggtactcaggaccagccattagaataggagaccaacatgaggagatctgcgtgtgatgtgagattccatttctgaaatcactgatatcttttggtgggtttaactctgtgtctacctttatagagcacagaagttagtggtacgaatgataatctcaaatagcaatacactgtgtactgatattggaaatgcacgctgaaggatgccagggagctgaactgacagctccaaaggctggcaccaggcataccatgagcgcattggcccagccagccagccaaacgtggccacgcactgggtggccagagagtccttaccacttcagtaggccggtagtacttgagatccacagtcacg

SEQ ID NO: 610918 - DNA, 264 bp, Homo sapiens
tctacacgatccctgttgtgtctgtgctatagagtctgtgtattgctgtttcatattcggagttctggtttgtccttcccttcaaacctgttaacagtttcttttgcgggtggggggattcagaacccttgtttcccattccatatcaccttacactatttctagttttataatatcttacggtgtctatttaatgtgtttcattggtcttgtctcccccttgtcgcgatataagcagttttcatatattctggatactaggcc

SEQ ID NO: 610919 - DNA, 166 bp, Homo sapiens
taataaaattattattataaaagggaaaataggtagaattagcgtggtaagggcaataagtgtggggagaaatggggtggttttggtttgttcaaacggtcatttaatttttactttgtaaaatatgggaagtagtgtaatggaggtggattgaaacatcgggttc

SEQ ID NO: 610920 - DNA, 395 bp, Homo sapiens
aacttggagttcagggggcttccaccattcccagaactgaatcaaagtagcttactatatctaaactgtaaaacaatatagtttctactgaacacctgctttccttctaggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcagaggattcttggaagcttgcacttagtttcccctgacttcaccccatgtgtcttttttcctttgctgattttgttttgtatcctttcactgtaataaatcatggccgtgagcag

SEQ ID NO: 610921 - DNA, 215 bp, Homo sapiens
ggtatgtgtagcgtcgagaaggtcccttatcaaggcagaacaaagcagtttgcaagtggtggggaattgtggctcctttatagcaactgtatgcaaagtggcatgcaaatagagcctgttttcccatccaatacctagtggctcagaagcaacatgtgttccccatggaccccttgaggcagccccttgaccctggtcgctcattcaccaatgaa

SEQ ID NO: 610922 - DNA, 324 bp, Homo sapiens
agccctgactatagagggactgtcagcagtagttatcagcatgccaggtttctaaaaccttggattctcactgtgcatagaaatactataagtcatactgggtcattccagactgggttacaggccaataagacagttggggctggatagatgtgggactgcatcaatgggtcacagagaaggtatgccgaattaatgaaatcatctaaaataggctcagatgcactcatgatgttattccatgagtgctgcatctatatctaatgctgaaatcccaaccaagaaccccaaaataagtctgtgtatagactctattgtggtcct

SEQ ID NO: 610923 - DNA, 200 bp, Homo sapiens
tgttgctggaggatctgctgcatatgctggggagtgataacttgaggtgtcatcatagccggctgacacgggaacctgaagagctggttgtttgtcattcctcttgggagatttcaatccactaacttgctgctgctgatgctgctgaagaaggagctgtcttgccacctgaagtgcctgtagctgctgctgctgagcag

SEQ ID NO: 610924 - DNA, 346 bp, Homo sapiens
aaaaaaaaaaaaaaccccccccccccgttttatgggggggttggggaaaaacccgggggggtacgaaaaacccccaaaaaaaaaaaaaattcccccacccccccccgggggggaaggtttgttattttttccggccacccccaaaaagggggggggggggggggaaggggggcccccgaaccccccttttttcccgaaaacccaaatgtttcccccttttaaggggccccccccccatttaaaacccccccttttttttggggggttgggttttgggggggccccccccccttttttttggggggggttttggtttcccaaaaaaagggggggcccttggtttcca

SEQ ID NO: 610925 - DNA, 111 bp, Homo sapiens
aacagctgtatgctttaacagtgatggctgatcattcctccgtagaactaccggaatgaagagtaacctggtcatagagtcttctcaaatgtttgcaacttggatatgatg

SEQ ID NO: 610926 - DNA, 696 bp, Homo sapiens
ggagaagtgagaacatgcggacagtcaggagaaggcctgtgagaaggatatagtaccgttatcagggctggaatgtagggaggtgagccgaggaaagaggaaagagatgagattctctcactacattaggggtgggataattataagagtacaacgctatatgttcattgcatgaattaaagaaggctaaaaaacaaataatagaaagaatgtaaaagagatttacacacaaagtctttgttctatccaaaaacaattgtaataggacactaaggtcgaggggaagaaatgtggataggatggcacggttatatggattttacggagaaggcacatttaacgagtgttgaacagagggaaactatgaggggctttgtgcggaaaagagaattttcaaagatttggtaaacacctttcattttgggtgggccttaacgttagattgaaggggaagataacttcgcccaatgtggaagggttgtatcccgcgatattgtccatggtcttacgcgcagggtaagggcaaaatacgtgggggacgtgagaacaatctcccctctatctataagcggcaattgatatccaaggtggagacaatcggtcatattcgaacgtcctttgactagagctggcgcaaaaatttagtggagggaaataataggacggttcggggttccgggccgatcgttgttgccc

SEQ ID NO: 610927 - DNA, 721 bp, Homo sapiens
tacaccttctgagatcctagggttatggcccagggttttaccttctagattcatcccagttttcggtcttaaaatgaagtttcactctcaatgtccaggtggaatttccagtcgcacaggtcatacggttctaagtgtacgtcattgccatgcacgtaccgggtctgcttgtctcaagcacgtcttcccgtgagccatgtgctcctctcagacctggcattcagcatgatcgtcgctcaccaagttctgaatgctcttcccttttaggctctctgctaacctcctcgggcatggcacacctcacagaacccagtctctctgccactaatgaaagctttaggccatggcagcaaactagacaccgtcaagaccaagtcgaactggtatagaagtcaagcggatgtggggattggagcaaactagagtaagctcacaggtgtccacattccgtcgtgcaaaagttgcatccactcagcttcagccaattgttgctatgcgggaacatggacccaaatcttacaatttcccaagccatgctagaaatctaggttttagtgtgaaatctctttgttaaatttagtaggcttaattgtaaaacattttcaaaatactgtcagtgagctgccagttttcaatctctgcttctgaatagcctttggaagacctctgtcgccttttttttctgtattttagcttgagatgaaaattcgctgttgttgcc

SEQ ID NO: 610928 - DNA, 829 bp, Homo sapiens
acacacccggtctgccccttaggaggtcctcaccttcaggttaccacgagactaggtgagtgacgactgacggacagtcctgatgcgtattttcacgattcgctggcagctttggcgggtgcccccccaaagctgtcccgtcgtcttctcgcgagccctgcccttgccacttgcttaatgccacaattgtgagatgactcacccccgtgcccctctcatccgttatttccctgggtgacgcctcccttggcgattcccctcccggctctactcctctcttagttgagcactggagcgcagcccttactgctccagttcttgtgcaacgcctcattggcgattgagcaagagactcgccactatggtcctccttcgggatgcctctcgtgcacacgcctgggtgttcccttctactcacacacactgtctgcttccttgtcctttaccgccttagttctgcgaactgctcccggggaccttccaccaccgtcatcgccaggtgggtgccactgcgtggtcaagttctggttctcatcctccttgtagctcacattctctcctatgcgctgccacgcccgacgctacgagtagataggaagtgtaccactcttttctgcctcaaacacgttctgggtttcgcaggttacccagccaatttatcgatctctggccttcttcagctagggacagtgttcacccacatttaggaccatgaggagatgatggcttaggctgacctttttctgtaggtccggagtggaattacagtaactatataacagtgcttcgcatctccactagatgatgctgaccacagggaatgagaaca

SEQ ID NO: 610929 - DNA, 262 bp, Homo sapiens
  misc_feature (229)..(229): n is a, c, g, or t
  misc_feature (239)..(239): n is a, c, g, or t
  misc_feature (242)..(242): n is a, c, g, or t
tcttgaccttgagaatttgggttaccgaaaacaaccagggggttttgggtctggggtccccgctgctcgctgcacagaaagtcaatgactgagacaacaattattgccaaggaagaaggctttaatagggtgcttcagccaaggagatgggagatcactttcaaatctatctccctgactgtccaaaattagagatttatatagtacagaggaattgtaacaatgtttnattgaaacanggnacttaagggggggggtaagg

SEQ ID NO: 610930 - DNA, 381 bp, Homo sapiens
  misc_feature (195)..(195): n is a, c, g, or t
  misc_feature (202)..(202): n is a, c, g, or t
  misc_feature (254)..(254): n is a, c, g, or t
  misc_feature (280)..(280): n is a, c, g, or t
  misc_feature (302)..(302): n is a, c, g, or t
  misc_feature (336)..(336): n is a, c, g, or t
  misc_feature (342)..(343): n is a, c, g, or t
  misc_feature (346)..(346): n is a, c, g, or t
  misc_feature (366)..(366): n is a, c, g, or t
gaaaaagagaaatgataatccccagcagcacatccaataccagtgcggcgaagccgagggttactttatgaaataagaaatcttgccatctgttgacgacgcatgacagcaaccagccgctcatgactcaactgcgacgattcattatttttatgctcagaggctgcgtgacttacggatgatgcggtcatgtgncgagacnttgatgtgctgggtgtcatttccaccgaagaggctagtccggcaacacgtancggaccgccccctgtttgttgcagancctaccttaactaccgtactanaggctcaggtacatctttacttgagttaaaaccnaatttnncangattgccttactggtaagcnttcttgatttttgct

SEQ ID NO: 610931 - DNA, 224 bp, Homo sapiens
gacccgggttgtgggtgaccgtggcttcaactcttgggctcagcagtccccgctgcctcagcctcctgagtagctgggagtacaggtgtgcgccaccacacctagctatacacctagtatagatatgtcttgctgtgttacccaggctagtctcaaactcctgggctcaaacgatctgcctgcctcagcctcccaaaatgctgggataataggcattaggcacc

SEQ ID NO: 610932 - DNA, 107 bp, Homo sapiens
acatgaaaatgttaaaagttggggggggttgaattttaggcaattttaatttttttaacgtcttttggtttttttacaataaacatgaatcagttgtagaacctcta

SEQ ID NO: 610933 - DNA, 313 bp, Homo sapiens
taaggctttgtttgcattgtttgagttcaaggggccttattattgaatggaattgcacaagcctttctttgtgcaatcaaaccacagtttcctttacagaactaccaataacaatggtttgattgcacaaagaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgat

SEQ ID NO: 610934 - DNA, 138 bp, Homo sapiens
cacagatgtagtttctctgcgcgtgtgcgtttcctcctcccgcctcaggtcacggcacatggcgtataggggcagcagtgctgcggagcattggcttgcagcggggagagaccaggctctgagcggcaccccagcggt

SEQ ID NO: 610935 - DNA, 183 bp, Homo sapiens
ataagggtggggtggtcatattcctgcctattagggtctcttgcatcagggtagagagaagctcagtcccagagtggtggtatggtgaaggtcattaccaactccaagttccgacaagaggtgatagttctggcaacagcaaaagcataggcaggctttcacaaacaggttctgagtcttctg

SEQ ID NO: 610936 - DNA, 159 bp, Homo sapiens
  misc_feature (1)..(1): n is a, c, g, or t
  misc_feature (17)..(17): n is a, c, g, or t
  misc_feature (40)..(40): n is a, c, g, or t
ntttttactttttttcnacggagcgcgccatgtgttggtnacgggggattcggccattatgggcggggaagattttgatctgggtaggctggtggtagggttctttgtttttggggtttggcagagatgtgtttaggtgctgtgcccaggcgggggggg

SEQ ID NO: 610937 - DNA, 266 bp, Homo sapiens
cccgcaggcttggccccagatagattctgactcaaaagccctcgcgatgtcaaggggtgggtttcgtatgttcaccactgtcatttattttacgtcgtcagatatggggagtagtgtgattgcggtggagtacattaggcgtacgtagaagtcacaggttaaggagggtgatggttgtgctatgatggttgggattatcaggctatagtcttttgagaattctccgataatgacatcttaatcttggtggcccaagcctgctgggc

SEQ ID NO: 610938 - DNA, 275 bp, Homo sapiens
  misc_feature (113)..(113): n is a, c, g, or t
  misc_feature (155)..(155): n is a, c, g, or t
  misc_feature (167)..(167): n is a, c, g, or t
  misc_feature (170)..(170): n is a, c, g, or t
  misc_feature (199)..(199): n is a, c, g, or t
  misc_feature (236)..(236): n is a, c, g, or t
  misc_feature (242)..(242): n is a, c, g, or t
ttttcatctagtactttcttaatgcctttattggagtccgcatcctctatctttaaaaaaaaaaaaaaaaaaacagctttagcctaaagccactttcaactttttttaagttncacaaaaagggtttaatagccacaatgtgatttttgccacanctgtgtgatttnaanattctctaatatcaagggcggatttaganttgcaggaaatacctggggaaatcacagtggatgaantttttnctttaggcgaatgaagagttggctgtctctgta

SEQ ID NO: 610939 - DNA, 135 bp, Homo sapiens
gtggaggcctgctgggaacgggactcttaaaaggaactatgtctggagggctgtggtccaaggccatttttgttggcattaagcggggtttccggaaccaaagggaggcacacagattttcttaaaattgaaggg

SEQ ID NO: 610940 - DNA, 749 bp, Homo sapiens
tatttctgcatgtacacgtacttgctttctttccctgctgtaacacattaccgcaatcttaacggcttacaacacctatttattctctcacagttcctcaggtcagaaggccgggcagttttgcctgactggtcttctgcttagggtggtgggagcctgaaatcaaggtgacagcaggcccacgcccctttctggaggctctcggactgaatctcctcccagactcttccaggctgtggtctgaatgctgttcgtaaggtcagattcccatcttcatgccggctctcagtcaggggccagtcttggctccccgaggcggcccaggttcctgctcatgcccttcacgcacccctccaccagccgccggccaggtccctctcgtgctctgatgcgctctgactctcctttctgctgaatctctgactgcagctggcagaacagttctcgctttgcaaatgctcacacgattcgattaggcccgcaccggatgatccaggataatctgccgcaggtctactcctggacactcataaggccatctgcaaagtccctttagccatgcaacgtaacatagccaccagtcggctctggaagatacgcagcatggacatccgcgagaggcccatgaatcctgccaaaccaccccacatgcacacatctctcttgttccctcgcaacccgactgttcataaccaaccaacatccaataacagcgatctagagcatacaccaccccacacacacgccag

SEQ ID NO: 610941 - DNA, 512 bp, Homo sapiens
  misc_feature (39)..(39): n is a, c, g, or t
  misc_feature (95)..(97): n is a, c, g, or t
  misc_feature (99)..(99): n is a, c, g, or t
  misc_feature (101)..(101): n is a, c, g, or t
  misc_feature (111)..(111): n is a, c, g, or t
  misc_feature (146)..(146): n is a, c, g, or t
  misc_feature (213)..(213): n is a, c, g, or t
  misc_feature (228)..(228): n is a, c, g, or t
  misc_feature (230)..(230): n is a, c, g, or t
  misc_feature (304)..(304): n is a, c, g, or t
  misc_feature (311)..(312): n is a, c, g, or t
  misc_feature (318)..(318): n is a, c, g, or t
  misc_feature (325)..(325): n is a, c, g, or t
  misc_feature (327)..(327): n is a, c, g, or t
  misc_feature (330)..(330): n is a, c, g, or t
  misc_feature (332)..(332): n is a, c, g, or t
  misc_feature (337)..(337): n is a, c, g, or t
  misc_feature (398)..(398): n is a, c, g, or t
  misc_feature (414)..(417): n is a, c, g, or t
  misc_feature (444)..(444): n is a, c, g, or t
  misc_feature (448)..(448): n is a, c, g, or t
  misc_feature (467)..(467): n is a, c, g, or t
gctggcctcagatcatgtgcaggggtgaccatgccagangtccccaggcctccattggttcagctgggcctgctccagaggaagaagttgcaccnnntngnggggtcagtnggaggaccccggggcctggcacacatgtagaagcngcggcccaagttgggtcctggcttcttcacagtacgcatcacacatggctccctgtagcccccacanaggggtgtgcgcaangnccccgccagcacagacttccagaatgaggtccgtaactccttctcatctttggcttctgaagtcttggcctgcnccttttnnactttngccactncnttntnttctngagtcttcggggtcatgagggcgctcatcagtggtaggctaggcagctctatgttaggtgnggcttggggacagctnnnnttgggctgaaagtagctcttcaggttnttcnggcctctgctagagccaanctgactgggctgaggcctgggttgagcgcacttgggctttgtttt

SEQ ID NO: 610942 - DNA, 446 bp, Homo sapiens
ctgtcattttgctgccaatggcaggatttcattcttttttttttttatggctgtgtttgttaataatgagtgtcaacttgattggattgaaggatgcaacgtactcatgctaggtgtatctgtgatggtgttgccaaaggacataaacatttgagtcaataagctggggaaggcccacccatacttaatctggtgcgcacgatctaatcagttgccagcccatataaagcaggcagaaagacgtgaaaaggggagagtggcttagcttctccacctacatctctctcccatgcctgatgcttcctgccctcttaacattggattccaagttcttctgttttgacccctggactagctgcccttcctcctcatgcttgcaaacagtgtattttgggactttgtgattgtgtaagttaatacttaataaacttctatgtgtgtgaaaa

SEQ ID NO: 610943 - DNA, 932 bp, Homo sapiens
ttgcagtgagccgagatcgtgccactgaactccaacctgccaatagagcgagactccgtctcaaaaaaaaaaaaaaaaaagaaagaaataccttggaagaaaataccggacatcagaggaaagcttattttcggcatggtgtctttccaaagatggaatatttgaagcatgtttctctaccgatggtgtgactgagggtgagctggatgaggcatcgctcacgctggggggtggtgtgtacagaagcacgtggagccacaagaggcacctcctatagtcagataagggcttccctttctgcgcccagctttggggtgaagggtgattcctactagacacatctgtgcttcagcataccatgtaatagaggaagcagttttcctgctgcagattcctgaatagacgttgctgaacagagtctacttcgggactcaggggaagtttgacggccagtctgtgtagaacaggctgaggcaaccggggaaagacctgacaggtagttacatacgctctgacttagtactcccatgagggcttccagtgacacagtgtgctgatagaattctaaacctctggaattccctggtggcgacttcatatggccgtgacttgtccaggttaccctgatgcagatgctatgaggcgttagtgagaacttagagctttgcgcctggcggacacgtgtagggaccagattcaggggcctttgcagcgccatttttgaaaaacccctgttagcaaggtgggattgggcggtgcttgctttgccaaagaattcctgagaaacgatttcggggtacattagccggataatccaggtaaaggggaccaaaccgtgatctgcacgacagtcactaaggtcatggtaaggtggcccgcggctaagtgcacagaattgagaccgaccaataaactaggccacctctgacaca

SEQ ID NO: 610944 - DNA, 203 bp, Homo sapiens
atatcctcaacagatgcaaatcccttattttattctagctagagatgtgactggttaataaatagcacatctatttcataaacatccattactactatacttggatggcaaaccatctcaaatattgtttccatcccagcctgaaaccccattcctcgtacgtttccgtctatctgtttttttaacttacagttataaatggt

SEQ ID NO: 610945 - DNA, 766 bp, Homo sapiens
ccagcctgtgctgatggagcatgtctccgtctctaaataaataaataaaataaagtgtggccgggagagcacaagcatttccaagccgctgcctgaccttctccgtctctgttgaagacaggggccatcttgaaagaaaaactctctgaggagtgtgtggtcactggggagcggggtgttgtgacggaagctactaagactaccaatgggccttgaccaaacatgtatacacggggtcttcttcttagaaagtgtccccttcctcctgggtgcagttggttcacataggaagtcaactagtggaaaaaagccgtaagtgtataggaacctgaatctttcctgatggaacagggtaggatttgtaggaagggaccggcggtaggagcgcaggcagatacatgcatgaaaagataacaccccagtaaagagtgtggtccctctggtggatgcttgaggttaacgaagaacaacacagagtgggaggacttttgcctagaaaagggcagtttggggctatatcctagggagaatacggcatccccattgaggaatctttacttaaaaggagcgtattaattggtctaacagtctttgatttcaacggccaacccctggagtaaggacacacttgcaaacatcggctttataaaacatttattccgcacttccttgtgacccggtaatccgccctccttttgtattatacaaccagcgtttttagcattgtttcaacacttgccgtttatcaaccagacggccacaagtg

SEQ ID NO: 610946 - DNA, 484 bp, Homo sapiens
acctgcctgcccaccagctagttttttgtattggtataactagtggagacggggctttcgtcatatcaggctaagtgatggaagaagaccccatctcaaaaaaaaaaaaaaaaagtaaataatggccttttaatatgcggaaagtaatttccagtggtagtaccaaaattggtgtgcccttggtcctatgcttaatattggtaaacttggcagttgactgtattttggcccattacaccacttcattctaaaaaattatttattggctaatagagactattcccacatttaccctttgaaatgtgtgggatgtggatattccgaaagtttagccccgcgcaaacaaaaaattacaacaattaagaatttctctcgtcccaccttgaaaggcaggttatagatttttttcctggcctggaaaatggggaggtttacaaattctttttggaggctgaggggtggtggcccacgctgtgatatccta

SEQ ID NO: 610947 - DNA, 343 bp, Homo sapiens
aggctccagctacgatataaggaggtcagcacggtgctcacgtgtcgacgtgaactagtacagggaggcatgcaccgcagtggtagaatacacgtcgaccaggctccagctaaacgatatattggaggtcagcacggtactcacgtagtcgacggaactatgtccagggaggcatagcaccgcagtggtgaataccacgtacgagctgcaggcatgcatagcaatagctcgggtaactggaggatcctactaaagtcgaccaggatccagctaaaacgatatatggaggtcagccacggtgctcaacgtgtcgacggaactatgtacagggcaggcatagcac

SEQ ID NO: 610948 - DNA, 187 bp, Homo sapiens
tacctgggccatattcgggcatcttccttcaatccaggcctgctactgctcgccgttcgcggtgcgtttaccccgaccgctcctctgtctgtcccttgcccagttgtgcacgattctaccggcttagtgcctgcgggttcgttcaggactcttgtcggggttcagattgttccatgttatgattaag

SEQ ID NO: 610949 - DNA, 276 bp, Homo sapiens
tcggagacgagactgtgtgtagctcctttcagaaacttctggtgctcttccagtgcttggggccaggacggtaccttcactgctctggagacagcatagcttgatatctggttatccttgcatgcatgcaacaatgcatgcaaatgtcatctatcatatctgatctttggtttgaagacatggctgtcgattactaggagagctgacttcccccaggtagcatggtgatcctgaggccagagcgaccctgatcctgaccatccagtgggacatggg

SEQ ID NO: 610950 - DNA, 1780 bp, Homo sapiens
  misc_feature (499)..(499): n is a, c, g, or t
  misc_feature (638)..(638): n is a, c, g, or t
  misc_feature (1328)..(1328): n is a, c, g, or t
acgcagttggcactgtgtacgaatagtagtatatcagcttatcggtctactagccgcccatcactggtgtcgtcagaagagaatgaataatgatcggtccggtgccatccaatagctgtatctcatcgaataaacccttgcgaaggaaccgagatcctcatcatttagacgcgagagttaatggttggccatatacgacgactagagatgagtgtgcgtcaggtcactgttgaagagcgcgcagatgcctaccgagttgcgcgacacgtcagctcgcctgaatttagtgttcgtttcaattgcctcccctatacgatatagtgcatgatactctcagacaactacaacagttactaatacagcacatacagtagcactaattttccccaaagtcgccttgacacaaaagggtaagattgcatggtgcacatcaagacctctattgtgagtcaatataatcatttagcgctacccttgggtactccagtagtgagcttgntgtgacacgaaaccaaacataccatcgagtaaacaggtttgtgcgaaagacttccaccaacgatctacagcgtacaaaacacggccaattcgaacgttggcaattagaaccagtaatatctgaaagctcccatactctnatttgcggcgccaactgcctttaggactttagctcactttggcagtctcgccatgccgcaacaccacggctgcgcaaaaggtgacaaactgaccaactcacccattggaaattggtggtccatgaacactagggcgtgtaagcgcccgtcaccaacgggcttccgctttattggccgcccctttacccctgcgaatacggccaacgacttcctcttacgcactaacggaaacgaccaaccgcccccccccacctataccacctataaccgcttttaggaccatacccatgaacaaggataaacgcgggtctcgcgcaatcgtgtcaccgtttaccatcccgagtgcattgtttcagaactttataaatccaatttgagtgtggcgaaaaagaccgccccttataagctgggggcgcatcacggcacatttcggccatgcgcacccccagcggtaaggatacacattcacgccgggcccacggtaaaacccagctgaccagacgaaaaaggccgacaacgggagaaggccaggcgctcacaaaacgcaaataccgtaacccgactataatatccacacgctggcgaccaccactggcgcaacacggccgccggctaataccaacgcgcatcactctaccggtgcaaccggccgctaacacaggtaggccatctaaaagccgcaccccgtgncatgccaaatccacgcgcaccggtcgaacgccgggaggcaactcaaacccctgactgccatagcccatcactcaacaactgcgcaccgaaacgcatagtccttcccaatacacccattaatcacaggcacacgaccaccgcgataaccggaacacactgcgaaacaaccgcactcagccacaacccacccagcacagacgcacacggcgcaccaccccacgccgccaagctccccctcggaccccctggcgccaccgcgcgcccaccagcccaccaaacacactccacacacaacgaccccacgtaccccactgtgccacgcgccagcccccacgcgcggccacgccacacagccacctcacacgtcgcacaccgtcctcatgacggcacacccgcaccccacaaccaaccaccacacgcggaaccacagcacaccccctattccacacacc

SEQ ID NO: 610951 - DNA, 849 bp, Homo sapiens
  misc_feature (120)..(121): n is a, c, g, or t
  misc_feature (125)..(126): n is a, c, g, or t
  misc_feature (147)..(147): n is a, c, g, or t
  misc_feature (159)..(159): n is a, c, g, or t
  misc_feature (180)..(180): n is a, c, g, or t
  misc_feature (195)..(195): n is a, c, g, or t
  misc_feature (206)..(206): n is a, c, g, or t
  misc_feature (268)..(268): n is a, c, g, or t
  misc_feature (291)..(291): n is a, c, g, or t
  misc_feature (301)..(301): n is a, c, g, or t
  misc_feature (321)..(321): n is a, c, g, or t
  misc_feature (327)..(328): n is a, c, g, or t
  misc_feature (346)..(346): n is a, c, g, or t
  misc_feature (348)..(348): n is a, c, g, or t
  misc_feature (369)..(369): n is a, c, g, or t
  misc_feature (371)..(371): n is a, c, g, or t
  misc_feature (410)..(410): n is a, c, g, or t
  misc_feature (551)..(551): n is a, c, g, or t
ggagtgtggcggcggctggcatggtgccccgatgttgccccctgcctggcatgcctttctcaaggaccaccgcatctctacattcaagaactgtgccttcttggagtggctgcgcctgcnncccnngagcggatggctgaggctggnttcatccactgncccactgagaacgagccaganttggcccagtgtttnttctgcttcanggagctggaaggctgggagccagatgacgaccccatagaggaacataaaaagcattcgtccngtttgcgctttcctttctgtcangaagcagttntgaagaattaacccttggtngaattnnttgaaactggacagaganangagccaagaacaaaattgcananggaaaccaacaataagaagaaagaatttgaggaaactgngaagaaagtgcgccgtgccatcgagcagctggctgccatggattgaggcctctggccggagctgcctggtcccagagtggctgcaccacttccagggtttattccctggtgccaccagccttcctgtgggccccttagcantgtcttaggaaaggagatcaacattttcaaattagatgtttcaactgtgctcttgtttagtcttgaaagtggcaccagaggtgcttctgcctgtgcagcgggtgctgctggtaacagtggctgcttcatctctctctctctcttttttgggggctcatattttgctgtatagattcccgggcttaccaggtgagaatgtgagggaggaagaaggcagtgtccgttatgctagagctgacaagattagaaacgcgatgacaaaaacactacagacactaatgtgtactggaacaacaat

SEQ ID NO: 610952 - DNA, 346 bp, Homo sapiens
ttcaagcgattctcctgcctcagcttcccaggtagctgggattacagatgcccgccactacacccgggtggcggaggttgcagggagctgagatcgtgtcattacacaccagcctgcacaacaacagcgaaactccgtcaaaaaaaaaagaagggggggggcgaggagggcaggtgcagtggctcacacctgtaatcccagcactttggaaggccaaagcaagagaattgcttgagaccaggaattcgagaccagccttggcaacagtagagagaccctatctctacaaaatgtaaaacacagctggtttgtaaaaattgctgggcgtggtgtggtgcacctgtgg

SEQ ID NO: 610953 - DNA, 249 bp, Homo sapiens
agcaaacacccccttgttctaccctcagctaccaccaactttcctgcacctcctacccgggccagggttgtccagggcagacagtggcatactgggggagggctccaccagtctggggctggagggttttgagggaggtgtcaggatcagaatcgtttacggattataggagtgatggggagtacatgaggtgaagggagactaacatgggcacagcaccgcgtcaggatcctatcttctagattcctc

SEQ ID NO: 610954 - DNA, 105 bp, Homo sapiens
ttcccccccccagccccccccctgctccttccctaatgcttttaggtttttttggttggaaactgcagctggccccaaaaaaaaaataaaaaaccacccttttta

SEQ ID NO: 610955 - DNA, 212 bp, Homo sapiens
ccatcccctactgtgctcagctattgaaatgccagagtccctatcactcagttccataaactttacctcaccctctttatcccgctaagtaaaaagtaactatgtcaaatttagaacattctgatcaaaatgggtctgcacatgcctttcaaacacctgctggtcatagctatgacctgactgctcgctgcacatcgggcacaccttccagt

SEQ ID NO: 610956 - DNA, 565 bp, Homo sapiens
  misc_feature (169)..(169): n is a, c, g, or t
  misc_feature (171)..(174): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (186)..(187): n is a, c, g, or t
  misc_feature (208)..(208): n is a, c, g, or t
  misc_feature (222)..(222): n is a, c, g, or t
  misc_feature (256)..(256): n is a, c, g, or t
  misc_feature (286)..(286): n is a, c, g, or t
  misc_feature (306)..(306): n is a, c, g, or t
  misc_feature (308)..(308): n is a, c, g, or t
ggtgcagaggcaaattgcatttagtgttcttcagcatgtcctcggggctggggccacaggtcaaggaggggcagcaacaccaccagccatctggcaccaggcggtggccaaggcaactcagcagccatttgatgtttctgcatttaaggccagttactcagattctggncnnnnggggantnanannatctcccaggccacagctgcnggagatgttatcanggctgcctataatcaagtaaaaacaatagctcanggaaacctttccaacacagatgtccaagcngccaagaacaagctgaaacngnatacctaaggtcaggggagtcttctgagtgtttccgggaagaagtcgggtcccaggctctagtggcgggttcttacatgccaccatccacagtccttcagcagatggattcagtggctaatggtgatatcataaatgcggcaaagaagtttggttcgggccagaagtcaatggcagcaagtggcaattggggacatacaccttgggtggatgagtggtaatactgatgcacacattacaggagagagcggaacgttc

SEQ ID NO: 610957 - DNA, 476 bp, Homo sapiens
cgaccacagaccggcaagacagagaagaccgacggagagagaaaacacacacatacgcgatgagcgaggaatagaggcaagcaagaaatagacaaacgcagagacacttagaaaacacaaggggaccgagaaaacagagaagggacaatacaagagcgatgaagagacaagaagaagacgccacgaaaaacacaaagagacaaaaggaggacagaacacagagcacacgaaaaaactcaaagacgagacacagagagaggggcaagcaaagcagagcaagaggagagggacgaagcaagaacaggaagacacaggaaaacaagagcccaagcaggaaaagaaggggacagagagagaagacaggaagaaaggagcacaaagaagcacaagaaggagaggagaaagaaaaaggagagacaaggacgcgataagaagccaaagcggggacgaaccggcagaaaggggaaccaagaagc

SEQ ID NO: 610958 - DNA, 360 bp, Homo sapiens
cgcaaggactctgtgggctttgactaccttgaagccttgccttcattttcctcctctcctgcctgtgaaagcgatacgagcccttctttgggagagctgcggcatcacatcgcttgggcccattacccactggcagtgccagctactcttgacacagtattacttcagactgatcttctgtcccaggcacatcatctgaggctcgagatctacagctttgagtcatgagaatgattctctccaccttgtgctcatatagaggctcggagctatttctaagattgggccccttctgggtaacgatctcacttggtctgtgcacagtgactgctccttaaaggaacaggtctcggattcatt

SEQ ID NO: 610959 - DNA, 446 bp, Homo sapiens
aaccactgagtcacgacagggcggcaactgacctgcgctcgaagacagcgggcagggtttgatgtggagcaagagctggcgcgccccatggacatcgaccgtctgtctggtcggggcctgagcctggtgcgtcagctgagcagcgctgtaggctggtccgatggcgggcgcactgtctgcgtggagttttgtcgggcggctctggcataatccgccgattcttgatcaaggagcgagcaagtggctgagattcatatggaccccgaggtgttgtcgggtttgcaggaagtcatggaaagcgaataccccacgctgctggacacctttctgcatgactctgaagagcgcgtgcaagcgctgcgcaaggcgcgggacgacgccaagacgctggggcgcatcgcacacagcttcaagggcagcagtggcaacttgactcaggtggtgtg

SEQ ID NO: 610960 - DNA, 190 bp, Homo sapiens
tcactacctgttctaatggggtctttcacaggtatctttgtacatttacccctgcagttgtgctttgcacgacctgtgcggctgtactttgtgagcctgggaggcgctttaccatgtttgctggatggttatgtcttagactcttgctagatcttacagtcttagaggatggggaaaatatatcgattgt

SEQ ID NO: 610961 - DNA, 559 bp, Homo sapiens
  misc_feature (559)..(559): n is a, c, g, or t
ttaaaatgtctactattacattgagtaaagtgtctggccacttttgaccttttttttcaaatgacattattgatatgaaatcagaaactataactgataaactacaaactgctgtatagacacttttctacacaatggtcatgcttttattctttatctaagcctgaattgtaaggcttccttctcttttttttttatttttttttttgggagaagtggggattcccgccctgggtgtcccccccgggcgtggggtgtgggggggcacgaactgtgggcttccccccaggactaacaacctccgcgggttcaccatccaccatattcatcagtgctcctacagcccccgcagagatagcgtgtgggaactacggagggagccccaccaacaccagggcccgcggctcataatcttatcatatttctaacgtaaaaacaagcggtatttttcacccacagtgttatagccacaggaaggtggttctgtgaatcacccagtgagccgtggtggtaatcaccccgtgctattgagacacccaaaaagtggctggaaattaan

SEQ ID NO: 610962 - DNA, 692 bp, Homo sapiens
  misc_feature (508)..(508): n is a, c, g, or t
  misc_feature (523)..(523): n is a, c, g, or t
  misc_feature (538)..(538): n is a, c, g, or t
  misc_feature (596)..(596): n is a, c, g, or t
  misc_feature (604)..(604): n is a, c, g, or t
  misc_feature (633)..(633): n is a, c, g, or t
  misc_feature (692)..(692): n is a, c, g, or t
ctcagcctcccgagtagctgggattacaggtgcccgccgtcacacccggctaatttttttgtatttttagtagagatggggggtttcaccatgtaggtcagaatggtctcgaactcctgacctcaggtaatccgcccgccttgacctcccaaagtgctgggattacaggtgtgagctactgtgcccagccttccttgcctcttaagtctatacacagtaaacaatagtttttttcccaatctttctgacctttgccaatctgatgggtgaaagctgtatctcattagagtttatttgctcttcctgtactacgaaagaggtggagtctctcttttatattcagggggtctttgtatttcacattccgggaactgacccttcatatcattcacccatttttctattgtattattggcttttacttatcaatatttaggatttctttaaatattaagggaagacatttttgtgatatgaattgcaaattcttcccacccataatatttgncttttgattttggtnttctgccccatatanatatttgtaattttttctttttgtagctgaatttactttttgttttctggcttctgangtctatgntatacttagaaaggctgcttctttatctngagtgattaatattctaattaattcattccatcggtttactaagccctgactcttgccn

SEQ ID NO: 610963 - DNA, 138 bp, Homo sapiens
tgcccttctctcgcgtacgatgccctgaacttccacgccagtgttccagcccttccttgcgatgatacacgaggctcagtaggccagggacatccagttccatagaccggccttccagcaccggccccctaaactcgg

SEQ ID NO: 610964 - DNA, 217 bp, Homo sapiens
cattgtgatttttcaagctataaaataaagcatgatgttaaaagatgattaatgttttcatttggtggtagatgacaagtttcttgcagggcatctgatcaatcatgctctttttttttttttttttttttggaaacttttattttaagttcaggggtatagttgcaggatccatgttcttttcttaacctgttttgagtcctttatgtaaacggga

SEQ ID NO: 610965 - DNA, 705 bp, Homo sapiens
  misc_feature (464)..(464): n is a, c, g, or t
  misc_feature (466)..(466): n is a, c, g, or t
  misc_feature (468)..(468): n is a, c, g, or t
  misc_feature (481)..(481): n is a, c, g, or t
actactattaaattcgcggccgcgtcaacaaacgtttccttttcaccaaaggcatcaaagcgctccaaatgtccacttccagattcttccaaaagagtgtttgaaacgtgctcaaagtaagggaatgttcaactctgtgacttgaatgcagatatcaccaagtagtttctaatagtgcttctgtctagattttagatgatgatattcccgtttccaacgaaatcgttagagctatccaaatatccacttacagtttctacaaaaagagtgtttccaaactgctgcatcaaaagaaaagttcaactctgttagttgaggacacacatcacaaagaagtttgtgagaatgcttctgtctacattttgtatgaccatattcccttttccagcgatatcattaaagcaatctaaatatcaatttgcagaatccacaaaaatagagtttcaaagctgctctgtaaaaananangttccactctgtnagctgagtacacacatcacaaacttgtttctgagaatccttctgtctcgtttttatgggaagatatttcctttttcaccgtaggcatcaaagcgctccaaatgtccacatccagatactacagaaagagtgtttcaaacctgctctatgaaagggaatcttcaactctatgagttgaatgcagacatcagaaagaaatttctgagaatgctgctgtctaccgtc

SEQ ID NO: 610966 - DNA, 412 bp, Homo sapiens
atgtgaccctatttgaggccgccttggcttttgggtcaccctgtttcaacccatcaccccaaacataccctagtccttcagcctggggttttggtttttgagcccgagctcctgcccctgttgtgggaaaggtggggaaaaaggtgatttccctcccgggcccacccagttgcccagcctttgcccactcggggagcagatcatgcatgccaatccctgttgccgcatggagctcctcagcccactgacctttccgtgcttggtgcaggccaggcccccgttttccgcctgcctttgtttccccgtcatgcatggtggtggtgtttttacggtgtttggttttgtgcccgtttttgagacagtttttgtgtggaatttgccttaaactgaagtaaatttggtttttttagta

SEQ ID NO: 610967 - DNA, 559 bp, Homo sapiens
gtttgacaacatcgagcagcgcacgcaagtaccgaataaaatatttcatctccagtaataggaatgagacacttttcaatagtctctaatctgtataatagagcgttagaaattttcggagctacaccatgaatccaacagattgcgttatgcgcacaatatctcaaaaccacctccataccctttatatacgggcatccctcactgaggttgcgccaaagcttcaggcgtcaattgacgaacttcttccatggatcaggcaccatactttggggtgaagacaatccaatacccatatcttgaagacgggcaagtagggtgaacagtaaatcgctgcgggtagcggacaccgaacgcgggctattaacgtagccactgactccgataacaagaccctctttggccagatccttgaacgtgacggaaggcgctggggtgtcaagaatcacctcgtgctcggtaaaggtttgcatgaacagctcgcgaactttcaatacattggtgtctagcggtaatgtcagggtgataccgactacaccgtcgacgcggccgcgaattt

SEQ ID NO: 610968 - DNA, 599 bp, Homo sapiens
atcccagcacttgggaggccgaggtgggtggatcacaaggtcaggagttcaagaccagcctggcccaaatggtgaaaccctgtctctactaaatatacaaaaattagctgggtgtggtggcgggcacctgtgatcccagctactcaggaggctgaggcaggagaatcgcttgaacctgggaggtggaggttgtggtgagccaatatcgtgccactgcactccagcctgggtgacagagtgagactccgtctcaaaaaaaaaaaaaggcttaataattttttacttcccaaatatttaaaatttggagtggccttggcagtggggagggttcctaaaatggccggtatagaatctagggccacagaactggtggtgtaagggtcctgaatcgggctaaaatacagggggatggtctgtactggggacatccatgaggcataagtagccagtatcctatagtgagaatcttacaaggctccttttggccctgtagactagaatatactgtgatgcgcgcttggagtgtatccccaaggccatagaggggctgttcaagcccatcagacctggggtggaccctcatgcgtccatcctgcggg

SEQ ID NO: 610969 - DNA, 567 bp, Homo sapiens
atctcaacacttgggaggctgaggcaggaggattacttgagaccaggatggagaccagcctgggtaacataaagactcctgtatctactaaaaaaaaaaaaacttacgctgaagtcaaaccacggcatcagaatatgggcattttggagaactcagtatacacagggcaaaaccggatccgctgaaagagctgccaccaaattactttggtttgtagctagaatggaagttgggcaagtagaagataagaaagggcctaatctcagacaagggcttatttacaaatgttggtccaaaaaaaagggagtctggcaagtgaggaactatccacaattggggagacgcagggacggcgctggggccaggatgtgatgacccaggagtctacagcccgaggaggactgggagagctcaagtgttctggagcaatgggaaaggcagctgttacatggcattttagaaagatcttggggccgggagttgtgggtcatcgcttggtaataccacaagaatcctgggagggctcaaagtggggcaaaacaccttggagggtcacagaattccgaa

SEQ ID NO: 610970 - DNA, 370 bp, Homo sapiens
  misc_feature (48)..(48): n is a, c, g, or t
  misc_feature (54)..(54): n is a, c, g, or t
  misc_feature (95)..(95): n is a, c, g, or t
  misc_feature (129)..(129): n is a, c, g, or t
  misc_feature (154)..(154): n is a, c, g, or t
  misc_feature (197)..(197): n is a, c, g, or t
  misc_feature (213)..(213): n is a, c, g, or t
  misc_feature (256)..(256): n is a, c, g, or t
  misc_feature (271)..(271): n is a, c, g, or t
  misc_feature (313)..(313): n is a, c, g, or t
atccagggatgaagaatcgcctgggtgccatcgagaaggccctacganaaaatnccttttcactgaggcccagcccggatccctccttcttcaanacacccaaaaagatgacagactacgcccaagaancgagggtgggtccctgggccccaanaactactacagttttgccagccagcagcagaagccggaagacnccaccattccctccanagaactggccaaacaggtcatcgagtatgcccggcagctgganatgatcgtcctgaancccccgggcactgggtggggcagggcacgagttatttaaaanagttacactgtcagggtttcgcccaataaaggtggactgacattccctcaaaaaaaa

SEQ ID NO: 610971 - DNA, 985 bp, Homo sapiens
tgggtatcgcgaaccaagcgtacgcagatcaagatggtggcctgccgggtgaaaggcatcctcagccgcttttctgccttcaggatcctccgactcccgaggttatatatgccgcaattttacagggtcttctgcttgctgaccagaacccatattaactatggagtcaaaggggatgtggcagttagttcgaattaactctcccaattcaaaggtaattttatctgagtaaagagctacattcagagttctcagaagttatgacatgcacctctgggctagtgatcaaatcagaagtgccgtcctcatctcatcaaagccaggctgctttattgcaggtgctgatctcaacatgttcagccgctatgcaaagacccttcaagaagtacccacagctatcacaagaagcaccgacgaatagctgacacacttgacgaacgtaccacaaacgccctcatgtggcttgccactcaactggatcctgcctgcgaggaggccttgaggttgccattacagatacaactacagaatagcaacaaccagaccgaaaaaacactcttacgtaaaccctgcacgctcctagcacgacgggccttaaccaggagacacgcagggcaccacaaaggcatgccacaaagagcgagccagtgcatgcagagcatagcgacaatgaaggctagaacaggatacgaaccgaatgcggctggcccgagccgcggcgcaaacgaagaacacgcggcacctggaatcgaaccaccgctggtgaacaccacctggcgaccccaggacctaatacccctcccggaggaaacgggcacacaacacactagccgcgcacgcagcataggcaagaaaatacacgcaaaggcacaagctgcgcaggcagaccaacaccaacaacaccaggaatagcaccgcccacaacgcagcccgcgcgcgacccgcccgcgagcgaacaagacaaaacaaggcgaaacgagccaga

SEQ ID NO: 610972 - DNA, 196 bp, Homo sapiens
cacgaggcctcgtgccgccactgagggtggatgctccagtgtggtcttgcgggacttgacagggacgccatctcccaggtccatgttgctgtcggtggtcagcgctttgatggcggccactatggccgaactggtgtactgggtggtgttgcccaaccacgaatcttcggtcacgctgacccgcggggagccgttc

SEQ ID NO: 610973 - DNA, 511 bp, Homo sapiens
ggaggccttggcccccatttaagagaacaaaattcttcgttaggggttcatttgggaaacaaaactttttgcccagtgggggggggggctgggaaaccccctgcctaaaaaaatagggcctgggcttgttggcagtgctcaagtagacctctcacgacgtttttaccaaggggctcttaaatttcttaaagcggcgggggggggccagggtccaaaaaactcgtgctcatttgcggccccctctgtgaccccccttttttttctcgtcccccccccccggggccggaactgaatttttttggaaaccccccagggcaccccttggttgtgggtttggaccacgagcccttagaaggggaggtggtttcccccagcctaacccccagcccccccaggtttaggccccccctgtgttagaattggccgaagtgtttttgtgcagctgacttttttgacccatgttcacgtttttcacaccccatgtagaaaaaaaaagatgccccggggggga

SEQ ID NO: 610974 - DNA, 228 bp, Homo sapiens
tgcggcatagggtctgtatcgggggcggctcagccgctctcctccgtcctggcggaggtctgcgcgccccagcactacggggcggctgtctgtctcatcctcccgcttctcctctgggggagcctatgagttggggggcggctatggcggtggcttcagcagcagcagcagcagctttggtagtggctttgcgggaggatatggtggtggccttggttgctggcttgg

SEQ ID NO: 610975 - DNA, 805 bp, Homo sapiens
taaggctaggtacgaggctgggggtgaatccatttccggcgtgatgatgcccgtgtggggcgtagtgcagttgggtgacacggtgtcctgctttggcgcgttaggtgttagtacgccggtaataacgcagttcgtcgaggccatcatctgccagccgcgcttttgtgtagatcggaactgcgcacggtaagttcttcggtatcgccgcgcgcatcgatccacggcctggcgtagtttttgccagcccgttgtctgcacgttatctggcaatctgcggatcaccatacgggccggaggtgtcgtagaccggaatcgcttcgtgttcttcgtactgcggctgtgctttgctagccggcagattagcgtcgggctaagctggatctcacgcatcggctacgcgcacgccggggtgtgtgccacgtgagtataaatgcgttatgagtgtgggtaagaggcggtgtccttccagggtgtcgatgaacatgttgggcccgggcgcgtgttcgcggcgggtccgtttgttgcagacatagctcattccaataaagttaaggacgtggcttgtcagacgacggatgaagcaagagacgatcgccgcaggggcgatgcgatagcacgattatctcttgtcccttcgcaggtataagcctgatcaggttccgcggatcccgaataaacggtctcagccagttcaggactccgaaagaattagccccgaaaggggccttgatgttaatgacgcgtaaagggcaaaccaagcagaagttgacaggggggtaaccagggaagtatttccgaaaaggcc

SEQ ID NO: 610976 - DNA, 1028 bp, Homo sapiens
cgcgggccgaagcagctgcagccggtgcgcgtgctgccccggtgtcttgccgtggccgatgctgcaccggcaaggggtcgagctcgcgtcccgtcccctgcccccctgcgctgtggcgcagcatggaatttgtgcctgggacccgggcgctattcgcggctgctgactctgctgggcggcctgtgctgcctttcgctcatctctattcttgggtgccgttgtggtcacctgcgctcctgtcctgtgccccccgtcccccgtggccctggagcggttgtgtcccccggtccggggggctctgcctgcgcctataagggggccgaggctggctggtggccaggggaacattgcagcctctaacaggcaggcggtcgtgcaacaccaacttaaccccgcacgggtgtcccccggggttccccacgggaacgacacgcaccagacggaaggcaacacgacctgtaacggttaaatgcccccattacacaaggctctacgcatgtcggtgcctccacacgggaatgcccgtgccttgagcaggcccggttgccctcatgaaagagaacaagaagaaaccggcgctaaatgttggccaaatgcaacacagaactgatttgagcctatgtctacttaaagagcgttattccccttccagacgtggcgggccccaaaactgcgtttaaaagtcacggattacccacaatgcgatacacctaatagtatccaacacggattggcagatccccataagttcgattagaacgggtacggcaacattaatataaagggctaatgcgccacctatggtgaccacggtccctattactaacacaaccagtctcaagaagacaactgagtgaaacatagccgtttggcatcacgcctattagcagcattaacatataggatagaactaacaaaacacgtactaagctaacataggcagggcaacggatgagcactaaacgttataggacacaagaatcgtcacacctaacaccaacctaatattaaaaaaaaggcatcctaat

SEQ ID NO: 610977 - DNA, 172 bp, Homo sapiens
tggaatccatttttaattttaattttttttaaaccaaggggaaaccggttcccggtttttggcttttaaaagaaaccccaaaaaaaattggttaatttgggaaggaattttaaaaataagaagggacccctttttttcccttaaaccttttaaaataacccctttttgggca

SEQ ID NO: 610978 - DNA, 1043 bp, Homo sapiens
tgaatagaactctgtgtgccaggggctcgggagggtagtatgtctttgagtatgtgtggggtcagaaatggggatgataagtattgggggaaatgatcacaaaggaacaaccgcatgctcgatctgtcgttgagggcagatggagatgccagtgcccgttcgtacttactggcactagtacccggccaagagggcggtcgagtggacgcacgcatcattcccttgaaacggccgcgagcccacctgtggtcgccagcgttccatggaccccggggggcacaggtgttggataggccccagcccggggggaagggtctggactcggaggcctctggggttggttgtcgatcctccaacgcaaggtaaatccttggcactgggtttgatggcgaactgataatgcatgggaaacctgggagggccttgttggctgggccccggctgtcgggagtgagaaacactgacgccggacagcaaaagtcctggtgagcactgtgctgaagtgacacgccctgtgtacaacccgaacaccgcaactaggtaacctaccggagcaggaattcaagcaatcaagaggattggctaggtacagacgtttgaccgtgcctttacctctctgttccaggaaattggcctgtttcgtcccgaatctcccggcctcgggtacacgccttgttaacacacgccgatggaaaaaggcctcggcccaacgaaagaggtcgggtgggaagcaccttgaagggacccggtcaccacaaaagacagttggcgggacaggaaccaaactacccgtcggggggagaacccgcaggaggaacccctcctccaagaagtgcaagcggacgggcgagaagcagcccagaacgcccgaggattgcgggcacccacggaagagagaaaccagattacgtgaccacagtgtgcagaaagcacccggcagcagtacagcccacaacatgtggcccccgagctggcgtgtgacgacagccctgctagcaacatcacggtggacacccaccgcatccaactctgagaacactccg

SEQ ID NO: 610979 - DNA, 401 bp, Homo sapiens
gcgagtacttttgactacatttgtaaggctgtagttgccttacaaatggatggatctgggcagagtaaatgaaacccttctggacaggattcaccattctagatgccatgaggaacatttatgattcatgggaggaggtcaaaatatcaacattaacatgagtttggaagaggttgattccacccttcaggaatgactttgagggattcaggacctctatgggggaagtcactgcagatgtggaaatagcaagagatctagaattagaagtagagtctgaagatgtgactgaattgctgcaatctaatgaccaaatttgaatggatgaggagttgccttcttgtgaatgagcaaagaaattggtttcttgagatggaatctattcctgctggagatgctgt

SEQ ID NO: 610980 - DNA, 84 bp, Homo sapiens
  misc_feature (39)..(39): n is a, c, g, or t
gccgcggacacgcccgtgtattactgtgcgccagccatntaaggggaagccatggctggccttatggcatcctggggccaggga

SEQ ID NO: 610981 - DNA, 234 bp, Homo sapiens
taaacgtcccccagggggtttttccttgggttaaaaaaggaagggggggggggtttttttttttggtttcctcggcccctatgggggggaaaaaaaaaaccctcctttcccttttttccccggggggcccagttcccccccaagggggggggggttgccctttcccctgggggccgggccttttttttgggttttttgcccccccctttggggggattaccctgggccttggga

SEQ ID NO: 610982 - DNA, 274 bp, Homo sapiens
cacggctctaggacactaaacaagtactgcatgtcttcactcatggtggaatgaacaatgagaacactggaccaggtgggggacatcacacacctgtacattaaatacaatcatgtgtgttaactacagggatacatctgagaagtgcactgttagagaatttggctgttgtgggagcatcatagagtacttacacaaagctagatggcatagcctactacatacctaggctatatggtatatcctgctgcttctaggctacaaacctggacag

SEQ ID NO: 610983 - DNA, 890 bp, Homo sapiens
tgcagtggctcacgcctgtaatcccagcacttgggaagccaagggtgggtagatcattgaggtcaggagctcgagaccagcctggcaacatggtgacaccctatctctacgaaaaatacaaaaatcagcccctttacacaagatggccccaaaagctaagaaggaagctcctgaccatcctaaagccaaagcaaggatctgaaggccaggacggcagggtggaaaggggtccacaggcacaaacaaaagaagatccgcgtatcactagccttcatggcggccaagacatgcgatccggaggccagtgcaacgtatcttcacgagcacccccaggagaaacaaagctgtgacaactatgcatcatcaaagtttcctcttgaccactgagtctcccatgaatgaagcaccggacagaacaaacaacgcacttgtggttcactggtgaatgtcaaaagccaacaaggcaccaaggccagaacgctctatgacactgcctgtgggcaacaggtcacacccctgatgcgggctggctggaagagaaggcacgatgttcgaatggtcctgatcaaccaatgctcggggatgttgccaaacaaaatagggatcatctcacgtgataccagaggtaatacaaaaatatgatacgtatcacattacaacaaaaaatatacacgctggggcgaacgctgaagaaccgcaccccgaggtgagccagaaaagcggacacggaagcgcgtgaagaacgccaaccaaggacacacggaaggggaccacgtaaaccgactcatggtgcacaaaaccaggaaaacacgacaaagatacaaggggagaaaccacactaagagacgcgacgggggccaacacgacgcaaaccacaagcaaaacgggcc

SEQ ID NO: 610984 - DNA, 242 bp, Homo sapiens
gggatctagaggatccctctgtgctttgggacggcgggaatcttcaaggacctcgacaatgagctcctcgccaatccagtggagcaactggctgtgtcccaggcagtgaccgtctttcgtcccttgatgagtcggttagaaccacaacagcagtcctgatttatgacccctgcaccttacagggccttgtcttagagagtcgtagacactacatgccatccctggacagtcaccacctgtgc

SEQ ID NO: 610985 - DNA, 197 bp, Homo sapiens
ggcaatgcgcagtatgcagaatgtagagcacgtgtatacagaacattaggatgtacaagtagaaactttgcttgaagccgggaatcctccagaagctgctccccttaactgtaattgctattccatttaagcatacctcactcccacctacaggtaaccaccaagtgccatacacccaaaggaaagctttaggtgaa

SEQ ID NO: 610986 - DNA, 852 bp, Homo sapiens
  misc_feature (37)..(37): n is a, c, g, or t
  misc_feature (41)..(41): n is a, c, g, or t
  misc_feature (43)..(43): n is a, c, g, or t
  misc_feature (46)..(46): n is a, c, g, or t
  misc_feature (50)..(50): n is a, c, g, or t
  misc_feature (52)..(52): n is a, c, g, or t
  misc_feature (83)..(83): n is a, c, g, or t
  misc_feature (100)..(100): n is a, c, g, or t
  misc_feature (121)..(121): n is a, c, g, or t
  misc_feature (125)..(125): n is a, c, g, or t
  misc_feature (130)..(131): n is a, c, g, or t
  misc_feature (139)..(139): n is a, c, g, or t
  misc_feature (164)..(164): n is a, c, g, or t
  misc_feature (181)..(181): n is a, c, g, or t
  misc_feature (186)..(186): n is a, c, g, or t
  misc_feature (192)..(192): n is a, c, g, or t
  misc_feature (217)..(217): n is a, c, g, or t
  misc_feature (236)..(236): n is a, c, g, or t
  misc_feature (264)..(264): n is a, c, g, or t
  misc_feature (276)..(276): n is a, c, g, or t
  misc_feature (307)..(307): n is a, c, g, or t
  misc_feature (321)..(321): n is a, c, g, or t
  misc_feature (324)..(324): n is a, c, g, or t
  misc_feature (362)..(362): n is a, c, g, or t
  misc_feature (365)..(365): n is a, c, g, or t
  misc_feature (377)..(377): n is a, c, g, or t
  misc_feature (380)..(380): n is a, c, g, or t
  misc_feature (397)..(397): n is a, c, g, or t
  misc_feature (418)..(418): n is a, c, g, or t
  misc_feature (448)..(448): n is a, c, g, or t
  misc_feature (485)..(485): n is a, c, g, or t
  misc_feature (568)..(568): n is a, c, g, or t
  misc_feature (660)..(660): n is a, c, g, or t
  misc_feature (683)..(683): n is a, c, g, or t
  misc_feature (747)..(747): n is a, c, g, or t
  misc_feature (782)..(782): n is a, c, g, or t
  misc_feature (815)..(815): n is a, c, g, or t
tggagaaaaaaactttattggtattacagcaaaaaantcananaanaaananaaattatgaaacctcaaagctagacgcaaanaaaaaacacctaattanacaaattctatacaattaaancaanaacannaggaaaanttttttgcaaaaatgtcaaaaaaanatttgatctggtcgggnatagnggcccncacctgtaatcccagccctttgggnggccaaggcggggggatcncctgaggtcaggggtccaagactagccnagccaacttggngaaaccccatgtctaccaaaaatacaaaaantagccaggtatggnggngtgtgcctgttatccccgccactaggggggctgagccncgngaatcgcttganccngtgaggggggggttgcngtgagccgggatcgccccccngccgtccagcctgggcgacagagtaagacnccctcccaagagaaaaaaaaaagatttgatcaaaccnagatttcagaaaaacaaaaccaaaaacactgtgacttggttaacatttatttaattttgggaccacagtcaaagacagaaacnaaacatctatttcttcacaattgtgaaaatgtctggcttgaaacacctttgacatttatctcactttcgctctcaagtttcaggctgctgcntccatggcggctagctggcagtnatgctcttttctgctctcaaggtttctttgggcttggaatagttccacggccgtctattttctntgaatccataaagttttctaagggccactcgagcngcctcttcttctgcaaccaatactgtttccccnggtccttctgcaatcaactttttatcacagtttaagc

SEQ ID NO: 610987 - DNA, 323 bp, Homo sapiens
  misc_feature (201)..(201): n is a, c, g, or t
  misc_feature (271)..(271): n is a, c, g, or t
aaggatcccaggttgtacttaaaagagacataggaatgaaggagggcttcctgttctattttaaagggaacatggaattgtggcctttttttctttaatggtagatatttgatcaatcttatgtgttgataaagtcgaagttgaaagtgcagaagagaggatagaccaccaacagtggtcacagtactgaaagtaaaaganggggtgggggacaaaagcacagagtggggaggttttagtctcaagatagaggttccatgtttcttgaacngtgactaaaaagaagcagatgaaagtcagcaaacagtacaacctgccggtgg

SEQ ID NO: 610988 - DNA, 149 bp, Homo sapiens
tggccccaaagggagcccttaaaccttaattggatactccccaaaaagggagtttttaaccaagttaaggccatgggatatgccctctgccttttcattggcagggggcccctaaaaccccttcagtaaataagggttgtcagggggga

SEQ ID NO: 610989 - DNA, 236 bp, Homo sapiens
accgaaaattgttcctccaaaaactgaagaatattcaacgtagtttaaacaaaatacatacttttattttattttctcgtcattggtggaatacggagctttttttttccttttgctttttatttggaaacggagtctcgctctgtggcccaagcgggagtgcaagggcaagatcgtagctcatggcagcctccaactcgggggcaccattatggagggggatcctctggggtcga

SEQ ID NO: 610990 - DNA, 450 bp, Homo sapiens
catgtgaaactcatctcatcacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgcgcagcctaggcagtcccgtgggctggcagttcgttgatcttttaagttaccttacaaaaccagtccccattttgggctaaggtttttagaaggtttgttaggggagcatccgggggccagtcggcttattatgccctctccagtaaagtggtttagttaggaaggattgggagaaaaagcttcccacagcccacctgctctgttagtttatattgacaggggtctttctgaaataatgagccagtccctccaaaaaaa

SEQ ID NO: 610991 - DNA, 201 bp, Homo sapiens
actctagctcggtacccggatgattaattcaggataatcggggttatccgatcacctcaccatttattacttctaagcattgaattacagatcttacaattgttggtggctttaaactctttactttgtcaaatgagaaaaacacggcctacagaacctaagtaacttgcctaatgattaaaactttccaggaactgcacc

SEQ ID NO: 610992 - DNA, 335 bp, Homo sapiens
ttttgagatggagtctcgctctgacgcccaggctggagtgcagtggcgcaatctcggctcactgcaagctccgcctcccgggtccacgccattctcctgcctcagcctcccaagtagctggactacaggcgcccaccaccacgcccggctagtcctttgtatttttagtagagacggggtttcgccgtgttagccaggatggtctcgatctcctgacctcgtgatccgcccgcctcggcctcccaaaatggtggaattacaggcatgagctattaccaagcccagctgaaaactatttttctagaattcatgcaacatggatgtctggtcgacgc

SEQ ID NO: 610993 - DNA, 1667 bp, Homo sapiens
  misc_feature (287)..(287): n is a, c, g, or t
tgcctggccacaccaggtcctagtaacacctgcggattgggatatctcgattctttgagattggtggttccttccgccgcgcgcgcctcgcatgtacagctggagaatcgtgagcgaacctggagagttaggttgagatcgccgtgttgactcctaaaaaggatgagtggtcagaggacgtgtgacgcacagatactcacgctttgctgtcctccctgtgttaagcacagtgaccaggcgctggcacgtccgtcagtgcctcctctcttgcgtcctgcgactgtcantgctatccacgtgtcaggcttctcctctagacttcctgattggtctgttgtcgtcggcatgtatgctatgatgagggatcgtggtgccctgagcccggtcggggagccctctagtctctgatgtcgagagctcgatcgtggacccaatcttaactagcctcagctatatgtgaccgcatattgggcggaagatctcttatcaacagctttctgtgtgtgtatggggttgcattagccttttgaagccgagtgagtgagccccatccaatagagggaggaatttccccttaatgagtttggcgtatgggggctttcgagcgcccaaggaaactagagtggtcccttttggctgggtcgcctcaccaatttggggccccgcctaagctctatgcggcgccggaggtctcgcccggtggtagcgacgctagggggggatctccgaggctttcgaacgacgatcccggagcggccttgttcttcttcccgcaacaacaattttatccgcggaccactgtggcttacaagacggcgcttatcgattcggcatcttaggcaccggtttgtctccattataaccactagagaggcccctaaacgaataatgggggccatcggcggccctaacgtacgcgtggttagcacgcacgagacgcgttgagtgtttacaagcttatatcttagcaagagacacgcgcgattcggaggacttttcccctaaggaatgtgggagataacgggctatcggttttggacaatgccccaattgttggggatagttctagccggaacccttaacgcttgggacatgcgtacgtttattgtgccacctttgtggagagcccaaagcagcattcgtttggcgcaatttcgcacctcgggctcccttgctgtactctttttcagtatcggtggcgggcccggaacagcaaatgcttgtcccgggacggataaccccctttgagccggattgccgctcttctctttatttggtcctctacaccggactgggaaaaccggcggcgcgccctccggaggggggcgcaaccgaagtgaggcatcccccacgtgggcaaaaaagatacttccgtttgttaccccccccttggtgcgcggcgttatatgtatcgcaccaaccgtcttcctcactaatgtaacactacgggggggcgattgctcgttgggggagcaacgattatttggcacgttggtgtgtgcccacgatgtagacaaccacttctataaacaacgattaataacatcgggggcgaggacaaccaacacaccggcgggtagcatgtatcgtcccacaactcgcgtactacactagctgtcgaccacaacaaggacacctcagcgctgatcgccacgacatccttcgcg

SEQ ID NO: 610994 - DNA, 910 bp, Homo sapiens
  misc_feature (544)..(544): n is a, c, g, or t
  misc_feature (605)..(605): n is a, c, g, or t
ggtcgtggcgggattgtggtgaaaacgatggcggctgccgcacaactcccgggttgtccgcggtcctgctcaatggtcacgttctgccattacatgcaatagaccaactatcgtgttgatgtctacgtggcctagctccgtgatcgcctagcgttctatcagtgccgctcaattgacctctatgtggagaaggtgcgactgttccgtctagatcatgtggtgattggtggccgactgtggttatgagagcaatcaggagttccatgagtggctgagtattgtttgtcaatcgcacacgttgtgatctgcattggggatcacatggtaattcgatagccctattcggtgttgatcatagtatgacgatcatgcatccttctgttcccgatggtgtgacgctggggcctagcgttcatgtttcatggaaatgaggacagcggacgaagattaagatgattctaatcctgagcgagtaggttacaacactagcaaattgtcgcgtcatcatctgcttattgcgacgacgtacttgggaatacctaanataacgtttgggattcttagacgcgattgtgtcatgtcgaaagattcccgcaagctagttngctcaacgtgtccaaggacagctggcagttgtaaacagttcagttcatgtttcaccagtctgaatgctgaatattaaaaagctcttcgtagagtattttgatgaaataaggctgtaggagagacacgtagtgagagatgcggatttcccgcgaaggccaattatcgtagagccggtcggacatctttggaagagacgcataagattcccttaattcttttgcaaagtatgcattcggttaggtcctatacaccttggttcctgggctggcagacagtaaacaacaggaattgtccgaatgtttcc

SEQ ID NO: 610995 - DNA, 267 bp, Homo sapiens
tgggggagggggtgatctaaaacatcgtagacttgggttaatcgtgtgactgcggtggctggacacgaattcgttattgtaaaggttatcagtgtgtctccgtggggtgtggtaggtaagcgtatgagctgcattgtgcgtagttgatgcttgtcccttttgatcgtggtgattagagggtgactcactgaaacgggatgcttgatgtgtatcttactaagagctaatgaaagggtagaccaaatctattggtgggatcgataaaga

SEQ ID NO: 610996 - DNA, 414 bp, Homo sapiens
aggatcgaggctgtagtctttagactcaggcataccacacgggccggatgggaggatgccgtggtcagtacgagcaccactgtccttctgagatggagagccgtttcctcctctgcactaagagcaacctgatcaggggcctggtcgcacctccgttcattctgaaccttgtgtgaacatcatgttgtaatccttttcacccagccttcgcagaggaattaatttgcctatatcagcacaggacgtaatgacgggagggacccatagaaaagcccatctaattaccatgctgcgcaataaatcctggatgtcggtaatcttgacgtccacgctggtagacacgtaccttgagtagttcctagtgccaggatctctagactgacgggccaactgctatgcctgcctagactgccg

SEQ ID NO: 610997 - DNA, 174 bp, Homo sapiens
ccccaacacaaaatctgtttgctatttataaaggagggtccctgcttggctcctcctttctagccctggtgagcactaatcttctttctgtctgtaggatgttctattctggagacatcatataaataatccttcgtgtgtggcagcatctatttagcacaacactgtctcacg

SEQ ID NO: 610998 - DNA, 92 bp, Homo sapiens
gactgtaagatttgggtttgtttgtattttatgttgtacattgcatcttatatttccctgaaaactaaataaagtttgggcctttttaaccg

SEQ ID NO: 610999 - DNA, 335 bp, Homo sapiens
  misc_feature (222)..(222): n is a, c, g, or t
  misc_feature (262)..(262): n is a, c, g, or t
tcgtgctcagaggatccgcccacggagactagcgaaggctttgaaatctctcttcctcagtgatgactcgagctttctccttcttatagacgttccggacgggcatgaccggtccggtcagctgggtggccagtttcagttcttcagcagaacctggtctcccttctgtgggggccgaggcgcttcctgagggaacgaggatgagtttgggagcggtactcnctttcagccgcgtgcacgtgttggccgtgcagggactccngtggacttgttcccgcctcctcaggatccgcagacaatgccggatggtcgcgggcctctagtatgggtaccga

SEQ ID NO: 611000 - DNA, 308 bp, Homo sapiens
gcagtacccacctatgagtgagaatatatggtgataggttttttgttctcgcgatagtttactgagaatgatgatttccaatttcatccatgtccctacaaaggatatgaactcatcattttttatggctgcatagtattccaagcctgttaatctttaatcaaattccagatatagtgaattttatattttcgggtgctggattatttttcatcctatacacatctgagggatgttttgcacatcagtacatgtaatagatcaacataggcttatgaaattaattattaaatatgagggaaggccag

SEQ ID NO: 611001 - DNA, 160 bp, Homo sapiens
aagatcacatctactcgactgatagtgtctatatcgtagcaacctttataaccagctcaggtaactttctcctcaaaaatccaactttcatgtttgtcacctgatcttatctgccattgaaaagccttctggctcactacaacccttgcgagacacagcc

SEQ ID NO: 611002 - DNA, 373 bp, Homo sapiens
agaggatccccgatttccactggtgatattggaggttacggtgggagtatgtcttagtgtgagtaatcctttggttgttcattttactaactaatgattatttgtgcgtatcatttaacctactctacatacatatctgtataacattcatgataatggcaagtgccttttatcagcttttggctattttgacctttataacggttactaatatttgtgacgttcgttattaacactatacataatagtaacctgattttaaattttagcccactttatttctttacttaattgcataaggaaaagcaattgacatttatattctggtttataatttcctatgttaatttttaaaattattccactttaggac

SEQ ID NO: 611003 - DNA, 413 bp, Homo sapiens
tagggggatccatggggcgcccatctaatgggtgggactgaggcccaccctgttccctcactctgagatgtcatggtccaggaggcccagacttcttttcgaaccctgttttcaagaggaagcttcatgacgaccgtggaggggctgacctttccgccactgggggcaagcaaggccagactctcggaagcccatccttgtccaccctgccatcagcccaggctgcacctgcttatctgagatgcctgtgagaggccgaggtgacctttttctccctcccctgagggaggcctgcttgtcacctggagatacctgacccacccccactctcgcctgagcaggtggaaggctcatcctgggagcctggcggcctgcataatccggccaaatccttctctcaggcatcctgccct

SEQ ID NO: 611004 - DNA, 105 bp, Homo sapiens
ctattattatagcaattagattgaatctgtgtaggtcaactagacatggctttttagagtctatgctatacaggtagtagatgaggaactaatggactaactggt

SEQ ID NO: 611005 - DNA, 969 bp, Homo sapiens
  misc_feature (13)..(13): n is a, c, g, or t
  misc_feature (129)..(129): n is a, c, g, or t
  misc_feature (143)..(143): n is a, c, g, or t
  misc_feature (248)..(248): n is a, c, g, or t
  misc_feature (866)..(866): n is a, c, g, or t
  misc_feature (924)..(924): n is a, c, g, or t
gatcaggaccctntcgctgccgtgtcctgacttctggaatctttgagaccaagttccaggtggacaaagtcaacttccacatgtttgacgtgggtggccagcgcgatgaacgccgcaagtggatccagngcttcaacgatgtnactgccatcatcttcgtggtggccagcagcagctacaacatggtcatccgggaggacaaccagaccaaccgcctgcaggaggctctgaacctcttcaagagcagnctggaacaacagatggtgcgcaccatctctgtgatcctgttcctcaaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcatttcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaaccccccaatttaattaaagccttaagcacaattaattaaaagtgaaacgtaattgtacaagcagttaatcaccccccatagggcatgattaacaaagcaacctttcccttcccccgagtgattttgcgaaacccccttttcccttcagcttgcttagatgttccaaatttagaaagcttaaggcggcctacagaaaaaggaaaaaaggccccaaaagttccctctccctttcagtaaaaataaataaaacngcagccgccaaccaataaaatgaaataaaagaaaccaatgaaataaatattgtgttgngcagccttaaaaaaaatcaaaataaaaatttaatgtgggccaaga

SEQ ID NO: 611006 - DNA, 349 bp, Homo sapiens
  misc_feature (96)..(96): n is a, c, g, or t
ccccccctgtccccaactaggaatccagtagcccagcttaattccccggcaggatgtttgaattccaaccctgtgggctcccttttattttggacnacccctttttttgggtttccctcctggaaattaaccccaggatcctggatttcccagttggcaagtaaagcccccaccactaaaagctatactcagaaaataaattttcccccctgcaacccgtttccttaaaaagggggggggggtatttttttaaagttttggccatttcaaagaaattttgtttggatgaaacatttccctgtttttcccaaacaagggccattttagtaaaattagattgtttgcctga

SEQ ID NO: 611007 - DNA, 406 bp, Homo sapiens
tcctgatgttgcaccatggcgtccatggggaccctcgccttcgatgatatctgtgcgccctttcctcatcattaatgatcaggaccgcatgtaccgtcttatgggacttgaagccctcaggtctcatataatggcttcaaaggctgtcgcaaatacaatgagatcatcacttggaccaaatgggcttgataagatgatcgtggataaggactgagatgtgactgtaactaatgatggagccactcatcttatgcatgatggatgttgatcatcatattgccaacctgatggtggaactgtacaagtctcatgatgatgaaattgacgatggaaccacatgagtggttgatctgactggcgccttgttactacgcggggcatttgctccgacgcatatacccagtcg

SEQ ID NO: 611008 - DNA, 1376 bp, Homo sapiens
  misc_feature (13)..(13): n is a, c, g, or t
  misc_feature (129)..(129): n is a, c, g, or t
  misc_feature (143)..(143): n is a, c, g, or t
  misc_feature (248)..(248): n is a, c, g, or t
  misc_feature (866)..(866): n is a, c, g, or t
  misc_feature (924)..(924): n is a, c, g, or t
gatcaggaccctntcgctgccgtgtcctgacttctggaatctttgagaccaagttccaggtggacaaagtcaacttccacatgtttgacgtgggtggccagcgcgatgaacgccgcaagtggatccagngcttcaacgatgtnactgccatcatcttcgtggtggccagcagcagctacaacatggtcatccgggaggacaaccagaccaaccgcctgcaggaggctctgaacctcttcaagagcagnctggaacaacagatggtgcgcaccatctctgtgatcctgttcctcaaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcatttcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaaccccccaatttaattaaagccttaagcacaattaattaaaagtgaaacgtaattgtacaagcagttaatcaccccccatagggcatgattaacaaagcaacctttcccttcccccgagtgattttgcgaaacccccttttcccttcagcttgcttagatgttccaaatttagaaagcttaaggcggcctacagaaaaaggaaaaaaggccccaaaagttccctctccctttcagtaaaaataaataaaacngcagccgccaaccaataaaatgaaataaaagaaaccaatgaaataaatattgtgttgngcagccttaaaaaaaatcaaaataaaaatttaatgtgggccaagaaaaaaaaaaaacaaacaaccacaacaaacaaaaagcacacaaaagcaaagacaacacaacaaaaccacgaaacgcgagaccacaacgtaagcgcgactgcgacaagcgaccacagcggcgggagcgcaaacagcagccggccgccgcccgccggcaagccgcagacgcgccgagagagagctgaccgcaggcactcggcacacacaaacccggaccacaccgcgcagacgccagccagaagacaccgcccaaccgaccgacacgcgccccaccagacgaacgcagccgccgtgccacccacagacccggccaactgagccatggacgcgcgcgcccccccaggagcacaccgacacaaattcacgccggggcaccgcagagaagaagcaactgccgcacaccgcacc

SEQ ID NO: 611009 - DNA, 952 bp, Homo sapiens
  misc_feature (13)..(13): n is a, c, g, or t
  misc_feature (129)..(129): n is a, c, g, or t
  misc_feature (143)..(143): n is a, c, g, or t
  misc_feature (248)..(248): n is a, c, g, or t
  misc_feature (866)..(866): n is a, c, g, or t
gatcaggaccctntcgctgccgtgtcctgacttctggaatctttgagaccaagttccaggtggacaaagtcaacttccacatgtttgacgtgggtggccagcgcgatgaacgccgcaagtggatccagngcttcaacgatgtnactgccatcatcttcgtggtggccagcagcagctacaacatggtcatccgggaggacaaccagaccaaccgcctgcaggaggctctgaacctcttcaagagcagnctggaacaacagatggtgcgcaccatctctgtgatcctgttcctcaaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcatttcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaaccccccaatttaattaaagccttaagcacaattaattaaaagtgaaacgtaattgtacaagcagttaatcaccccccatagggcatgattaacaaagcaacctttcccttcccccgagtgattttgcgaaacccccttttcccttcagcttgcttagatgttccaaatttagaaagcttaaggcggcctacagaaaaaggaaaaaaggccccaaaagttccctctccctttcagtaaaaataaataaaacngcagcgtgccgacccaatctgatggaattaaaggaccctaatgaaatatatattgtcttgggcacgccatttaagaacaatacaaa

SEQ ID NO: 611010 - DNA, 371 bp, Homo sapiens
  misc_feature (368)..(368): n is a, c, g, or t
agtgcgacgggcaacaggcattatggaggggataacacacttccatgctaaaacataataaataaaaactgcccttaagaatgcaggctgggcgcgctggctcatgcctgtaatcccagcactttgggaggccaaggcaggaggatcacttgagcttatgagtttgagaccagcctcggcaacgtggcgaaaccccatctcatctctacagaaaatacaaaagttagctgggcatggtggtgcatgcttgaagtcccagctacttgggaggctgaggtagaaggatggcttgagcccaggaggcagaggttgcagtgagctgagattataccactgctttccagcctgggtgatagagccagaccttnttt

SEQ ID NO: 611011 - DNA, 81 bp, Homo sapiens
taatataatataaatgaaaattagatatttacaaatattaaattaataaaattatatactataatatgtattattatataa

SEQ ID NO: 611012 - DNA, 674 bp, Homo sapiens
  misc_feature (180)..(180): n is a, c, g, or t
atggctcttcctcccagagcagccggcagctacctggaccggaaatgtcctcatcccctccctggggccaggctctgccctggccttcctctgtgaacccctcctttctttgtgctgggtgtctggcgaccaataaagggggaatatgggatgggcagcagtgggtgcggggagtccatngggcctcggggccccgaagccggtgtggcgtctagagctccctcaggcatgagccaaacgctcagatggaggaggcctactgcttctaggcccgcgcctggcatgactattcgtgagcaccccactcggtaggcccctgccacagtccaagcctgcccagttctttccttctgggcattgaccccgccagggagagttctccagtgcctagggccaggacgagaggccctggacaccctgagcgtgggtgcccgcacaaacgccctgcgaacgctcagaagcacaaatgctgtccatggccgtgaggctgcctgccaggtgaatggacatagcgtgagaggcggtgaggccagggcttccaggctcgttgctgtgctcgggacatcctgaccgtggtgtgcagtgtgtgcccgtctgtgacatttctactcaccaaggttgaagaacggaaacggggaatatcacatggggttcaaaccccacctcagtaggtg

SEQ ID NO: 611013 - DNA, 205 bp, Homo sapiens
aaggcttcgaagagattagcaaggtgctaatccagtggaaataaggagaggtgttaatgttagctgttgatgctgtaattgctgacctcaaaagcagtctaaacctgtgaccacccctgaggaattgcacaggttgctcgatttctgcaacgggacaaggaattggcatatcatctctgatgcatgaaaacagttggagcagggt

SEQ ID NO: 611014 - DNA, 151 bp, Homo sapiens
gaccacaaaccctcctttccctacctaccttcctttaatagcagaattcctattattccctgtattctgtgtattgatcaccctgcaatcctattatgtatctgagtgtgtgtgtgtgtatgtgtgtgttatggggaaaggggggggtttt

SEQ ID NO: 611015 - DNA, 1290 bp, Homo sapiens
  misc_feature (245)..(245): n is a, c, g, or t
  misc_feature (254)..(254): n is a, c, g, or t
  misc_feature (337)..(337): n is a, c, g, or t
  misc_feature (819)..(819): n is a, c, g, or t
ggcgcctcagagttggcagcgacacagatgttattaataacggcaaatcgcaaggccgccggcgcggtgactcacgcctgtcatcctaccacgtttgggaaggccgacggcggcgtgatatcacgtctgagggtataggagattgtgatgatcaagcccgtggacaacatgtgctgaacaccgcagttcactctacataaaagaagaaagacattatcccgatgctgtgatggtggatgccctgntaattcgcntacactctcgcgtcaggagaggggcgtaatcggaggttattatagtggctcctcgagggaaacggctgactccagatgggatngggctcgcgacgcaagtattcgtaggctactctgacttgacagatgatgacggtagcccacagagacgcctaacagcccaaaggaccttacattctcgacttcgtacttgcctccgttataccctccattgtacgtcctggctggcccatcgaccacatgggcaaggcgaacgcagcgaggtgaacggcgcgcatagagacttaccacacccgatgtgtttcccctggaggagcgcccagcacacatgtcgtgtcatacatccaaggaatggcaacaatctagttccacaccctggttcgcaaatacctttcgaaaccgcccacactctagccacaagacggtttccaaccgctctattgtagcccccttctacgcaagaaaacaatcgcgccaactgacaataaaacgcccggtgcgtttccccacaatcggcaggaaccgaggaaagccaccttttccaggaccagccgcttctggcggncttagtctttcccgctttgggcttcccccaatatgggccccaacaggtctatgacaaccacttcgggcaaacccctttggcaaaccccgccccctttcgggcccagcaaaatcccccccaaacgcgcacatcagcgtacctctttggcgcccccctgggccccactcgcaaatcatattggtccccaagtggtggggccctttggcgaaaggcgtatatatccaattggctttgtgggcggtgggtgaaactttacccaacatataatacaacaacgctgtggacaacggtaaataacctatggccaaccccatcagtacccatatcactttggcacctttccccacccgatacacgcttggtaacccgctggttccatagccatggagtcccactaaaatacatatgttacgaccccttgtccaacctgcgaatgttcgcaagtttgcggtgcccggccatttccctccg

SEQ ID NO: 611016 - DNA, 943 bp, Homo sapiens
tgggctctaaagggggtaaagggggtgctatagggtaaatacgggccctatttcaaaaatttctaaggggaataaatttctaggacgatgggcttaaacactgtggttggccccacagaatttcagaagctttgcaaccgtatttataccccgcggttcgctgtctagcggctgaaaaggtggcttgggtatctagacacgtccgggaacatgcatctgttttcaagcctattgtggggcacagctcatgagtgcaagaacgtcttgtgatgtaattattatccaaagtggggcctctacaatcgggaagtatactacttccgactgtgtaaaagcgtatcaaggcagttcaccaggttcagcacgggctatcttaggacatataacgtggggaaaacatatcgtagcgaagtttagaacaatattagctccacgacacgacaactcgagtagacataccaccgctgagcgtcttacagatcacccattgtcgcgaccccacacacgcactcggaactgaaatacagccccagaaaactccgggcagaaacctcacacaactgcaccacgaacaaagggaactgccgactaagcaacggaggcagagagcacaaacgcagcgacacatcaggaaaacaaacaggaagacaaccaccaaaacacccccacacgaaacccagacccacccaacatcacccagaaacggaacccccagaaaaacagaatacaaaacaaacaaaccacaacagcaacgacacagaccaacaccagcacagaaacaacaaagccaccaaccacacagaacacacagaccagccaaaacacaggcaaaagcaaccacaccaacggacaacacaacgaaaaaaacacgaaaacagacaccacacaccaacccaagagacaacacacacacaaacaagaaaacacaacaaaaccacaaaac

SEQ ID NO: 611017 - DNA, 178 bp, Homo sapiens
ccagaggattacggtattgagtggcatgtgagcagtagaagctaaaaataggcatgagccaccgcacctggccttccttgcctatttttagcttctagtggtttgctggcaatctttggcattccttgacttgtaaatgcatggcttcaattccttgttttcacatggccactcaata

SEQ ID NO: 611018 - DNA, 456 bp, Homo sapiens
  misc_feature (87)..(87): n is a, c, g, or t
  misc_feature (115)..(115): n is a, c, g, or t
  misc_feature (118)..(118): n is a, c, g, or t
  misc_feature (130)..(130): n is a, c, g, or t
  misc_feature (143)..(143): n is a, c, g, or t
  misc_feature (147)..(147): n is a, c, g, or t
  misc_feature (157)..(157): n is a, c, g, or t
  misc_feature (200)..(200): n is a, c, g, or t
  misc_feature (211)..(211): n is a, c, g, or t
  misc_feature (236)..(236): n is a, c, g, or t
  misc_feature (240)..(240): n is a, c, g, or t
  misc_feature (278)..(278): n is a, c, g, or t
  misc_feature (286)..(286): n is a, c, g, or t
  misc_feature (301)..(301): n is a, c, g, or t
  misc_feature (310)..(310): n is a, c, g, or t
  misc_feature (317)..(317): n is a, c, g, or t
  misc_feature (415)..(415): n is a, c, g, or t
gtcttctcatacatcatacaattaatttttcaagtattctttatgtacaaagagctactctacctggaaagaaaatttaaaaaaaanggacaaggtaggttatgcatcctatggnggngggggggggggngcggtcgggcacntgtncccgtccccncgaccccacgggccgctgattccctgccactgggctccccccnccctccacgcnagcagcaacgctgggcaggcgaaanccangggagtgggaatcagcagcacttttgtgcctggggggngaagggangccacggtggagagncagcttggngaaagcngatggcggggcagggccagggctggtcctcagcctgtgtctgcacccaccctccctgtgtgcagcttggtgcccaacttgctccgcccccccaagatnggagggtggggagcttgtgccctcttgtgcacccacattgc

SEQ ID NO: 611019 - DNA, 178 bp, Homo sapiens
ccccccccccccggcttcccgggcactggggccttcagccttttaaatttcactgcatcattttttaccttgactgggcagggatgcaaggagctttgtgaagtgacagtgacatttttgtgcctttgggggtgggttgtgcattccagcctgggcgacagagtaagaccctgtttca

SEQ ID NO: 611020 - DNA, 117 bp, Homo sapiens
ccggagtatctgcaggctgcaagcagtgacagtgcccaggctctgatgtgtctctcacatcttgtaaagtgtgagacagctgccttgtgtgggactgagaggcaagagttgttcctg

SEQ ID NO: 611021 - DNA, 390 bp, Homo sapiens
  misc_feature (352)..(352): n is a, c, g, or t
cggtttccggggcgtccgcggccaggtgctgcggcctgggtctgtacgtccgattgccgattcagcccagcagaggtgttcggcagtggcagccatatgtggaatgggcacagcagtttgggggagctgttatgtaccctagcataagaagcagcccactggaagcctccacgcttgagtaatgattgtgcgaccctaccatagaggcacacaagttgctggaagtagagcattgagcccgtgaacatcttttgggggcccctcgcgagaaacacctcgatggcccatgatccggcccaaagttgggcccttgggttaccccggttggtcccggaaaaaccctttaaagggntttggtaaacgtttgggcgggcaaaaacctttttgcgg

SEQ ID NO: 611022 - DNA, 184 bp, Homo sapiens
gaccaacatgatcagccagtcggaaaagctgttcagtatcccagatgcatcaggtcacaatcccagtgagttcctcagttctccttcgtgtgcctcgctgtaacctcattgtgccacagcacgtgatcagatgctgccccattttccacatgccatacttctgacagcaatgaatgtcacatca

SEQ ID NO: 611023 - DNA, 565 bp, Homo sapiens
cttatcccccctgccctcgttgcccccaattggtccctgcccccaattgtgttttcccccctctgtgaaatcacaccgctgggtccataccccctgtatgtttccactattcgccagaaaacaatgtggccttttaagtcacttggaacaaaaaccttaataccctatttccccgtatgtctaaagcccaatattctcccccccgatttgtagatctacctcccgctcacgactgctcttctctccaaacacccaacagtcttgaagactcacaccacccccccctcccgccccctcctagttaatattaccgacgcttccccgctcctactaaattttttacacccacaactcacccccactcaccccatctattctgcatatgttctctccacccacacttttgtcatgtctactacgccaccctatccatactccccctccttatcaaatataacttccctttcctcttatctccccttccctaccttctatgcctaaccctccaccccctatctttctccctgttggcacccactaatctctccccaaacaaataaaaaca

SEQ ID NO: 611024 - DNA, 128 bp, Homo sapiens
tttgggtactctaaggatccccaagttagtcgggacgtggcacgagagggagagggagaccgtggagagagggagagggagagggagagggagaccgtggagagagggagagggagagggagacgtga

SEQ ID NO: 611025 - DNA, 856 bp, Homo sapiens
  misc_feature (852)..(853): n is a, c, g, or t
tcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcatgggagttctcagcaggaactcaaatcttcctagtcactatccagtctcagaattccttaatggatctctgctggagaaagcacagctgagtcagctactggagtactttgctgtttgtgctgtgcttggcccgatggaagcgagtctttccttccaggcgtgactctcccggatacaggcgtatattagcaccaaggttaatcggatttgccacctgccatgatgataaacaggtctggttccccttaggcccatgggaaggcccctgggggccttatcattttcttctttctccttaaaaaacatatctccctctctannggg

SEQ ID NO: 611026 - DNA, 1467 bp, Homo sapiens
  misc_feature (930)..(930): n is a, c, g, or t
ccacgcgtccgtccatgcgtcagacaggaaagttgtcttctaaagatggggatggacattcaggtccttcaataatagatgttcaggactgtgagcgtacttgttagaccctgttagaatgggtgggattgtagcgctaactcgtgatatatccttgtctacgatatcgatgagaatgctaggttagcatgtagcagattggagtgattattaggacgtggtagttctgagattttcaggaagcggtcgaaggatgcatggaggaacattcgacgtaattgtactgactgtggagacatagggctgtgtggggtgatggtggtgttgtcgcacaaggctagcctgcgcgtatgatgggtatacacgtcttcaggttctagacctatcttagagttagcgcttttgttattgactgaaggttatactgggacgattatacatagaataagagaatagtcccctgtgggttgtgccaagaacgcgatactaaagtggattggctcatacgttgtaggtcatcgttggtcgccagccacgtgacaccacctagtgcgaggggagctaggaagatggaagcatggatcgagtctgatcggccaaagccacaacattggcacggtactcggtcggaaacgggggggaccctgggtgggattcagacgtattggtggcaagcagacctgggctagctaaggataatggccaattatctcttgtgaacgaggtactattcttgtagggccatggtggtgattttccaacgtttgctcaaacgttgaatttcctttaggacaagacaatgccctggtccttcccttcgtgtggcctccccgtttgtgtactgggccaagagtgtccatcgttcgactcggatgtgcaagaggcctgtagccttttgggacacacaacacgccaaagaagttaatgtantggggggcacccatccaagttacaagtgggcgcgacgatccctattggaacaccgggaaagtttggtgtcaacaccacttccttaaaggagtaattatatccggtttactctccccacttgacagttgaacccccatggaaacttctgtaaacgggccatcctgtgaaaattatcagggggggccttaatagagaggtcacacaacagtaaggtggccacccggggccgtgagcaactgtcggccccagtggacgcagcagaaagcagcgaaaaacagagacattcgccaacataggtggatgatacaccgggcgagacgacaaaagcgggcacacacaacgggtagaaacagacaacgcggggacccatgtatagacccacaatgagactagtcaaccaccaagcacagtgtgaaaccacggacgcatatgaaaacagggcagcatcagcgaaacaaccatcgggacgaagctaaggcaaggaacacaacaaccagccagacgaaggtgagcaagtatgagcgacatgcaccgtca

SEQ ID NO: 611027 - DNA, 568 bp, Homo sapiens
  misc_feature (96)..(96): n is a, c, g, or t
gggcaaactgggcccccaaggaacctacccttccagtgccccagactttgttcttgaatgtgcaattgacaatctggactccccaaggatggcacncaggtgtttggcttctggctacctaaggttaacatgtcactagagtatttttatgagagccaaacattataaaaatctgatggcaaaagcaaaacaaaatggaaagtaggggaggtggatgtgacaacaacttccaaattggctttttggaggcaaaaggaaggggagaacttggaaaatagtttttgctttgggggtaaaggctttttaaattttcccagcatccgcctttccctttagccagtttgctgtcttgaaacccaaaagtgatggaaagaaaccaacaagagttctcgaaccctgtttaaaaggaatgtatttgttgttaaatttggaagccctgtttacagttttcccccatgttatttatgaattttaaattccgggaatgtaaattgtcttgtaatgttgcaaaatgttccctttttaaagggggtcctttattttaaacagtaaaggggtttttttttta

SEQ ID NO: 611028 - DNA, 269 bp, Homo sapiens
tctggtggtattgctcagtgaggtcatgtccccggaaggactttgaggaaggctatgacatctctgatgcttgtgagatccagtgacaaggcatattcagtctgtctaacctgtaaggcaattcctccatgagggggtgcccgattaatctaaagcctggagcagatgggaaagcattttcacatcctcctttgaataaggtgtggccaggatcattacgctgcagctctgcagttgtgaattcgaattgaaccgactccgtatttcat

SEQ ID NO: 611029 - DNA, 147 bp, Homo sapiens
cggggttggctgaaacccctgggtggggggttggggggaggactaatgggagtcggggaaaatttgtgggtattttttttatttctttttggttcccagttttgacacgtttttatcaaaggagaaccaataaagggattaccctta

SEQ ID NO: 611030 - DNA, 106 bp, Homo sapiens
tacgctcgtccggaatatcagcacgcactcctgtgtgactgtgactacacaggacttcaatgtagatggaggaaaatgaaggtaggagcgtgtgtgtttgtgtgtg

SEQ ID NO: 611031 - DNA, 201 bp, Homo sapiens
gtaactcatagaggatccctttttgcttgcgacatccagactcgtggggggccacccatgcctcggtaagccagcagcccaggcactggcaactaccatagaggcactgctttaattgctgcatacagctgtaacccgacggcgcacacaagcagcaggtcaactgccaaggaggcccccatacacggtcaccaggcgtgc

SEQ ID NO: 611032 - DNA, 1031 bp, Homo sapiens
gcaatgtgctgttgagcctgtgtgatgccagcgtcaacgagcgcctgtgccgattctccgatcaactgtgcaacatggcccggcaagagagccagagcgcatgtgctggccgtccatgttgaccctgtgggcctctgcggtagcttgcccgctcgttcagttggcttcagctcctggggccgacatggagcttggtcacagcaggagaacccagtcgtggcgtcgtgtacccgcctggccctagctgcctgagacaaatgagggagacactcgcgtggggtgcggctgctccttgtgttctacgccaatgcgggtggcctcaccctcagcctatcatgatcaagcgctcttgcattaatggacaccaccaccacgcgtcacctggcgtcatcgtgtctttgcgggttcatcacttgcaagatgcattctgttgaacatgcttcccgggactcgaatatcctccaccatagcgtgcctccgtccggtccatgtctgccacagctaacgacagagcgaggggctccagccctgggttctgaggactttgccaatgtgatctgctgtcggttcagaaggctcacggccggcctgattgtcctgaatactgtcttcatttccatcaaccatgtgcgtcgcaccaagcccctgtggagaaaggagcccttgagcaaactctgatgggcgtgagaagtgcctgtggtgcttgctagggtcaaggtggttgcaaattgtctggtggacctgtagctggtgggacgcactgggacagccacggtccactttgggcgggagggaacgtgcctgctgacatgggtcctgggctggctgtcctggtcctgtggtggtggccctggttcgtgcagcttccttgatttgggtccagtccggaccgaggcgcaaagccgtgtttggcgattggggtgagttccttggcgctggggtgggtgggttgccgcctcgggagaccctctacagggggtctatggcgcgttgctgccgggggaaccttaccttttcgctttgggccgttc

SEQ ID NO: 611033 - DNA, 251 bp, Homo sapiens
  misc_feature (156)..(156): n is a, c, g, or t
ctagtggacttcatatgggtcccatggtgttcttcaagttttatggttcattaccagtaacacatgcactagcttactgggtatgttcattggtcatcacaggggtgttatacagtggcaccattgtcagtgtcatgagccccagtgtcaatagcncatcaggcaggctgcacttccagcaatatcattcacggccagtaccagtcatatcaccgccagttacattttcatgtcagcttcgtgcatttgca

SEQ ID NO: 611034 - DNA, 342 bp, Homo sapiens
tacactcaggataggggatttgtgtgagttgtatgtgcccatgggtatatgaaagtcgtgtgcgtatattagagtattatgggtgttttgtggtttataaaagggtatggaaggggtttaatcgggaagggtgaggtgtgtatcaagggttagttggtaagtgtgtatataaggggtagggggaatataaaaatttaggggtcctcggtgtctgtggtagaaatgtaatactcgcaaatttggtgtgtggcccttggtatgtgtgtccacagagtccgtgcggggcacttatatgtattggataaaactagtataggggggggggatccctcaaagagcaga

SEQ ID NO: 611035 - DNA, 1767 bp, Homo sapiens
cagtctgcatgcctctgatcattgctgctagtgacttcttatgtgccagtagacctggagctttagcttgtaccaaattgtgacttcacaagtagctaagaacgccgacgtctacgaaagtgactgcactaggagttattgccttggccgtttcattgtgaagataactgtgactaattactgttattgtgtataaacaaggaaaacatgtagttggagtctacttacttatggatgttggtatctaggtttcgatatctattagtctacgccctctatctaccgttgtgttttagtattattgtttaaactcacaatttatggactgattagggatatgatggaacagacgccgtgagaggttacatgcaaacacatcatctgtggttcgcgcgcagaatgtggtataactgtgtcacgcctcacacattcaacgcgagggacaccaaccaccaactcaatcttcctttgatggaacgaagccaccactctgtgggggaaatttcccatggggtggagcaagtgcataaataaggaaaaacaaactcactttcagcgaaacgacaacattcccacacactatagtgacagctgtggggttggagcaaccctaaagaaccccctaaagacagtcttaccagaatgctttataatctccaccgtactacgcagttactaacagagtctatacaggagatcaattctttccagcagcgtaaacagcaaaactacgggaaacctgcctgaacccgtcgagtggtcgaccagaagccgctgtatgtgggctcataataaacacgacaaagacccccaaatatcattattacaaatagttgatagcccccccgacaagttatactgacaggacacagtatcgcttagattgtgaggatacaacagcgtttgttaaaacatcgacagcgggagtgatattataatcaagtaaaacacatgggccgagctttcctgacttagtggggtggctctagccccaaaaacaatggagcagaatagacatattgaattagtcatcatccattaccattagcaccctcaccagtgtgttatccacaccccattatcagcaacttcagcaacaacatctatggggtgaaagcaccaataaatagggatgtgggtggtgacgaacccacaaacatttagtgtcgatctatctgtgggtgataataacaggcgaagcatcaccttctttatcaagcgttgggttaagttgagtgtactctattaggatagtaacaaaagtaacctttgggtgtgcataataatttatctgtgatgcaccccgcttgtaatggtgtgctgtgatagtaagacaccgttatgacatcaacgtagtataggcggatataacatcaggggatgaaaggaggaatcattatcccctgacaatactgccgagtaaaacattactgcagccagtgtagaccaagccatcactcggagagcatctatagccgagcaaggctcttacttatagagatgacaaaaacaagtccgtagaatacagccgaagggcagggctataataaagcaatcgagacaaaaccatgggtgagtcatactatagcatataagcaaagaggctggcgaacaagcgtatcaatagaatacattgtctcgatttacagatactcgtggtcgaagcagattaacaatgatatgagcgagaccccaacagcagcatccaaagcgaagagtgacaccgtctacagacaaattatcgaagtatgagtacctattacatag

SEQ ID NO: 611036 - DNA, 275 bp, Homo sapiens
atctccagtcggcggtacttgttcagcctgacgcggccgacatgcatatatctatacaaaccatatcataagaaatctttcctctgtaggcccaagtaattcgattatctatagtgtgctctgatctcgttcgaattatcacttaacttgggggaattaaataaggcactctggacatacgcagccactcaggaacacagctaggtgcgtggatgatcctttcgtctgaaaacggtgcccgttcctctacgcagtcacacctcaccctggcaccc

SEQ ID NO: 611037 - DNA, 1240 bp, Homo sapiens
agcggcggagtaccatcttgacctaatatgacgacatcagttcctaatatgtaggacgtagtggagccacagatgctaggtgtaattaatgtcgcaatgctgttgcgtatagagtagtaagccagggccaattccagcaatatgcatagcccatcatcatacgacgaaagctgatatgtggcttttcgtttggctcttgtcatcttgttctccagatgatcttggaaagtcctcgctcgattctgcctatgtttaggcctccacagcgccgatgtacactcaggcgaaatgagccaagcaggtgagaatcactcaggaaaagagatggtaccacagagaacaagcacggggagatcctcaggaaagagcgtgaaccaaatactggggccaagaatcggccaggctggtacaaaagacatatggcatgagtatagctcaggacgcgagagtaggacaatggcgaaaaggggtgcccgtgatgcatatcaaacatccgttttacaccagcacataagtcgtggtcgacgcatttgtaacacacgatcccgacggggatgacacaggcgggggaatatgagatacaacccccagggggtgtgtcaatagcaaaagctggaacgaccagggaacgtgtgcgcaccgcccagtccaagataagggcaccacgtgtgtggtaacgcacaaaagcagcatcattcaaatccccgtgacggtggggatctgtcccccaaaaggggaagcttagaacgtagcgaactagaagctcaactttcgcattccacacgtcttatgccacagcgacgatcacgtggggtttatcttaatattagcctaatggtgtggacttcgtgaaatctgtccttggggtactcttcaaagggctgtaaagagttactctcaatgagtagtaacgcaaaggtaacaaacaccaatgaggccatcacacagatcaacgagaaggctagcggggaggacacacccaaactcacctgacggaccatggcaaatgcaacgttggataagaggtaacggcccgtcgagccacaaaccaactcattgcaagacacaggagctttgccctaaccaagcgggggcacactgagaacatcgaacggagagagcccatttggcgcctgagggacgatctccagaaagaacccctagggggacatccggaacgacacgaaactgagggaggtcacccacgagaaccacggacgcaccatacgtgtcgcaaggc

SEQ ID NO: 611038 - DNA, 554 bp, Homo sapiens
  misc_feature (491)..(491): n is a, c, g, or t
ggacgcgtgggtcgctgtagactgggtcaaagctaatttaagtatatggtcagagctgtcaaagacataaggagtccataccaccggactggcctggagcaaaaggggcctgtggaaaagaactgacggactgccatctggaccctctgccggatcaggtcctccttccccggtctcaccagtgaccatctgatcctccttcgagtctcataatcaatacaggctcagatgagtctgcttcccgctcagctagtgttcgcgcagattactcagggggaagagcattacacatgccctgaaaatatgtatctgatgacatgaagactcagaagaaaactgccctgaaggctcagagtggtccagtacgcagtgggcccaaaccaatactctgcagctaaaacccaaaacagcccatccccacaaacgagccacaaaggaaggagccagcttgtacttgaattggagggcaagacgctgcgagagtgcgaaanatgaggcacactgtttgcaacctggtgattgaggacgcagagctgaaaaggtgggtaacctaa

SEQ ID NO: 611039 - DNA, 621 bp, Homo sapiens
ttgcctcttgatttatcaccgaggcggtggtcagggttgtaaatcacagcacttggagagggtgaggcgggctgatcacgaggtcaagagattgagaccatcctggccaacatggtgaaaccctgtctctactaaaaatacaaaaattacctgggcgtggtggcgcccgcctatagtcccagctacttgggaggctgaggcaggagaatcacttgaacccgggaggcagaggttgcagtgagccaattgagccgagaacgcgctactggactccagcctggagacagagcgagaatccttctcaaaaaaaaaaaaaaggatgttctgaaccaatagggggatgaattacacaaaaacaaaaatgatcataaggccgcttgtagccacacagaaaatgcttctgatgtaataagcagaagaagcacagtataaaatatatccatttctgtggttacagccatgaaaatttgcttgtaacaaggaaggaaaggcattttaaccgagagcaaattgacaagatttccgagcccaattccgaatcatggacaaagcaattccagagggaaacgccagaataaaacagaacaaaacaacacaagacaaaagaaaaaaacagaaata

SEQ ID NO: 611040 - DNA, 632 bp, Homo sapiens
actcaactcaaataggcaaatggggccggtcccccctcaaggttgcggaccgtaaactttatatgatttcgcgcaaggcctcagcacggaaagccccataaagctctcccgggcgtgttttttgcaccttggtctgaagtgagacacaccgatgttcttttgtatcttgggaagacttttattgggctcggtacattgaagagcctctctacatgagagaacccatctacactggctctgcatatgcttccatgcttggggcattattttcctaccacaaggtcacctgggggcccctgggcaccccaagtgtcacacactctcacattgtatgttcaaaccctctagggccatgtgtagtaggccccattgaggtatcaggattcccatatgttgggccggaatggaagagtctcctattccgtccagttccctggacagctgtaataatctttgctctcctttttaatttgctttcaggggtcctgagtatagcgccccccggcaaggtaaacatagttagcaaggtctttgtccactgtagctgaaatttggcatatattaggcttctaaacactctcttaatcgctggctctcaaactctcacattgtgcctcccggagactagttct

SEQ ID NO: 611041 - DNA, 266 bp, Homo sapiens
ccccgggggggggggggggtttttttttctcccccccccccggttggaaaatttggggccccccccttagggtttttttgggggggggggggggccccctttgtttcccccccccttttgtgtccccggggccccctgggggtttttttggggggggccctttttttttgggtggggccccccccccccccccctgggggggggggccccttttttgggggggggggccccccccccccttttttttaagggggtttgggggttta

SEQ ID NO: 611042 - DNA, 210 bp, Homo sapiens
gtacttagggctacccagacacagatctcatccccacggaaggggtgaaggcctcgtccaaactccgatccaccagctctgcctgactccactgaagcaaaagccacacatcactgatggtcacatgcctctggctgagaccctgtcccacagcctggcaccacaagagtcatgctgcaccgtcatgccacgggtgtgggaccccgactc

SEQ ID NO: 611043 - DNA, 101 bp, Homo sapiens
cctcaaacgcttggattctacagcaacatattaccactgttccatccctgacccatctttctcgtttggaaattcggtccagtctaaaatcagaacgtcta

SEQ ID NO: 611044 - DNA, 171 bp, Homo sapiens
agcggactgccggaagacagagcacaggaagcagcagcaccaggtcacaggactgcacgttcacctttgacaccttggggaccaggaggacagcaggtccagaacctccagtgggtcctgcaactccaggagggcctccttcacctttctcacccgcagggcacgagagta

SEQ ID NO: 611045 - DNA, 152 bp, Homo sapiens
tattcctaggctgctgtagaagcactgaggtccccagacttcacaaaggaaggggaggaggggcaagcactgagcctaccaggtgctgcctgccccgtcctgcattcctgcaggaggtgggaagggagagaaaacggacattcgcgccatcc

SEQ ID NO: 611046 - DNA, 314 bp, Homo sapiens
tcgagcccgacgaaggcggcgccgaacaggccggtgaccgtcagccagagctgggtcttggagagatcgcccttctccatctccagcatggcgaagccataggtgatggaggagaacagcagcatcgacgtgttcgatcgccacgatcggcaggtcgaacgatggtccttgggcgagggccctgggcgcagtagttgcggccgagcactggcgtaggtggccgaacaggaccgcgaagcatgaggcaatctgctcatcatggtatgatccgagaagtccgagcaatcgtgctcccattccgggtgatgctctcc

SEQ ID NO: 611047 - DNA, 474 bp, Homo sapiens
tcttgggattatcggccggaagagaactgagccacccggatttcttgaagctcagagacccactgatagttgggtttgcttagaattcaaacttctttcattttagtggtgccaggactcgaacccttgcacatgctaagcaagcactctaccactcagctacatcctcagccctagaatttaaactctgtacagtcataattcaagaaatagtttgagagttttaacacaaattgggtcctgatctcgatgacagatgtgcctgacatatagactgctctttgcctgagaaagggcttaactaaaagtagttgctttcttttaaaattagatttttattttttaaaaaattggagtttacaacaatgaagaaattggatgtggtaatgtgttaattttgtcttcacccatattttggtgttagaacaagcgtatgttgtatgtgacattaaaacatttaaatgtaaaaaaaaa

SEQ ID NO: 611048 - DNA, 334 bp, Homo sapiens
catgtgattcctagaggatccccaggctctcactttcccacttggttttctccacttgaaaaagaaaagcacgagccgggcgcggtggctcacgcctgtaatcccgacaccttgggaggccgaggcgggtggatcacgaggtcaggagatccagaccatcctggctaacacggtgaaacccagtctctactaaaaataccaaaaattttgccaggtgtggtggcacatgcctgtaatcacagctacttgggaggctaaggcaggagaatcgcttgaacccagcaggcggaggttgcagtcagctgagattgtgccattgcactctggcctaggc

SEQ ID NO: 611049 - DNA, 306 bp, Homo sapiens
  misc_feature (115)..(115): n is a, c, g, or t
  misc_feature (133)..(133): n is a, c, g, or t
  misc_feature (159)..(159): n is a, c, g, or t
  misc_feature (161)..(161): n is a, c, g, or t
tttgtctctgctaaatacacaagattagccaggggtggtggcacatgcctgtggtcccaggtactttggaggttgagccagaagaatctccaggaggcggaggttgctgtgaacnaagatcgtgccattgcantccaggttgggcaacaagagtgaaantntgttccccccccccccaaaaaaagtaagggctctccattagggcccatagaggacttttaatatggaacctgaatccaaggatcccacaataagtggtcagtagttcatgatgaattaaaagactcaatatttggtcttcaccca

SEQ ID NO: 611050 - DNA, 229 bp, Homo sapiens
aataactatcctctgcctgactagacaatgatagtatactaaatagcttcaaagctgaagaatctaaatagtcgtctttgactcaagtaccaaataataataatagctatactataaattacttgtgaaaaacaacacattttaaagattacgtgctatcttggtacaggtataagtagaatgacagtttatacgtacatgctgttagtagtgcattctaaataaatat

SEQ ID NO: 611051 - DNA, 608 bp, Homo sapiens
  misc_feature (39)..(39): n is a, c, g, or t
  misc_feature (48)..(48): n is a, c, g, or t
tagaggatccccgtcaagaagcatcctgagtttactacncaaaccttnggctcacattcttgaaagaaagagcctagatgaccttgcagtgagtaacatactgctcagtaatatgcaccaaggattgtaaaggtcgctatgcttaaatgtgacaagttagagtgtgctgcctagaggtaatgaacaggaggtaaacagctttctcctactgtcaccttacaaatcagcacagaagttctgacatacacgaaagcaaatgtgccaaacaatcatttagaaaaggtgatatgagaggtcagggcggtggctcatgcctataatcccaatactttgggaggccaaggcgggcagatcacctgaggacaggagtttgagaccagcctgggcaacatggtgaaaccccgtctctactaaaaatacaaaaagtagctgggcatggtggtacgcgcctgtaatcccagctactcaggaggctgaggcagtagaatcgcttgaactcaggaggcagaggttgtaatgaaccgagatcacgccatttccattccagcctggacgacagagcaagagtctgtctcaaaaaaatataaaagtaataacatattgtatga

SEQ ID NO: 611052 - DNA, 1409 bp, Homo sapiens
  misc_feature (20)..(20): n is a, c, g, or t
  misc_feature (70)..(71): n is a, c, g, or t
  misc_feature (73)..(73): n is a, c, g, or t
  misc_feature (94)..(95): n is a, c, g, or t
  misc_feature (101)..(102): n is a, c, g, or t
  misc_feature (104)..(104): n is a, c, g, or t
  misc_feature (137)..(137): n is a, c, g, or t
  misc_feature (143)..(143): n is a, c, g, or t
  misc_feature (186)..(186): n is a, c, g, or t
  misc_feature (188)..(188): n is a, c, g, or t
  misc_feature (193)..(193): n is a, c, g, or t
  misc_feature (195)..(195): n is a, c, g, or t
  misc_feature (197)..(198): n is a, c, g, or t
  misc_feature (211)..(211): n is a, c, g, or t
  misc_feature (690)..(690): n is a, c, g, or t
  misc_feature (694)..(694): n is a, c, g, or t
  misc_feature (730)..(731): n is a, c, g, or t
  misc_feature (753)..(753): n is a, c, g, or t
  misc_feature (760)..(760): n is a, c, g, or t
  misc_feature (763)..(763): n is a, c, g, or t
acggtcagagcctccccatnagtcccggggtaaagcgacccattgaaaacagaaaactaattctacccanngncacgagaaatgaaacagaacnntataanngnaaaatacgggaccagaaatggtggcctccgcantaaccnaatcatcctaaatgtcctctaagagaccagacctccccagaantnacccntnanncacctattaccgntcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaagggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgacatattngctnttgctgtctatctgaatgccccagaattgtgaaacnnattcatgagtattcataggttnatggtantanagttatttgcacatgttccgtacaaccacaacaaccaccaccccccccccaacccaccgcacacacccacaccccaaaccaccaccccaacaacccaacacccccacgcacacacgcacagcaccgcccaaagcacgcagaacgaacaagcgagcacaacagtggcgcggcagccgggcgcgcacaggtcgagccgagcgaacgagcgaggacaccgacgaccagggcgagggcgacgcgacgcgcccccagcaccaacgccgcaacagcaccatgcacccacccacacgacacacacgaaaggagagacaacgaaaaccaacagaagggacgcgacgggcgagcaacactaacgagcgggggggcggaccaagagagaatgagacgacgaggaagaacaacaaaacgaaggaaggagaaggacagcagcaggcgccgcaaccggcaccagcagacagggaggaacgagacgcgcgaggcagcagacgagaccccggcgcgcgccgaggcggaagaaggagcgacccacccgacagaccgacacagaactaacgacagcacacagcagaacgcccgaccacgacgcccaacacggacgcacccgacaacgcagaaccccaggccgaggcgacgacacagcgagccc

SEQ ID NO: 611053 - DNA, 135 bp, Homo sapiens
gttgtgggatcttacccccgcagagggtggtaaagcaggaaataacagctacttctagagtactgaaatacgcatttgcaagctagtaataagtatactataagctaacactgtgaaaggttaaaacataacgct

SEQ ID NO: 611054 - DNA, 296 bp, Homo sapiens
agctgatctagagttatccccgctggattcactgagcttcattgaaatcttcaacgatatagccagctcctgctcgaagctgggattctgtatactgctatgcttgaaaggaggaatttccattaattcctcctcttcgtcactgcttcctgtaggaccatctggcagtctggagcggctggcctaccttgtcactggttgtggccaatgtaaggataaatgcgtatcccacaaacaaggtcttgttgagaggcacccgccctctctgctcttccaggtcagagcgttcaccattt

SEQ ID NO: 611055 - DNA, 1094 bp, Homo sapiens
  misc_feature (20)..(20): n is a, c, g, or t
  misc_feature (70)..(71): n is a, c, g, or t
  misc_feature (73)..(73): n is a, c, g, or t
  misc_feature (94)..(95): n is a, c, g, or t
  misc_feature (101)..(102): n is a, c, g, or t
  misc_feature (104)..(104): n is a, c, g, or t
  misc_feature (137)..(137): n is a, c, g, or t
  misc_feature (143)..(143): n is a, c, g, or t
  misc_feature (186)..(186): n is a, c, g, or t
  misc_feature (188)..(188): n is a, c, g, or t
  misc_feature (193)..(193): n is a, c, g, or t
  misc_feature (195)..(195): n is a, c, g, or t
  misc_feature (197)..(198): n is a, c, g, or t
  misc_feature (211)..(211): n is a, c, g, or t
acggtcagagcctccccatnagtcccggggtaaagcgacccattgaaaacagaaaactaattctacccanngncacgagaaatgaaacagaacnntataanngnaaaatacgggaccagaaatggtggcctccgcantaaccnaatcatcctaaatgtcctctaagagaccagacctccccagaantnacccntnanncacctattaccgntcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaagggaaatctccaaatccatgacagtcaaagtctctgagacagcatctccccaggttacctatgctggtccaaacacctggtttcaagaaatccttctgctgtgacctcccaaagtgctaggattaaaacatgacccaccatgctcagaaaaaaaaaaaaaaaaaaaaaaaaaaaaaaaaaaaccaaaaaacaaaacaaatataaaaaacataacaacaaaacaaaacaaaaacaaaaaaaaaaactaaaaaaaaagacacaacacaatctcataaaaactcacaaccagacaaacgcaataatcatcaatcagacacaacaacaaacatgacaactcatactgattcacggcacccaccaacacaccacaaaaacagtcataccaaatacaaaacatacactcaccacgtacagcacaacaataaaaaactaatataaacagtcaaccatactgtagacctacactcaagtataataactctaataacataactacaactgttcgtggaggatcatgacgcaacagactgagacgaaaggggagtgggggcgggtggcagcgacgcataagagaggctaacctagagtaacgaatcgagcgcgagcgctggtagatgagtgagacgaggagaatgagagtggagggagagaagggaagaaggagtgagatagatgataggcgcaacgccggtgcgtcggccggggggggg

SEQ ID NO: 611056 - DNA, 103 bp, Homo sapiens
ggcagtttttgcttctattggtcaagaattctttacaaaacccacacacacacatccacacacacacacacacacatgatgcctgcccttctgtcgtcttctc

SEQ ID NO: 611057 - DNA, 338 bp, Homo sapiens
agtctaagaaaatgaatgaatgaatgcatgctgaggtggatgtgataccagaaataaatatgtgccctactaaaattttttcaccgtattcccctacgttgttagtagtgctgcttatgcttatcatagaaaattagtcaagtacacaatttggaagagagtaacagtctattcttaccacaatccatcaatccactcttcttggttaagcgttgtctgtcattccttcatcttttttcctatgcttttttttaactttgccaaggctatactgtataccttcatttctccagtccaccctggtgggttggtgggttggttgattgggttgacgtcag

SEQ ID NO: 611058 - DNA, 386 bp, Homo sapiens
  misc_feature (52)..(52): n is a, c, g, or t
  misc_feature (54)..(54): n is a, c, g, or t
  misc_feature (56)..(56): n is a, c, g, or t
  misc_feature (100)..(100): n is a, c, g, or t
  misc_feature (102)..(102): n is a, c, g, or t
  misc_feature (260)..(260): n is a, c, g, or t
  misc_feature (356)..(356): n is a, c, g, or t
ggtggtagcccattggaggtcccgggagcgaagtccagctgccgttagctgngnantagtcgcacgctggatgcatctacgtccgccgagcccctggcanangaggccgcgtccgccttcagttgtggccggtgcttcgccccctgacccttcgcccccaaagaccagctctaacgttaatttggagtggccgcagagtcagtttcctacaccatccgaggccccacccagcacgagctacagcctccaccagggagggncctgggaaccctcagcctggcactttcctcaaccctcaggaagctcagcggtggggcagtcctagttccgaggttgccaccgtgggaaggacagantgggcagcaagagcaattcaccaccagctt

SEQ ID NO: 611059 - DNA, 147 bp, Homo sapiens
tgagagggttcacatgtgccaggtggtttgaactccttagctcaagtgattcacccaccttggtctcccaaagtgctagaattacaggcatgagccactgtgccgggccagttttaggtttttgttttgttttgtttttcagagaca

SEQ ID NO: 611060 - DNA, 181 bp, Homo sapiens
gaggaatgatcattctattccccctctattgatccccacctccaaatatctcatcaacaacctgacataagtcaccacccaacgaatgactaatcaaactaaccgtcaaaatcaaatgataacacatacacaaacacataaagagacgatacctgactctcttatatactatgtatcctct

SEQ ID NO: 611061 - DNA, 273 bp, Homo sapiens
  misc_feature (2)..(2): n is a, c, g, or t
gncgaccggggatacaggcgtgagcactgcgcacgctgggaagtttaattacttctgcattttccccagataaggacatttgcttctagattgcctgtttggatagtcatcgaggtggtatttatgctccttctgcaattcctcagataaggaataattgtctctaggagcctagttcagatgagtcaccaagtgattttgctctcctcagatctcagaccatattttaaactgtttcccaatttaactatctattgaaatccccgaggggta

SEQ ID NO: 611062 - DNA, 314 bp, Homo sapiens
gaggcaggaggattacttgagccagggaggtcgaggctgcagtgagctgtgatcacgtcactgcactccagcctgggtaacaaagtgagaccctggactcaaaataaaaaataaaaaaggatcatcatcgtgatgacaaaggaattacagggcagggggtaagattcatgtaccctctgaggccaaaccccttcttggagtccagggctgtctgttgctgaggatgacatcaaacctgggtgattcatcacccttaatctttctcggtgccagagcgggtcacaagctcttttgtgggatttgggtcagagcca

SEQ ID NO: 611063 - DNA, 363 bp, Homo sapiens
  misc_feature (122)..(122): n is a, c, g, or t
  misc_feature (155)..(155): n is a, c, g, or t
  misc_feature (188)..(188): n is a, c, g, or t
  misc_feature (191)..(191): n is a, c, g, or t
  misc_feature (236)..(236): n is a, c, g, or t
  misc_feature (244)..(244): n is a, c, g, or t
cagtctcatccaggtcactgcaaatgttgttaattcattcctttttatggctgcatatatatactacagtttctttatccactcattgattgattggcatttgggttggttccatgattttncaattgtgaattgtgctgctataaacatgtgtntgcaagtatctttttcgagtaatgacttctttnctnctgtgtagaaatccagtagttcgattgctggatcaaatggtagtnctactttnagttctttaaggaatctccacactgttttccatagtggctgtactagtttacattcccaccagcagtgtggaagtgttccctgttcaccacatctgcgccaacatctacttttaaaaaa

SEQ ID NO: 611064 - DNA, 903 bp, Homo sapiens
  misc_feature (163)..(163): n is a, c, g, or t
  misc_feature (175)..(175): n is a, c, g, or t
  misc_feature (180)..(180): n is a, c, g, or t
gcttcctggcgcacaaagatgaggagtggtgtcggtctaagtaccacccagatgaggtggggaagcgtcggcaggaggcccggggggccctgaaaaccgactgagggtcttcctgtccctcatggagactggctggttgataaccttctcctggacatagacnaagctgatgccntgtcnagatgctggatgcagccgtgacttcagatggaaggaggcacggagaatgatctccgcactcctggagcaggaggaggaggcggagcaggcaggaaagcctggggagcccagcaacgaacagaagaaggacgggctggagcacggcctaggggcacggggagcgcaaaagcaacgacacacggatgacgaacgcacggacacgacggcaagcaggctgagaatgacacgttctacactgatgacaagaacaacacgaacgtcggacgggtgatggggacccaggacccgcacgcaacgaacagaacgactcccgagaaggaaggccacaaacacggagtagcacgacagcggaaccggaacgcaccagggcgtgacgacagctttgccgagcgccacgcgtgtcaagagcctgcacgtcgggagtccagagcagccgggccaggctgcaggacgcagacaggcaggaggccgaaccaaccgctccaccaggaggagagggaagacagccccacgggaaacaaccacactggagacgaacgcgcaacgcgacgacacgcgggcgccagggacgtggaaaagaccgcgcgcagccgcgcatacgaacctggactcccacgccatacatgccgccacaacagcgccccaaaagcacccgcgggccggacaaccagcccacctccggtacagggggacccaggcaccacagccggggcgcgccaacga

SEQ ID NO: 611065 - DNA, 415 bp, Homo sapiens
tctcacgtctgtgtcactcaatcattaaatcctatcaattttacctcctgaacacttttctttcctaaatttttaaattttcttgtggagaggagtctcactatgttgcccaagctggccttgatttcctggcctcaagtgatccacccgccttggcctcccaaagtgctgggattacaggtgtaagccaccgcacccagccagtgggctctttcttatgagactttgtagacattccattagctgatttgttaaatgatcttcaaaatatttgcttgcatcaagtaaaggaaattggatggtagatatcccctgtatatagctctacctgcctccttccttcatcaaagactcaaaaagcggaatatgtctcctctgtaatccatttcaagaacacattaggtggtgatgggca

SEQ ID NO: 611066 - DNA, 349 bp, Homo sapiens
ggggggggggaaagggggggggctttttaggccccccctgggggccgttgtttggggccccccccccccctaaaggggggggggggggggtttacccgggggggggggggtcccccccccccccccgggggcgggggggggggaccccccccccccttgggccccgggggcctttggtcccggccccccctcaaacccggggcccaaggggggggggtgttttttcccccccgggcccccccccctgggggggggggggggggggcccccccccggggggccccccccccccggggggggggtttggttttttttttttaaaaggaaataaaaccgggggcctttttca

SEQ ID NO: 611067 - DNA, 1230 bp, Homo sapiens
  misc_feature (1153)..(1153): n is a, c, g, or t
gcatcggttaaagtctctcttcaccctgccgctccatgtctaagtcagagtctcctagaaggaggcccgaacagtcgtgaggaagctcttcacttggcagggttagagctttgagaacaacgtgagtgatgaggccgtgtagagagccgatttatagatgctagatgggcgaacagcgtccacggcacttgtgtgggtactcgcagtagatccaaacactccaagcgcctccaggggctttggcgtgttgtcacgactcatgccacgtgctggcaggaggtgggatagcagcttatggaatcgcagaggtcaaccaaacagagtgggatcggtcagcagttgctggaaccaaacagcagagctgtacatccaagaagcatagattctcgaaagtagcacgatgcccgacatatcaacctgtgaaaagagagcatcatttagtctgcgtggctaattgacagatagcaacactgaatcgaacatcaccctagatgaagattattgtgcgagagcaaggtattgcgcaataacactttgaaatcgtgatacgaaccgtcaatggcctggagcctcggaccagcaggtggctagagaagatagagaggtgcctattagaactctaatatgtttacacccatattgaacggaaaccagtgacatccgtgtgggacttagaaaaatttggccagtgccaagagtaggaaaccattgaactggtagcagatgggcccatcaggcgtgttgaaacgttacgacacaaggccccgggtgcaaaagctaaaggagatgggtaggtcgcgtgcaaacccatgggcaacagagggccaaagggggtccagggcaacagcagggccggggggcgaaggaccagaggcgccacaagtggcagacagacacactccgcacacgcgtggcgacacacccacagaccgaacaggagcatggcaccaccagagagtcagcctatttgtgcgtcgcgagaagcaaatgagcatggacagaattcacaaacgtcgcaggagtgataaagaagctggccgcacaccaggcggaatgaccacggacggagcaagaccaagcatgacgcagcaaacaatcacaagttctcctcctgtccatctgtacactcacactattctcctccatgcctacncgacgacgacaccacaacatacagaaaaaagagaacaaataaaagataacacaacgacagtgaaagaacaggtgaca

SEQ ID NO: 611068 - DNA, 1474 bp, Homo sapiens
gtgtctcccccaccaaacgtccgtgtgcggacgacgagaggctcatcgaccacttggttcacgacagaggtctcccccgagcatgtggtcgcttccctctcccccacgcgggggatatttttggggggggcggccgccctccatgtctggtccgaccaccaacgctgtgtttgtttgtaatcgacgaagctacttttttgtggggcggacagaaaacgagtgtggcgcgaccgaccagcgacagcgtcttgtggtgggcgcccgccctcgcccccaccagctctgttgtcttggctgttttgttgaaaaccgtgggttggatagaaaacccccaccaggggggggtatggtcgcccccccccaacaatgtggaagggggtagagataccccccccgggtggtgtgtaaaagaccccctctttgggggagaaaggagggatgaaagaagaagatcccccctggtggggggcccccaccaaccgctcgtctgctgctccagtgtgctccccaccacacaccaccccacacggggggttttataagtgtcccctccccccccctacgagcgcccctcttttttatctcacggggtctgctccccccacctctggtggcgacacttctcacagagggggggacaccccgctctgttgtttgtgtttctctccccccaagaggtggaccaccctcccgcgtgttaatcctactctctctcaccccccgcctctcacacacaaggggtctcctcccccctgtgagagaattgtgggggcgcaaccccctcctctcttcttctctctacgcgcaccccccacatatggggggccccccccccctctctctctttgtggtttctctctctccgcgctctaatattctccccatatctcgcgcgacgcatgctttcttttttgtagactcggagagaaatctttttatatttgtgcccccactctctgtcttatgtgtggctcccctatgagagccagaattatgttgtgtcttgtgagagcttctccacatgtggcacacacacaccctgtggggtgtaatatagtgggagacacacagccaccgcgttgttgtagtacccccgtgtggcgtggaacacacgtggccccacaaacacccacgggccatttctcccgcggcgcgcgccacacctcgtgccgccccacaccacgctttgtgggcttgtgatttttcaccccgcgtctcacatcatcacatctgtggtttctctcttttgtgacacacgctcttgttcgtgttgtccccataaggggtcgcgcagcttggggaccacaggtgcacacacgcacacacaccacgggggggttcacaccacaccctctctttttttttttttttttttttttttttttcctccctctaaagctcgtctgtgcacacacccacaaccacttggcgatcatcgcttttttttggaaattaaacccaccaatccacccca

SEQ ID NO: 611069 - DNA, 168 bp, Homo sapiens
ttctctgtctttctccttagattggaataatggtggaacaggcctggatgatccagaaatattagaaggaagaacttttaaatatgtggatacccatttggcaaggttaatatcctaacttgtggagacatgttttagttttcatttccctggctggcttgatttttg

SEQ ID NO: 611070 - DNA, 260 bp, Homo sapiens
ggggggcccccccccccagggggggggggggcgaaaaggggtaaattttaaagggcccccctttttttggaaattttttgggtttttttccccaattttttgggggggggggggggggcgtttgggtttttcccccccgggggaaaattttttttgggggggccggggggggaattttccccccccccccccccccgggggggggccccccttttttttattttccccccggggaaaaattgggaaaaggggttttttta

SEQ ID NO: 611071 - DNA, 489 bp, Homo sapiens
  misc_feature (288)..(288): n is a, c, g, or t
cagagagtacggactgatgggtcactgctgaaatctaccaaatatttacagaagaatgaataccaattcttctcaaggtataccaaaaaattgaagcaaagttaattcttctgaactcactctacaaggccagtataaccctgataccaaaaccagaaaaggaaaaacaaacaaaaaagaaaactacatgccagtgtccttgataaacatagacacaaaaattctgaacagaattctggcaaaccaaatccaacaacacatcaaaatgtaataaccatgatgaactgngattcaacccaggaatacaaggataatttaacatacgcaaatcaagggatgtcatacatcttagcaatagaatgaaggacaaaaaccataggatcatctcaatagaatcggaaaaagcatttgataaaattcaacatccattcgtgattaaaaaaaaaactctaggccaggggtgggggctctacgcctgtaatcccagca

SEQ ID NO: 611072 - DNA, 189 bp, Homo sapiens
gtgctcgccgtgcagatcggcgaaggcacaggaagcccagatcagacacagagcagacacagcgaaggccctgggatgccccagactgcagacacagggagcccagacgcagacagagcagacacggcgaaggccctgggggccccagacgcagacagagcagacacggtgaaggcacagggagcccag

SEQ ID NO: 611073 - DNA, 895 bp, Homo sapiens
agcgggggcgggcggagcctgggcccgcgggggtgctgcggggcgatcgggtccgggcgcggttgtcgtgccatgagactcacggtggtacagccttgagcttccagccctcattgaggtggccactcccaaaggtgcttggcagccgaaggaacggcctccagaactgtaccgatgtcttattatggagcacaagcgccgaacacggagcggtggtcacaggtcagtcgtcatccttcatatgctccactcgcggtgctctgagaggtgacctatgaatacctgggtacatgcctggatgactacacatgcagagcttgcagacgtcattcagactcagatcatgaggacgaggagaggcatcgtgggggatggggagaccaaggaaaccctttcgcatgactgggtgcaagtattctgtgccaagtgtgaccgtgcgtggaggacgaaagggccaagtcgtgatgatcgtccacaactggcccaggatagtccaacgagttgacggccaggatgcaagggtcctggttcctgattttgcatgtctgggcaaagaggcgctgggagagggcaaaaccgatacgggatagcagcctgctgtcttgaagatggacacgggcgtgacgacttgcttgcgcattgtgccatcgtggcgcgtgacttccgtgattctggaattgcacttgagtgcccgggaggacactgtgcatgtcgcttgaggcatttttcaccgctcgggacctccaatggttgaaagggttgccccatatggcagagcaaacatggagtaagaggccttgatcgattgcatagaggggctcaatgcgaccatgttagcaggactttttggtaccttggaattgtctaggattgaacgctgccattcggattgcag

SEQ ID NO: 611074 - DNA, 966 bp, Homo sapiens
aggaaacaggagctttgtcctataaccctggttagtagcagctgtacgctcggaatcagggatcaattagtgtctggtgcagctattgaatgtgcaatgtgtcacgtatcgtgtattacacgctacaacataactcatttgtaacccatggtataagctggtatttacaaatataacacagacctttaaacttttccttgaatacaaaatgtcatgcatggtcttagctgcatcaactttccatttaagtcaggactgcaatactgattccagttaatgagcgctaagatccaatctgtctaatacagtgaccccctagccatccgggcctggcaatatacaacttttttttcccctccagtttgtaaacactccccttccagaaaggattgtgcaacacaggattatttttaaagtgattctgaaatttgaattacactttttggagaattctgatgatgcccttagaagaaattggacacgtattgagtgtcacaaagctggggctgggaattgctggtctaatgtttcattagacttaagaaacctaaaatttctcagtgggtggataaaaaccacctaacgcttagaaactgttttctcatgcagatatgtttctcttatttatgcctgaggactaatttctggttgctagctgtaatgcactgttgaccttccataatggtgccttcacgccagcgattccctactgtgggggtcacatacagggatgttggggcgatgcatgactgaatcacggctctgataacaaacgggcaggcacaaggatcaaagaataatacagcaaagaaaaatcacaaaaagtaccatccaccaaaagacgcaaaaggtaaacatccctgaacagtgtcagatagtcaaaacaaaggaaaagaaaaggacagtacaaaagggcaaaacggaaaacggacacaacgaacaacacagaagacaaagaaaacaaga

SEQ ID NO: 611075 - DNA, 748 bp, Homo sapiens
agcggagcggtgcacaagaagagaccgaggagggtggacccgagagagccagggcatggaggccaacatgccgaagcggaaggagcctggcaggtctctccgcatcaaagtcatctccatgggcaacgccgaagtggggaaaagctgtattatacaagcgatactgtgagacacaagattcgtgtctaaatacctggcaacaattggaattgactatggagtcacaaaggtacacgtcagagacagagaaatcaaagttaacatctttgatatggctggacatcccttctatctatgaggttacgaaatgagttatatacaaggacacacagggtgtgatactggtctatgatgttgggcagaaagactcctttgacgacccttgatgcgtggactggacagaaatgaagcaagagcttggacctcatggaaaacatggaaaatattatataagtagtaagtgccaaacaagattagatagtaccaaaaaatcgctcgtgtagatgacagtgaaggacgtcttgggctgaaagcaaagggttcctgatactatgaacacattcagcacaaaactggagaaagcactacacgagatgtccagaacatataatactatccataggaagaataacagagacacatggcgggaaaaagcacaaacaaacaaaagcaaggcaagaaaccccaagaacaagcagaagccaaagaagaaaacgaaaagaaaaaaagagggacaagcgggagaaaa

SEQ ID NO: 611076 - DNA, 372 bp, Homo sapiens
  misc_feature (101)..(101): n is a, c, g, or t
  misc_feature (154)..(154): n is a, c, g, or t
  misc_feature (272)..(272): n is a, c, g, or t
  misc_feature (371)..(371): n is a, c, g, or t
aaggttgtggtgagcccagatcgtgccattgcactccatcctgggcaacaagagtgaaattccccatctcaaaaacaaagagataggtagagctggccgtnggtggctcacgcctgtaatcccagaaggctgagttcggtggatcacttgagancgggagtttgggactagcctggccagcatggtgaaaccccatctctgctaaaaaaaaaaaaaaaaaatacaggaattggtcgggcatggtggcaggcatctgtagtcgcagctacttnggaggctgaggcaggagaatcgcttgaaccccggaggcagaggttgcagtgagttgagatcgcgtcactgcagtccaacgacagagtgagactctgtcnc

SEQ ID NO: 611077 - DNA, 797 bp, Homo sapiens
  misc_feature (592)..(592): n is a, c, g, or t
  misc_feature (774)..(774): n is a, c, g, or t
gtaaatgagagtaaaacttatctcaaaggctagcaaaatgatcctgaagtctaactcaggcaatgaggacagtaattcattagaaattaactgttcttggcatgtcacagtcttgtcagcttgaatgttaatctctaaggaaatgacagttattacctgtgctttattgttgatactggacaagatcctcaagtgacacttctgtctgtggatactacatgctaccagtacaggcccggctccattctttgcccccgtttacacacacacaagaacaacaacaacacagaacactctcattctctctgtgtctcttttctcaaagggtgtgacaagaggttcattatacgccactgtgttgtgtctcagggtgtgacaggctaagtggacggggatcaaaaaaagaaggagtgacttaagggcagggaggaagaaccagagaaatatatctcgttaaaagttggaggtgagcaattttaaaaaaaatattttgagccatttaaaaaaaaactttacatgtgggcaaataatttataagttgacaagaaaagtggccgcagaatacgtcaccaaaattaggtgtgttatatcncccttgacaccctcgggaatttacagggcgtgacgcccacttcatggtgggagagtctctttcacccgggaccggcaattatcaactaatgcggggggccccaacggggggagatcccgtggatttccataaaaccccttcgggtgtggaaccaaacgggggggacggggaggagaagtganagtttgcctttctcccactaata

SEQ ID NO: 611078 - DNA, 723 bp, Homo sapiens
ccttctgcaagccatctatctctgctcactctccaattgacccgcctggaaacaagggatgaggaggagtagggggctgggagggaatcctgccagttggtgaacgccctgtggcaggaaggtatatgtggacatagagtatacctgattctcttctcttcagccactgactgcttgtggttgggctgtgaatgataatggaatggctggatgtctgctgtttgtcagaaggcagaggagggtgatgaagtgactgacccacatggcactgggatgtgtgtcgcgtatatgtggcatgatctgctacgttcactctcagtgtgtgatctgggtgcatacatggagttcattgtcctgttgcttacttactgcaatgtcttatggccctccttttcaacttggttcctctgttggtgcccaaaggttgggagtaggagacagttatcccatggctgacaacgtgtgcttgccctttaccttggtgcaccttgtcaaattttatgcctgtgtccttccccacctttgcccctcccaagtggttggtattgtggtgaagcccatctcatgttcctgtgacttcatgtctcaaaccaagtttgagcgtctggtctctgctatgatggtggaatccgacgcctttccctgcccactctggtgcttgcccacattgaccggacattggtttcttgacccttttccttcctctttcttgtgcgcagctga

SEQ ID NO: 611079 - DNA, 207 bp, Homo sapiens
gcgtatgaaagaatcacatcaatagacaaatcaaacattaaaaaaaagtatagcacctctccgttcctaccacggcctggactgtagccatttctgccttggagatttagtaacaaccgttctgcatcgatgtgctagttgagggaatcagtgcccagaaagggcaagacatctgcggaaagtcacacagcttaggaagcagaggag

SEQ ID NO: 611080 - DNA, 307 bp, Homo sapiens
gaccttaggagctgtttgataaactaaattgactttaagcaagtagcaggactcctctattattattattttttatgagacaaagtctcgttctgttgcccaggctagtatgcaggggtgtgatctcagctcacagcaacctctgcctcccaggttaaaaccattttcatgcctcagccccctacagtagctgggtttataggcatgcaccaccacacctggctaatttttttatttttagtagagatgggatttcgccacattggccaggctagtctcaaactcctggcctcaagcgatccgcctg

SEQ ID NO: 611081 - DNA, 184 bp, Homo sapiens
tgtgacatgtcatataccactgacatgttcatatatcgctgagatgtgcatatagcgctgacatgtccatataccgcatgtacatgttcatataccactgacatgtcatataccactgaaatgttagctgtcatagcatgtccccgagaattagatgtgaaccccagcgagaggctggcatgca

SEQ ID NO: 611082 - DNA, 753 bp, Homo sapiens
atcatactagccggcttcggcgaggggctactcccccaaatccttcagcgcccccggtctggcggttacaggcatgaccaacacaaagcttatagactcttactcttctttttatgctactcatgcctagcacccactatcgacggcgcacccccactatatcacgcttacacactctaccctccggggagcggtgaatcaccccagaccatcgttttctcaggccgcgccacttgcttttttcccttacacctaagaacgaagttatactaatatcctgagtacgaagacaacacccattatatccttgcacttctcttcttactctatttatctatatcctgttcaccacttcgcccccccctccttcctgactcctcgcctatcccccacataatacttcttcatttcctccctatagtccccagccccagaaacattccgcatcgagccccgcgccctatatttgtccgccctttttcatcttcgggctcgctctcctcctgcgcccttaaccagatacgacacccgcgacatagaacacaatcgttgactatcggaacgattagcataagcccctaaagtattcaacttaactttactcgttcacgacgccacctgcacaacacgttcttgcacacgatcaccacccactccacggcattacatccgcactattctcctctccgccccgtatacctccaaccgcctcatgcacaccagacggttttggttttataggatacatgtaag

SEQ ID NO: 611083 - DNA, 315 bp, Homo sapiens
acttattctttcattttaaaaaaaaactgttttgaattgacacataactgtgcatatttatgggatttagtgtaatgttttgatatatgtatatgttgtataatgatcaaatctgggtcattatcatatccatcacctcaaacatttatcatttctttgtggtgagaaccttcaaaatctcccttagctattttgaagtctatggcacattattgttaactatagtcactctgctgtgcagtagaacaccagaacttattcctcctatataactataactctgtgcttgttgaccaaccttttattctccctact

SEQ ID NO: 611084 - DNA, 402 bp, Homo sapiens
ccgtgcctcctggtggggctgctgatgaaatcctcgggaaggtgccagtacggtccgcgctcgcggctcttgcctaagaaaccgtggctctggctgctgttggtgaggagtcctggaggttcccagagcctcgggcaccgagggggagaccctgacactgtcctgcctgccccaccagtttgctccccgcagctcctcgtcctcacccgagtgctgctggagggttggcaggaggcgtgaccagcagggtccagcacagtcagggtttcctggggggtccaggaaacaggatgagctgctgtgtggcagctcatggtcagctcggtctgaaggcctccctggggacacacaggcagcgaggtccaggctccctctccctcccccagggtgacagagccaatg

SEQ ID NO: 611085 - DNA, 355 bp, Homo sapiens
gtttacgaaagaagtggtgtctcccggtgtacaatatgatccatagcctcagcctcctgagtagctgggattataggcacacgccaccatgcttgggtaatatttgtatttatagtggagatagagtactccatattggtcaagctggtcttgaacccttgacctcaggtcatccaaccgcctcgaccttccaaaacgctggatttacaggcttgagccacgcgtccgacctgaagtggtatatattagaaagtaactaaaccttttttcagtttaatgacccagggatttatttctgaagggaattgggagcgatccttttaagggcaacaagggagaaaaccaactcttaaga

SEQ ID NO: 611086 - DNA, 244 bp, Homo sapiens
tttgagctcggtacccctgacgaagtattttcaatcgggcgtgtacaaacacccacattatttatgatttatcaaagacataaggatattcttaacttcaaagaagaaacattctatgaacttacagggaactttgaggctgaaagtggctcgtataaaggaaaagcaaagattaagaccacttctaaagatgaaatagacagcctatataatgataatcaattaagcagcgctactaacggag

SEQ ID NO: 611087 - DNA, 119 bp, Homo sapiens
gggacttacctgggtgtcccccgcatgcctgtaccccagatgggtgggggccgctttgcccatcctgctctcctccagctgagggaccctggtgggggtggctccttctcactgctgga

SEQ ID NO: 611088 - DNA, 140 bp, Homo sapiens
ggtcgattagaggatccccagttctggtcccccactttgtagatgtactgaagttttggtctccctgggagtgggtggaggcaggcaggacttacctgtacactgacttgagaccagttgaataaagagtgcacacgctt

SEQ ID NO: 611089 - DNA, 406 bp, Homo sapiens
acaacacactctgctcgggtgcacaggttatgtgcttctgcacgcgggcttagagggataacaatgagagggtgccttgagaagcgctgcggatatagtgactgaggccaggtccctgccgcggaaggcaacccagttcacagagtggcaagctcagtgccagccagtgcaagcaacaggcagttctttgatcctgccttagtcacagcaaacatttagccagcctggctcttctccatagccagcaggttgcctgctcatccagtctgtccctggtcagcgggcatgtgctcaaggagaacaaacacagttcagcacaggactcagctgagggtcactaaaggatcatagactgtgagggtgggaggtcttggtttagaggttgagtctagtgcagctgatcacc

SEQ ID NO: 611090 - DNA, 564 bp, Homo sapiens
cctgtccaaaaggccgtggaagggggagattctattttaaccccaaaaagtttttttttcggagggatttttttggcccttttaccactccggccaggcccccaccccccaattagggggggtggggcccccaagagggatcccccggttaattccctaggaagtccccttcctaaacacatcggttttattggcatcgggggtttcaatcccctgggctccccaaagtttaaaagaaaccccccgaacccaaataattcaagcccgggttattacaattttagggggttttttttttccccccccacaagcctaaaagtatttggggtttcccttccccatttccggggggatttaggggtcaacattttttgaacccacaggtttcccgggatttcaggtcataatggggccaactttccccccaattggtttcaccccccaaaaaaattttccttttaaatccaaacatcctttgggttttgaaccccccccctaaaacgggcattttgtaaatggggtttgacaatttttgtatgtccccctttattgatgggggtttta

SEQ ID NO: 611091 - DNA, 238 bp, Homo sapiens
ggacccctatcataatgaggccccggcggctgtgcttagcatgtagaaaataagcttgcttctgcttatctcagagaacaaatattgcccatcatggccaccgctgcgggaagctctgcagactcctaagtaacttatactaggtcactttgattccttagacgacaagagaccagtattgcggcccactatctgtccttaagatgcccgcctctagattacccttctttggcccatt

SEQ ID NO: 611092 - DNA, 150 bp, Homo sapiens
cttgaagaggagaaaaggaaggttgaggaccttcagttccgggttgaagaagaatcaattaccaaaggtgatcttgagcaaaagagccatatttctgaagatcctgagaatgtggctacagtttcagaaaagtcacgtataatggaactg

SEQ ID NO: 611093 - DNA, 778 bp, Homo sapiens
  misc_feature (449)..(449): n is a, c, g, or t
agcgggaatctccaggacaatggggacccgggacgatgagtacgattacctattcaaagtggtgcgtactatcgtggactcgaggtcgtgggcaagagcaatctgcttgtcgcgcttctacccgctaacgagttctaacctgtgtaggagcaagaagcaaccagtcaggcgtggagtatctgccgacccaagcaatgcgatccaggtggcacggcatatacctatcacagtgcgcagatctggtgacaccgttggccaggaggcgctagcgcttccttcaaccatccgcagtaactagcacgttgagtagcaagtgaggtgctcttgtattggatgtagcggagattcgtcgcgaatgcatccgtagaactactagagaaccgttggaagcagcgtggcttgacgggagcttgaagggaccaacgcagaatgggtaacattcgtcagtnctatgcatagggtggcgcaaagtgaaggaggtgaccttgcgcactaggattgctggggcttgatgcgccaattgaaccgaagcgcccctggggcccattcggctggccagggaagaaactaagctttcgtcgctctcagagtcggagtagcccttccgagcccgttggaagtatcgcgcatagaccgttaagagggacatgcgctttcaaaggaagagcatcccttgacgaaagaggattttacctggcagtgtcgttgttcagcgggtacattcagaattcgcctaacctgcggctgccactacggacgaagttcccgcgggggaacc

SEQ ID NO: 611094 - DNA, 103 bp, Homo sapiens
tgagctgctgcctggcaaccctctggagacatgttgtaaaccttcagaaatgatgcagagattttagacatcagaagacattggatggaaaagcaaatcttga

SEQ ID NO: 611095 - DNA, 250 bp, Homo sapiens
tgcagacagtcactatagacatgcagcgagctgaaatgttcttcgtttatggatcattgaagccaagaccttgcccctaaaagaaatattctgcgaactgtgccttgatgatacccctcttttgctcgtacaaccagcaagaccaaaaggccaagaccaaattaatttttccttggggggccggaacattttgaattcttcagccttccacctcttcatagtatcacagttcacatttacaaggatgtgg

SEQ ID NO: 611096 - DNA, 340 bp, Homo sapiens
gacaccctgaatttatcacagatcagccatgaaatgaatgcctaattcaaataatggtcaacgagaaatctacagagtacacgaagagaataatagtgagtatgaagcaggcataaaaatggataggggggtcgggaaggggcataaggcccaaactactattaggcaatcacttgagcatcgttaatttcattcatttcatactgcacctcattttcaacaatggacatgaaactttcaaccaaaaacaccaacaccaacgccagtaatctcacacccacaaatcaactcacaagcaatgataaggtggcagcacaaaaggcaagggcatcacacagca

SEQ ID NO: 611097 - DNA, 161 bp, Homo sapiens
tccctcctctccttcttccccttcatctccctcctctccatcctcggccgctccttcttcttcctcctcagccccgttctcctcctcctccaccacttctttctctcgctctttccggcttgccttctcctccaccttctccttttactccttcaggtcct

SEQ ID NO: 611098 - DNA, 107 bp, Homo sapiens
catgtggtagctgtttgcctcaatgtaccttctccaacaccattgagggactcctcttcacgtggctgcgtgttgcgtggtcatagctattgcctctgtctagtagt

SEQ ID NO: 611099 - DNA, 412 bp, Homo sapiens
cccgcccactgggatttggattgctgcttggaccagtacaatgacaggatctgtgccattctagacatccctagatacaagagtcggatccagaccggtccatctgctcttttccgtctactgagaattcaagaactcacagcattttaaagctctcgctgatggcgagaccgcatccactccttcctccaattgcacctcccaagctggagacatggagacattaaccttcagctgagacacttcccatgctgctgttacaaggctgagctggcccctctgccccagctgagatggacagatcgttggcagctacttgatgtccttgcccatgccacagcttgactcaggggcagtgcatgtcctgctgccctctctgccagagggcacagaacatgtttgtttaatgaac

SEQ ID NO: 611100 - DNA, 601 bp, Homo sapiens
  misc_feature (17)..(17): n is a, c, g, or t
  misc_feature (335)..(335): n is a, c, g, or t
  misc_feature (342)..(342): n is a, c, g, or t
  misc_feature (395)..(395): n is a, c, g, or t
  misc_feature (534)..(534): n is a, c, g, or t
  misc_feature (543)..(543): n is a, c, g, or t
  misc_feature (590)..(590): n is a, c, g, or t
tatctttcctgagctcngaggtctgtacacacaatggaattttcatttgacctctaaatacttggccacaccctgacttacctgggcaacaaaggcaggaccattatctgacactattgcttttggcactccgaaccttggaaaattttctttaacaatcttcttgatgactatctgatcagtctcgttttacaaggaaaagcttttatctatcttgagaacgttcacaaaaatccagaaggtatttatacacatattttttcagtaaagtctatttttcagtagatgtcaggtctgtcttctcatgagaggactagttttctttcttcagtttntactatnttatacagggtttcttttaccagtcttaatttgtctataacttgatagtcttnagactgtcaggatcattgctctttaggatgcctgggcggttagatttgccatctgatttcttttagccacagcatcttaggtctttctctgcagatgtctatatatagagcttgtattaaagccacaagtttagctttntgggctgangtccctttagggaggctgctggcctagatcacttgctttctgtccancactgcactgc

SEQ ID NO: 611101 - DNA, 474 bp, Homo sapiens
ggcatgagctctcaaatcagtggctcttgggtgcaaggcagcaggcgacaagctcacttgggaagagtcttggacttacagcttctcccccactgaaacactatacactggggccacagttcatggcaaacaacacacacaaacacacactctctcacagtcaaacacacatctcaacaagttggcggcaggtagctcagggtatcatagggtctggcatacgcccactcggcatctaagcttgtcctccacgctcttcccagttcacttccctgctgtaacctgggccgtgtggtagaggcctccagcttctcactctgacacgctgatcgtacaaggcaacagtgtgacaaagtcccctcatgggattggccgtcgattgacagcaggacggctacaggggcccgcagctgccaaggaagctgtaaacgtcctctgctcggctcaagaacatcaagattggatcaggtcagc

SEQ ID NO: 611102 - DNA, 314 bp, Homo sapiens
cctatggcacaacaagggtggcagccaggacaacctttagaactcaaaccgacgataattaccgcagggagacgaaacacttattggggtggtgaaggcggaggctacgtaggaagtggagatggctggggccttcaagaagggccacgtcgaggtgaaggagaccgtagccgcttcaagcagtttgacttccctagcaccaccgccgatttcattggagagcaaaagtacaatcaatccttgattgacgcggagtacagcgcacggtccgcaaccctcactactgaaactgaaggcgttacggggtaccgagc

SEQ ID NO: 611103 - DNA, 952 bp, Homo sapiens
tgttgttgctggcagaccgagtagtcattaaacagataataacatcaagaaataaggttctcgcaattatggaaagactagagaaagtgaatagcttcaagagttggtccaaatattcagtcaattctgggacaatgaaatggtggagttggcacatctgagtggagatagaccaaacatgatttgcaagatgacacagaaaacggcaaaaatggcagcagctagggcagttcttgaaaaagtgtcacaatgatgcttctcacagcttcaacgacatgtctgaggcatcctaactgcgaatcagcccataaaaaacaaagaaggagtattgacccgtatgaaacgtggcatgggataaaggtcatgtgacaactggtgacctgcctgtaaccccgaatggagagactggacatttcatctatcagtattttaactgacataaggaattcacagatgaatattgaagctcttcgggaaaactccttcatttccagttccaaagagaacttctgtgacatggaacgtcatcttgagcgtatggacggcttcatgattctgctacacagcatgagccacagaagacccgcattcttgaaactgtcaaacttcaggcgacgaactggactgcagcgaaggaaactctgtgggatacaaaggccacagacaagaaaccaaaaacgcatccggggacagaactggaactcaagcatcggaaatccagcaccggctacagactacgaacaactcccacagacacggaaacagggacgcgatcatacaaccaggtggcacggggtcaaaggctcaactcggaggaaagcaatacaccgggggcacccggcatcctgacacagactggacccggggcacatctgcacccggaacggcacgcggacaggagacacaatcgggagaggacaacaaccattgggccaacacccatcggcgactc

SEQ ID NO: 611104 - DNA, 246 bp, Homo sapiens
gagatctggagtcaagcttaggcccctgtcgtagtgggaccatattagggagcatctagaattttgagaggcttaggctaaggttacagcccacaagtaagatttagtttcctctaggccagagaaagagatattttctctagcattttttaggggagagtcccgagaaaccgctcactcagaatggaaaaaacactcctcgggcattagaggtgaagattctcaaggaaagcagcgctgttggct

SEQ ID NO: 611105 - DNA, 488 bp, Homo sapiens
cctcggcgcctagcaattccttacatagcacttacgccaggaaggtctccatctgcagtcatagagtcatttcaagtatatcgatatatgttatcaacttgactgacaccatgtcagaggaatttataggggggtacaaaagcatcaagatgatttacaggatgtaacagggagagctgtcgagattggtgttaaaaagtttatgattacaggtggaaatctacaagacagtaaagatgcactgcatttggcacaaacaaatcatatgtttttcagtacagctggatgtcatcctacaagatgtggtaaatttgaaaagactaaaccctgatctttacttaaaggagttgctaaatcttgatgagaacaataaggggacagttgtggcagtaggagaatgtggacttgattttgactgactgcacttatgtcccaaagatacccaactcaaatactgtgaaaaacagtttcggaagttgctaggcggg

SEQ ID NO: 611106 - DNA, 467 bp, Homo sapiens
agactctcctcctcactgcggagtctggtccgcgctcctgcagttctgaggaagctcggcagcgaagtcgtgtgtccttcatgcgctgaggtcctcgatttctttctccagacggaggatctcttccacctgcttattttccttctgtctctccagtacacgggtcagtacagcttccttcgggctcttcggcaaggcttcgagttctagcgtgttcctcgtatcttctatcctgcggggcgcggagctcgggttctctacgctctctctctctattctctatcttcttcctccggtttcttcttttcttcctcttccggtttcttcttttcttctggctcccttttctcggccagcaatggtctgtaaactctcggagcaatctgacctctgagttgcttcggaaaaactatggctgcctttttcaggtgcaaaaatctcctcctcagaaggcatgctctgtaatt

SEQ ID NO: 611107 - DNA, 377 bp, Homo sapiens
gggaggccgaggcgggaggatcattgagctcaggagttggaaaccagtctggacaacatagggagaccccatctctaccggaggaaaaaaaaaaggagtcaggcctggtgggtggtggcgcctggtaatcccagctactcgggaggctgaggcaggacgattacttggagctggggaaatcacggtggcagtggagctatgatggtggtgggccacattccattcctgggtcacagagtgaggacctgtgtctcaaaaaggtaaccatagggaacaaaagaagcctggttttagcacaggtttgaggccagaagccaggatctaaattggtggctggtcttaatgcggaattttaagggcgatgggcagggtggcac

SEQ ID NO: 611108 - DNA, 903 bp, Homo sapiens
gggcagtgggggtggggggtcttctttaaacaggcccccttcccatctacctagccagtacccatccaatgagtccccagagcctccagaagctgctgtctcctctctggggacagcagctcctgccttggaggccaaagccccagatctctccagccccagagctgaaaacaccaagtgcctatttgagggtgtctgtctggagacttagagttgtcatgtgtgtgtgtgtgtttggttaatgtgggtttatgggttttctttctttttttttttttttttttagagtcttaaatttagggggaagggagggcctcccatgtgtgcaagaaacgggggtcttaataagattttcataagggttttccccaatgattgtcggaaattgcggagtgttgcctgaagttgccccaggactcacacacccgttcccatctcactgggcccacccaggggtgacaaccctgcgggggggatataccccgcggcgggactcagtgctcttccccacccccactttgctataaaggctaggccctagaatacgacttctcgtggtggcaaaactccggctaaggtctcgtgttccacctggaggtcgacctcatcttcatgtaacaaggggcggggcgactgctcggaaagacatggccccgacaagaaccaccgtctttccaatctttctcgggacaagaagcccgggggggcgagaccctaacgcaaggcttagaggaaaagactcgacctacgcaaccatcggaaacataagggcgccggcgggcgtccacaacaaaatataccacaacaatcacaacacacacacaacaagcaatacatatcacaccacaacacacagaggggggggcgcaaaaaaaccatcccggggacacacatcccaccacg

SEQ ID NO: 611109 - DNA, 940 bp, Homo sapiens
agcggggaggcggatcgacgcgtggcgcccgagggtatccaatggcctggacctggctgcgcaggcgctgacccgacctggcggtgatgctgggcgctggccttggcttggacgaggccttaaccccgcctgggcggacctggcccctgcttgcgagttggaggccggcgggccgggggttggggcctactcggggccgaactgcgaatgggaccgccctctatggaagggcgaccaccgctgggcggcctggtcttgtcctcccttcgcgccttctgacctgcaccaaacctccggaatgcgctggcgcgttacgcactaatccgaaggacggacaccttaactccacagggcgctacacacagctctctaccggacctaaccaggcacatacacagcgcacatcggcgtctggctctacctcacacccggaacacttggacaaccactcacaaccttgggcacacaacgtaacctcctcacccgagaaggacaaacagaccaatcacaaccagcttgaccttgccacactcaccgcacacactgtaccccaccacctggggcaaataccctataaaggaccacagcggcgtaaagctcggcgcgttctcgcgccttagcacagaagaccaacaccacggcaccccaagtaacctccgttcggacacaccacttctaactaacgccctagacactccacaacaggcccgggaaaacgcgcgacctcggcagccaccgacgcaaagacaaagaggcccaccccacccaaagcagaatcgaggccgcaaacaatacccgacgaaaacactaagtaaggagccgcaaacaaactgcaccacaactcccaacattataccgcgagatggcacgggcgtaccgcgaaggccacaagagcaccagaacgcacacagacaacaagaatagcagacgagtaaagaac

SEQ ID NO: 611110 - DNA, 130 bp, Homo sapiens
catgaaccatcacctgacaggaaacaatgtttcacaaaagaagcctacaagaagtattcatcacagattacatgaaatcagtcaaagggaaacttgaagaatagagatcagaaagagtaaaatcttttat

SEQ ID NO: 611111 - DNA, 424 bp, Homo sapiens
gggttaatttaatggggtaaaaggtatactggtaaataaaatagctgcaaacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattgggccccccttgccccaaaacattttaaacttgaaaaaatttttttatgggccccaaattggggccaatttggcaaaatcccccaaaaggggggggtaaaaaaaaaaaagggcccgcttttaaaaacactcaaaagggaaaaaccctggggttccccaaaaaaaaccctttgaaaaaaaaccccttttcgccagggggggaaaaaaca

SEQ ID NO: 611112 - DNA, 111 bp, Homo sapiens
acctaaatggcgtactgaaagctaagttcaaaccacccttgcgtacaaaggagtacaggtacacatcaacaccaatcacccagcaccccacagccatttagataacagcca

SEQ ID NO: 611113 - DNA, 144 bp, Homo sapiens
aggcaaggtgactcgttgttcactttgcttggaacagggaatggccatatgtgcaattatataccagttcatgggcgcgtagccaatgatttgtctggtatagtcaggggactctagaaggacactatgacttggaaaacctgg

SEQ ID NO: 611114 - DNA, 131 bp, Homo sapiens
gaggatccggggacacgggcatcattatacgttagcgtgtatctacctggcttacatgcacagtgaggcacagcacctttccttaaacttatttatgacacagagacctgtgctcccgctgtcccacctct

SEQ ID NO: 611115 - DNA, 471 bp, Homo sapiens
gcgaattcactagtgattgtgagctgagatcgcacccggtccaagcactggctttgagataagcaatattaaaaacattttcagcttcatcagatgctgactaactgacctccaaccactgttccaccagccataactacagctttgattggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttatatgttgcatgcatgtttgttcaatatgcatgtgtcagaaccactttcatgaatattcatagctcctcatgtaacctgttgaatgtgtatgtttagtccatccattgagcatgaagctccttacctaacccctcc

SEQ ID NO: 611116 - DNA, 1143 bp, Homo sapiens
cactggaagacgtgcttcgtggctgctcagcaactgggatcctctaccagtaccctggacctgcacctgacgtcatccctctgctctcgtgtgaacatgggtggtgtgtgagcagtgctggtggctgcctggatgagccaacaccacggatctggccccacgccttccagtgtcattctctcctgacctgtgccctgcctgtgagctaatgtgcctgagagctgatgtgccgagatggccgagctggatgcacgcatctctgccagtgctgtgtccaaagtggtgtcatcccccagggctgtagctccacagcccctgcataccctgctgcctggctcctcacggatgacctgcctctttacgtgccatgaggattgccagaccagcttcttccgcatctttgggcacagcccaacctggcgcgacatcagcgcctgtctccaccgagcctgggcaaggagtactgcgtcttggagttctcccaggacagccagcagctcctccctgcctgggtcatctacctgagctgcacttctgaactggaccgattgctgtctgcactgaactctgggtggaaaagcatctatcaggtggactcccccacacaggcgatccaggaagcctccaacaagcagacaatcggaggatgccttgcagcctcatccacaggcctggcagcggagcgaaggtctctgccgcggctgagcctcgcgatgaccctggtgctgcctgcagagctggtggcgtccctggtgtgctcggcatcgaccgccggcacctggcaggcacacatggtaaggctgttgtgccttgctgccaagaagccataaggccaacccttagccttgtagtcggagaaaccccccaagatgtgggcataaagcatagggtccctccatccaggagtccaagcaacatgtgccagcgaccccttgacattcttgcgacaacggagacacatgacgattgcggtcaagagactcaaccaatatgcgctatgagagcaccaacactaatgccgcagcagcgaacgactcctcgggcagcgagacattcagaaggacacacacggcgccccactccttattgcggtcgatgcaagcatgctatcatcaacagatcgagacgcgacaacatgcaagg

SEQ ID NO: 611117 - DNA, 954 bp, Homo sapiens
  misc_feature (278)..(278): n is a, c, g, or t
cctgatttcttcccggcgcaacaatttcccaggccgttttcccttgcctttttgggccccataggaaaagtgtgccaagaccggcgtggtcccgctcccggactccgcggaattttctcgctcccccccctctgggaaaattccgggttgctccacgggagcccggcaaacgcccgggggtttgacccggcgttcccccgaacgtttcgcatcccaccccgccagctctggtggcctccttcgtggaatgccacacttctccgcggggtgaccccccnccccctggggttctcctcttcttctctgcgccgagaagagcctcccctcccgtcttgtgtgacgatgccggcgccccttgccgaagagaaaggaagagaaaccccggtgtgttatcctattttacgaactctgccttccgcgagaataactctttccggcgcccctcttgtgggaggacccgcaacactgccagttgtggtccgcagggccccctatatacctgctccggcctctttcggggcaccccccttcttcggccccccgaagccctctcttctgttggctgtttgtttgggcttcccatcccccgaccgacacctggtgtctagcttccgtgtgcccctgtagtttcactgctgctctttcttggggccccccccccggagaccacaagtgttttgtaagatgtggctgttgtgtagccctgtggcgcatgttcccccaggagagaagggccccctgttgccaccttccccggcccttctcatgaagaccaggatttctatctcacccccacccgaggggagctctttccctggagcacaaggaggacccctcattctaccccaccaaacttgttttatttccccggaaaaccaaccccaaccctggggacctttttgccggtagggtgggccccccccggctttttggaaaaaaaaccttcttcccgga

SEQ ID NO: 611118 - DNA, 946 bp, Homo sapiens
agatatcaccgtgcctccctcctactgtatgatgcgatgagtgataatgagtgtgctttcaagtcggtttactactcatactgtgcacccgatactgatgaatgctggcgccatcgaccttcttgtcgagcgacatcccttgaacagtgtaatggtggagaatcgcgagaacccaaactcgagcgcgcctccaggggatactttgaccacgtggtgctccggggatcttccggaatggcggaataatggagaaggtctctctgcttctgatggacatggtggggtaccgtgataccagggatggatccggacgtccaagttacaaatacgcggagttaaaatacaggggagcccttttcgtgaagacagttttgctacaaagtgaggggagaataaggcaagtaaacattgaaggagtgtacatctttggagaaaatcaatctgtcatatgaatgtgatcggaagttgatgcatttatataataccggatcgtagtatgaaagcggaaaagatgagtaagacttcgtatgacacggggcatcttatccagaacaaaatgatttttgtaggtttgaagcaagatcaacactgtaactatttgtttgaggacttgggggggcagaactgccgcactaattgtcgtgctcttgtgaaaacgtctcatgccggacctgttgcgtccacttggacaatcgaggagaagcgagctggaaaaggggcgtacgaaggcgataggtacctgttgaatgaggaagccaactgtggatatctttccacatccttttgtccgaaacaatggcgtgatggcgatttgcgataccccatttactcttcaagcgtccgcctagcatcaaggtgcgcccttcaccattgtgcccattccagttaacggagacaccttgcactcttccgaaaacacgataaacgcgctgacttgagaagcgag

SEQ ID NO: 611119 - DNA, 182 bp, Homo sapiens
ttttcttcagccaagcactctgcattctctctactcaatatatatatattttttgagacagagtctcactctgtcaccctggctggatggcagtggcacaatcttggctcaatgcaacctccgcctcctgggttcaagcaattctcatgccttagagtagctgtgattacagatgtgcacca

SEQ ID NO: 611120 - DNA, 363 bp, Homo sapiens
aagttgattcttgagtatacccgtctctctttgatcctcttgaggcattcccagatggaagtatcaaatataagagaagagcacgcaattgcccatgcccttagctggagtaagtctgtgtgttgcctccagtctcgtctcatggcattgctgggactggcacttaagtggcagctgcctcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgat

SEQ ID NO: 611121 - DNA, 777 bp, Homo sapiens
tcttggccaggggcggagggccatgtaacaaccccaagcccgaacgctagagagcaataggttgaacttctaaggtgaccagttgttccagcgcaataagaagagcaccgctttactctgatatcatccgacgatggagtctatcgagctctatcagctgtttctgggggagggatgcccgcctccatatcaagtgctgaaacagagaaaagccttgtagcccacaatcgacctataccatattcataacacctcattatgatgcatgccactgtgatcattaactgagaacccatgcattgtgactcaaaatgaaaatgcggctactagagccggcttatcctgcttgcagaactcactctccacagatatctgacaccaacttctcgtacgtgtgtgctatccctctaaacaagcttgtgcaaaaaaatcaaactttttggtcacttataacaaagagagccagagtgctgcacctctaactatcgcctatatctattgagatatcactggtaccgaccgcaatccttttcaaaagacattctctttactaaacgcaggagttttctgccggtaaaacgtgagtaaaacaaacagaatacacctgctctcgcgcataggaaaggataaaaaagactcaaacatccttttgacccagacccaataaaaactaaattgacgcgattagcaatatattaagggatgttaaaggtaagcaactacttttgtgcccccgggcgccggaaatacccaagtttagcaccctttaaaagccta

SEQ ID NO: 611122 - DNA, 859 bp, Homo sapiens
  misc_feature (10)..(10): n is a, c, g, or t
  misc_feature (67)..(67): n is a, c, g, or t
  misc_feature (70)..(70): n is a, c, g, or t
  misc_feature (89)..(89): n is a, c, g, or t
  misc_feature (118)..(118): n is a, c, g, or t
  misc_feature (149)..(149): n is a, c, g, or t
  misc_feature (152)..(152): n is a, c, g, or t
  misc_feature (164)..(165): n is a, c, g, or t
  misc_feature (168)..(168): n is a, c, g, or t
  misc_feature (171)..(171): n is a, c, g, or t
  misc_feature (200)..(200): n is a, c, g, or t
  misc_feature (205)..(206): n is a, c, g, or t
  misc_feature (243)..(243): n is a, c, g, or t
  misc_feature (270)..(270): n is a, c, g, or t
  misc_feature (279)..(279): n is a, c, g, or t
  misc_feature (289)..(289): n is a, c, g, or t
  misc_feature (293)..(293): n is a, c, g, or t
  misc_feature (320)..(320): n is a, c, g, or t
  misc_feature (344)..(344): n is a, c, g, or t
  misc_feature (351)..(351): n is a, c, g, or t
  misc_feature (376)..(376): n is a, c, g, or t
  misc_feature (401)..(401): n is a, c, g, or t
  misc_feature (424)..(424): n is a, c, g, or t
  misc_feature (426)..(426): n is a, c, g, or t
  misc_feature (431)..(431): n is a, c, g, or t
  misc_feature (467)..(467): n is a, c, g, or t
  misc_feature (479)..(479): n is a, c, g, or t
  misc_feature (489)..(489): n is a, c, g, or t
  misc_feature (572)..(572): n is a, c, g, or t
  misc_feature (608)..(608): n is a, c, g, or t
  misc_feature (618)..(618): n is a, c, g, or t
  misc_feature (620)..(620): n is a, c, g, or t
  misc_feature (627)..(627): n is a, c, g, or t
  misc_feature (667)..(667): n is a, c, g, or t
  misc_feature (726)..(726): n is a, c, g, or t
  misc_feature (792)..(792): n is a, c, g, or t
  misc_feature (824)..(824): n is a, c, g, or t
caggcctggnaacctgaggtgtagagcacccagaaggaagggtaaaagcagggggcaaagcgggggnccncccgggcgggggggcacgncggggggggggccagcggaaaccgggggncaaggagcgggcagggggggccacacccgangcngggcaaaagggnngcnggnaagggcgggcccagggggggcccaccggnccagnnagggaggggagcagggggaggagggcacaggggggcnagggcggggggggaggggcagggaggnagggggggntaggcaaagnggcncaggacaaggggcaggcggagggcagngggagagggaccgaggcaggggcncgcaagngaagggggagagggggaaacaaggngggcgcgaaacagggaagcgggcangggggcagggagggggcgggggncnaaggngggggggaaggggggggggggggaagggctggcctncaggggaggggnagaaggaggngggggggggaggggaaggcggggcagagcaggggaaggagtgaaagccaggcaggaaagtggaagaacaggagaagctcatgnaatggattaccctccacaggattatgttccttgatncctgagagtntnttctctngattttaccccctcagtctatcactgcaagagaaagaggnagaaaagacaaacagaccacaaaagacaagaacccagacatatagacagacgcacctgntgcatgtgcatgagccagagcctggggagagaagagagagcgtgcaagagagagctcagagcaggnaggcagcccaccccctgcagcagtgctgggcntcactggagcccctgcaggaagtccagcagccctg

SEQ ID NO: 611123 - DNA, 1076 bp, Homo sapiens
  misc_feature (54)..(54): n is a, c, g, or t
  misc_feature (357)..(357): n is a, c, g, or t
  misc_feature (404)..(404): n is a, c, g, or t
tccgggagcaacctttttcctgcttttgttaacgtaaccttgcgagttgtacgntcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcnataagttatgtttttaaattgagggcattattatgaaaaaaataccntgcgtgatgatgcgaggtggaacctcgaggggcgcgttcctgttagcggaacatttacccgaagatcaaacgcagcgcgataaaatattgatggcaattatgggttccggtacgatctggaaattgacggtattggcggcggtaatccactgaccagtaaagtcgccattattagccgtttccagcgatccgcgtgctgatgtcgattatctgtttgcgcaggtaatcgttacatgagcaacgtgtcgataccacgcctaactgcggcaatatgctgtctggtgttgggcattcgccattgaaaatggttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatcta

SEQ ID NO: 611124 - DNA, 104 bp, Homo sapiens
caactctatggaatatgacatttccatttgcctcattgctacttcaagctctttaaatcaccatcttccctatttctgcgagtggtattgccatcctttacatt

SEQ ID NO: 611125 - DNA, 315 bp, Homo sapiens
  misc_feature (171)..(171): n is a, c, g, or t
cattacaaatattttactcatatatctttaaagttaaagactaagggctgggtgtggtggctcatgcctgtaatctcagcactctgggagaccaaggcgggtggatcatttgaggccaggagtttgagccagcctggccaccatgtctactacaaatacaaaaattggccnaggcgtggcagtgcgtacttgtaatcccagcttcttgggaggctgaggcatgggaatcacttgaacccaggaggcagaggttgcagtgggccaagatcatgccactgcactccagcctgggcgacagaatgactcccatctcca

SEQ ID NO: 611126 - DNA, 887 bp, Homo sapiens
agcggagacctaagagtgtgcgactagacccgcgggtgacaaactgggactggggccaacagtcctgggtagccgcggtgctgcaaagcgcaccatggcccgcccagggcgccgcgcagcacggccttgggggttctgcagaggccttcgggttgcgcgtctcgtcctctagcccatggcgtgtccgcagcgcttggctgatcctgggcctggtgctgtgcctggtgtgctgggggggtctgatcctggcgtgcgggctgcccatctggcgggtgaccgctcttcctggaccagctaatcgatctctgacggctgctgatcctaccttggagccgggctgtggagtgtcgtgctgtggtgcatgagcacctgggcacattgctgtgctgctggtgtacgacctcggtagcttggctctgatgctctcgaggtgccgtgccggcagcggtgcgctcttccgtagagctgccgtgactgctgtgcgttacgtttgcgctcattcgttgacccctggctgggctgcgcaagtgtcaccacctgctgtgcgcccacgtggcccgtgcctacgcgtcgctggtgtgcgtccctcacgagggaggccgtgcgtctaccatggtacttgcggagctcgctaggcgcgctcgttgccacctcttgactggcttctgccaatctattgtccgtcccgcgaagttttacccgacccgtcttgtgccccgtggtcgcaagacagtaccgaatgctgggctgcagcgccttgtacagtcgggctgcggcgtggccaccgctgcctgcttccatgtgtaggcgagctgcactcttggtgctgcgggcgcctgaggtctgcaccggccgtcccgtactcagcttccccgtggaagtactca

SEQ ID NO: 611127 - DNA, 395 bp, Homo sapiens
tccaatctcaccctctttccactcgccacactcaagtaaaccacagtatccattgctccctttttttctgtgttcatgtgtactcaatgtttagctcccgcttttaagtgagaacacgcagtatttgattttctgttcctgcgttaccttgcttagaataatgccctccagctccatgaatgttgctgcaaagaatatgattttattcattttattaacagcatagtatgccatggtgcatatttaccacatttcctttatctagagactcttgttgggcatctagattgattctatggctttgctattgtaaattgtgccgcaatgaatataatgcgcatgtctctataggatagaattatttatatttctttgggtatatacacaggaattgg

SEQ ID NO: 611128 - DNA, 612 bp, Homo sapiens
gtctctaactcccagcctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtggaaaaaaaaaaaaaggccctcccaggccagaaacagaggagggcagtcgtggtttcaattaagagaccctgtggggtcctttgggggtgggtcctggatttaagagacttcacttggaggatccaggtggctctttggacgctggggtctcaggtccccttcccattggtccgtgggcgcctctggcgcggccacctgggtgttcaccacttggtgggtgagtccactcggtaggagggacttgggtataaagacactctcacaactctcgcggggggccctacagccaggggggtcttatctcccagaaagaggggcccaaagagaagagcggagtgccgcggggaacacccccaagcgtttccgcacagggctcccgatcacgcggggactggggggaaagccg

SEQ ID NO: 611129 - DNA, 1091 bp, Homo sapiens
  misc_feature (798)..(798): n is a, c, g, or t
tctcaccagttttgatgatgaccattttaagaaaagcttgtgtggctctctcctatcatttacagacctccagaagctggaaaatttgatgcttttactgaactcttcctgaaggtttaatactggagtgggaactcagttttggtcctaattatattagaagaaaggcttccctcttctcgtactcctttgttgcaaacccatctcgtggatagctagaaaaggaacttcagaaatgtggcactatattgtgatgcaccacctgtgttatgcactctaggcctctaatcgtgtcctctatttaatggtgggtgacatatattcgtcagaagttacttacccctttcgtgagttagctacatattattctccatattgccagattttctttaacagctcttcgggagtgcgtgccctttttaaacatttgtgggtcgtatatttgtaaacgccctctttgaggtataacgggggttgcagggtgaccttttcctatagaattctcataccagttagcgcagtttggggccatgtgttatagcgtgcaacgggaaacactgtggtgaattccccatattttcccacctccattccataccattatcagtggcatttgggggatccccatttgggtctcctattcctcatttgacggctttccccaggacatttcagaaatttctagatataggaacgggtccactgttcataaatcgtcgtgggacccttggtacttttacactcatccctccggttcccctatctcttccgtttaaccgacattattttgtaggggtnaaaatccctgaacagactgatagtgtagtcttgaaaaggttaaatctataggggtcacgcttcgtataatatatcccgtggtgacgacccatttcgttgtacaaggggcccaattgtgggtggttcttgttaactggcaggcccgtatgtgttgtatattagcgggaggaaatagcgcgccaaggaagtgtgttcttccacaaaagtggctctgcagagattacaaggggtgttcttgaaaacggtttaattgtaacagcgggatattttgaaaggaaaacccttacaacttc

SEQ ID NO: 611130 - DNA, 464 bp, Homo sapiens
  misc_feature (7)..(7): n is a, c, g, or t
  misc_feature (175)..(175): n is a, c, g, or t
  misc_feature (215)..(215): n is a, c, g, or t
  misc_feature (409)..(409): n is a, c, g, or t
  misc_feature (421)..(421): n is a, c, g, or t
tgcccanttaacttttttaatgggtcccaaaattccgtggacaaatttttgggtcaagttgtcctcccattaaaaagtactggattttaaaaacctaataacttaaaactgccacacgcaaaaaagaaaaccaaagtgggtccaccattctcctttccttctgaaggtttacgangcatgttatcataaccatctttactactaaacttaaaggncaatgaaacaaacagttctgagaccgtcttccaccactgataagagtggggtggcagtattagggataatatcattagccttctgagcttctgggcagacttggtgacctgccagctccagcagccttctgtccacggcttgatgacacccaccgcaactgtcgtctcatatcacgaacagcaaagcgacccgngggatagtctgngagctcccacacacagggctgccaggaaccatttcactggcgc

SEQ ID NO: 611131 - DNA, 251 bp, Homo sapiens
gttattccgtgcttgtctgactctagcaggatccgtaggaggctgcagtgcactccagcctgggcaacaagagtgaaactctgtctcaaaaagaaagaaagaagtgaaagaaagctctggcagtcagcgtgtaagtaaatagccaggcacgtgtggctcacacctagtaatcccatgcgcttgtgggagtgctgaggcagcaggctggatcacttagagtccgaggagttcacagacctagccatggtgca

SEQ ID NO: 611132 - DNA, 223 bp, Homo sapiens
caagcacagagcgaaccagccacagggcatggaaagctccaaatccatgacagacaaagtcactgacaggatataaccctgaattctactagttcctccaattccatttactcccatggaatcacgaagagcaagatccacgctgttccagaagccctataagctggaggtggacaactcgatgtaaatttcatgggacaacccttgtacctgactagagtgg

SEQ ID NO: 611133 - DNA, 186 bp, Homo sapiens
atttctgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccccttctgtcgtcttctcg

SEQ ID NO: 611134 - DNA, 498 bp, Homo sapiens
gaatatgctgtctcacgctgaagctggagtgaaatgcacaggcgcgatcccacgtactgatccagcacgggagttcgagctgctccgtttccgaactgggacaggttctcccctccttaggcaacctggtggtcccccgctcacgggagctaccatattgatgccgaacttagtgcggacaccgatcggcatagcgcactacagcccagaactcctgggctcacgcgatcctcccacctcagcctcccgagtcgctggcattacaggcatgaaccaccatacccaaccatttctttactcatagatataccttcaagttttcacagtgctttcatatttgtgttacacttacaacaagacattatgagggggtcaggagtaattactgtctccactttatggcccaggaaagctcacacagcgacttggtgtcacgtggtctctgtgggcccaggaaagctcacacagtgccttggtgtcacacggcctctgtacctc

SEQ ID NO: 611135 - DNA, 153 bp, Homo sapiens
  misc_feature (23)..(25): n is a, c, g, or t
cccctaaaagccaaaatggggannnaaaagactcctatcaaccttgtgcgtcattggacacgtggattcgggcaagtcccccactactggccatctgcttctgtaaatgcggtggctcggacaagaaacccttgaaaaatttgggaggcggcc

SEQ ID NO: 611136 - DNA, 107 bp, Homo sapiens
tgcactgtagatcgctccatcttgtaaaataaaataagctggttgtcatggcacatgcgctgtaatcatagctactgtaatcccagctacttgagaggctggcatgg

SEQ ID NO: 611137 - DNA, 1040 bp, Homo sapiens
gggtccctcagtactacagcttgcgttcaccaggcctggctggttgcctgactctgtagcctaccatgctgatgatgcgcaagctgtacaatggcgagccaatgggccgcctagtgtgggtcatagtgcaattccggggacctggagttggctgtggcattgagtcctgtgtcctttgatgttgcagtacctgccgcatggatcttcttcaaccaataaatgggtaagcgacggtggagcatctactcatcagtgcccatgatccccagatggactgttcccagccagatgggcatgctcttccctgggtcgacggaggttgcgagcatgcatctcaatgcttgagctggagtccgtcgatggacgacagcgtcgagtgatggtggacagtctaccgacgcgattgaataggggccaggcataacatacatgtcagacgtcttggtggagaacttcgtgccttgggagtttacatatcagcgcgacatgcggcgagtacaagcacttcagttgcgatcgattggctgtggttgtgccctaggggccacttggttgacaccaaattcagtcgctccgtcgctagggcgacgtacctctccgacgcgtggaccgattcagatggtcatcccgtggaaggacgcaaatctgctaacaatttggggcgcatgactttgtcttggggcaacgcgaaccgacggaccttatttcgcctctaaagtataacaagggccaacctcttgggcctacgttcatcccacccatgaggtttctggcgaggaaatttacttccactggccagcaacggaatcgtcgtgaaacgcaacatcgtttccctattgctcgccacgtgtactcgtttgcgtagtgaacccaccatgttcgagggttccaccactcctggcttaagcacgaccgcgacgccaacaatccattggccgccttgagtagcgtactggtcaatagtttcccccccccgggcgtaatcataacccatttgtggggcaaacagcaaggacaggcgggaacacaagccgtacctc

SEQ ID NO: 611138 - DNA, 327 bp, Homo sapiens
tagcaagaccccatcttaacaacaacaaaaaaggcaaaagacatgaacaaacacctcaccaaagaagatacacatatggcaaacaagcatatgaaaaggtgttcagcatcataaatgtgtacaaacccatagaatgtacaacaccaagagtgaacccttacgtaaactgggttttgggtgataatgatgtgtcagtgtaaattcattgattgtaacaattgtgccactgtagtggggatgttgatagtggcggaaggttgggtgtgggggcagggactgcttcagtttctgttgatccgcccgcgaatttagtagtagtagtcgacc

SEQ ID NO: 611139 - DNA, 580 bp, Homo sapiens
ggggcagtgatgcgactggcgtgtgccgcgcggcgcatttccgactctggcgaatggctcgtctgtagtgcactgcctgtgtggcccagctgcgaccccgtgtcccggcccctggtgtacccctgtgactatgtgaccgaacgtgttccaccgctcgatcgttgccctgtgcaaatgacgcctatgccacaatgagaccaatccatggtgaccaccagtaattgatgagatgcatcgagtttgcagcaagacgcgaatgcaagactggtaggcattgctgctatcctgactacaacagtgcagcaggtggctgcatcctgctggtgcagacaatcctcagtgacgatgagtgcagcaccagcatagccagccaagaaccgcacacccgagacgatacaatgactcgacttgtgcgtcacatcatgtgaccacatgtggtcagcatgttgctgacgagtcgtcacacgtgagatacagcgctaatgtgtcctcgctcgcgtacaccctgagcgcgtcacacgccgcgatcgtaggcatttgataagtgcaaaatgggaccgtgacactgagagaacgtaga

SEQ ID NO: 611140 - DNA, 232 bp, Homo sapiens
  misc_feature (54)..(54): n is a, c, g, or t
  misc_feature (65)..(65): n is a, c, g, or t
  misc_feature (83)..(83): n is a, c, g, or t
  misc_feature (96)..(96): n is a, c, g, or t
  misc_feature (109)..(109): n is a, c, g, or t
  misc_feature (112)..(112): n is a, c, g, or t
  misc_feature (117)..(117): n is a, c, g, or t
  misc_feature (122)..(122): n is a, c, g, or t
  misc_feature (130)..(130): n is a, c, g, or t
  misc_feature (147)..(147): n is a, c, g, or t
  misc_feature (150)..(150): n is a, c, g, or t
  misc_feature (202)..(202): n is a, c, g, or t
  misc_feature (218)..(218): n is a, c, g, or t
acgcattttaatctacctttgtcttaatttacagcaggttttgtatgaattttnaaccttttaanaaactcaccaaatctggntgatgcctttganagtaatgaaaacnatnaaacnaaaanaaaataanaaaaaaaacggcttttnaanttataaaaaaaatgaaaaaacgaagggaaaaaaaggggaattgaaaaaagancagaaaaaaaaatcanccgcaacaagaaat

SEQ ID NO: 611141 - DNA, 288 bp, Homo sapiens
  misc_feature (56)..(56): n is a, c, g, or t
cctgacggctgttacctcgatgaaagctgaagacctgatcaaaaatgaccaacgantgcctgagcgtctgttcaccccgatacgccacccagtgctacacgtctagccttgcaaaaatattgccaaggagatcagcgaaacctcctatacctatctgctgtgccgagctggccgaaagttcgctgagttcggaaattctaggccgtccaggcgccaatatcagcctggtcaggatcgagatagaggaggtcatgctcgaagccgatgtgatcaaggtaaagaccgtcg

SEQ ID NO: 611142 - DNA, 208 bp, Homo sapiens
taacatatgctgatgatctcagaccaatctgacaccatcgcgaatcggctcttcaatagcagtgcgacagtgtgaaggtgaatttccacccggagttctctacctccgcaagcccactgctcgctgtggactatgaggagtttgtccgtggctgtcagctatggcagtcttcccctcctactatgagccttggaggctacacaccggc

SEQ ID NO: 611143 - DNA, 308 bp, Homo sapiens
ggcacgaggtcttgtgatataatccaaaaaaaaaattgactacaagttagcactcagaggagaaggagtaagggtaccacaagcagaggaacaatatgtgtacggccacaggagtagacagcacagtgaggacacacctgaggactgaacacattgtaatggaggagagtacagactctgcaactagactgcctggattcaatccttgcctgccgcgataattagctgtgtagccctatctggtcatttggctctgggccaaagttttctcattaataaaagaaagaatattggtgtctcccacaaaa

SEQ ID NO: 611144 - DNA, 285 bp, Homo sapiens
  misc_feature (43)..(43): n is a, c, g, or t
  misc_feature (63)..(63): n is a, c, g, or t
  misc_feature (270)..(270): n is a, c, g, or t
aataataattaaatttatagaaagccgagaggaaattgctagnttattcctggtagaggaatntctgtatttgaaaattctccagaaggaataatataaactgtggactttgggtgataatgatatgtaggttcgtcagttgttaacaaatgtatctctctgttgggggctattgataatggggaaggctgtgcatgtgtgggagtaggaggtgtatgggacatctctgtaccttctaatcaattttgctatgaacttaaaactgctctnaaaataaagtttatt

SEQ ID NO: 611145 - DNA, 450 bp, Homo sapiens
  misc_feature (159)..(159): n is a, c, g, or t
  misc_feature (162)..(162): n is a, c, g, or t
  misc_feature (165)..(165): n is a, c, g, or t
  misc_feature (177)..(177): n is a, c, g, or t
tacatggcaataatctcattaaaagtatataaataaaaagacaattgattaaaacaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaanaanaaaaaaaaaaanaaaaaaaaaaaaaaaaaaaaaaaaaataaaaaaaaataattttaaaaaaatattaatttgaaaaaattttataaaaaacaaaaattaatactttttaaaaaatattaatttttaaaaactattgaggtttaaaaacttaggggctcactaaataaaacctaataataataaaattactttttaagccaaaatgggtatttatggagtcgaattattaatttattatattctgcataaaatttataaaaaaacaattaatttttataaatttta

SEQ ID NO: 611146 - DNA, 538 bp, Homo sapiens
tcctagcaggatctcttttgcggtgcctttactcttcatactctctcttcttcttcctcttggggaggccccggcagagccggctcagagggggtgcctattcttttgcacctccataggaaggggctctcaacctccaaggtggtacctccttctcctctccttcagagttatctgcctccttgtgacgtttaggagagtctccagcaagtcccctgctctcctcttaaacgctcctttctcgtacttctccttggctggctcatcaatgaccagcttcccttcctcgtcgcttgctgccctctgtataccccttcttatcaccgtcaacctctgtagcttcgggcctctggttcaggctcttccacacagctctttttctgggaggactgatagccgggaagccttgacagtagggttgttctcgatctcccacagaccctcgctgaaccctttcctcttgttgggctatccaaacttctccttggattcctcgtaagggaagaggtctttggggcccaggaaagtgggagaaggg

SEQ ID NO: 611147 - DNA, 432 bp, Homo sapiens
  misc_feature (159)..(159): n is a, c, g, or t
  misc_feature (162)..(162): n is a, c, g, or t
  misc_feature (165)..(165): n is a, c, g, or t
  misc_feature (177)..(177): n is a, c, g, or t
tacatggcaataatctcattaaaagtatataaataaaaagacaattgattaaaacaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaanaanaaaaaaaaaaanaaaaattaaatttggcaaattaacctaatagggaagtcttttaaaaattaattggaacgaggtttaaaaagtacaaaaacgggaaaaaccctgagtttaccaaattaaattgccttgtagaacatacccttttaggaaaaaacctattagcaaaaagaccatgaccgttcgcctttataaaaatttgcacaccttgattgaaaattgaaaattgaaagcgtaaatattttgtaaaaatttgggttaaatttttgt

SEQ ID NO: 611148 - DNA, 223 bp, Homo sapiens
gcatctgagagtgtaattttcagctgtttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaacccagtctctactaaaaatacaaaaattagctaggcatgatggcgcat

SEQ ID NO: 611149 - DNA, 946 bp, Homo sapiens
  misc_feature (18)..(18): n is a, c, g, or t
  misc_feature (61)..(61): n is a, c, g, or t
  misc_feature (102)..(102): n is a, c, g, or t
  misc_feature (106)..(106): n is a, c, g, or t
  misc_feature (113)..(114): n is a, c, g, or t
  misc_feature (129)..(129): n is a, c, g, or t
  misc_feature (142)..(142): n is a, c, g, or t
  misc_feature (155)..(155): n is a, c, g, or t
  misc_feature (157)..(157): n is a, c, g, or t
  misc_feature (169)..(169): n is a, c, g, or t
  misc_feature (179)..(179): n is a, c, g, or t
  misc_feature (184)..(184): n is a, c, g, or t
  misc_feature (188)..(188): n is a, c, g, or t
  misc_feature (226)..(226): n is a, c, g, or t
  misc_feature (239)..(239): n is a, c, g, or t
  misc_feature (303)..(303): n is a, c, g, or t
  misc_feature (320)..(320): n is a, c, g, or t
  misc_feature (327)..(327): n is a, c, g, or t
  misc_feature (387)..(388): n is a, c, g, or t
  misc_feature (438)..(438): n is a, c, g, or t
  misc_feature (499)..(499): n is a, c, g, or t
  misc_feature (505)..(505): n is a, c, g, or t
  misc_feature (525)..(525): n is a, c, g, or t
  misc_feature (783)..(783): n is a, c, g, or t
  misc_feature (785)..(785): n is a, c, g, or t
  misc_feature (898)..(898): n is a, c, g, or t
tttatatatgttgtaaanaaaagtgtagaaatagtgaatgattaaagtgtgtgtgagaaantaggttgggaggaaaccagcatgtggtccttttggtgtganccancccatcnnggaggtggtcgggtntgggtggatgtgntgggcagtgagtntntcgctcggtaantgtttggttntgaanattntctcgcttcaggaactgatgaggttctcttcttttgantgatggagattanaaaactcttggattctctgaattatacttctgtaggctaacgtgggtggggaatctggggggtnaatgaaaaaagactggnctttgtnacaattcttacctatgaggggatccagggggactctgccgaggagagggacctgcaagtnntggcacatgaggtccgcgcgcccggttgtgggagggaatatctgagattntttgttggacttaggagagatgaagccactgatgttctccaccaccccgatgatggggagnttgacnttgggggagaagttgatttntttccggacattctggagtgtgatctcctggggagtggtgatgatcactgctccatcgatgtgtgctgtggccaggtaccggacgaccgagaggtgttcatccgacgtcccaggtggggtgtccacaatgaggtagtcgacctctccccagtccacatctcggaggaactgcttgatcatgccgtttttcttgggtcccctccagataacagcatcatcaggactgctgagcaggaagcccactgacatcacccccangnttgtcttccacgtacactggagaccagcctgagccactctggtgaacctgctctccttccaatcccattatcttgggaatcgatggcccacatatatcgatgtctagaagagnaatctgtgtgttttcatcctctgctaggccatgggcaaggtgggcgct

SEQ ID NO: 611150 - DNA, 753 bp, Homo sapiens
atagcaaagatgagagctggtagacacgactctgggctcacttcaatagagaaaatgtttcagcctataacctcaaatatctcttcattcgtaagagcacacatgtcagacatcgtggatggtcacttagctgagcatggatcccttacaataatattgtccgtactgcaatagacagcaattggcagtcagatatttgggacgggactcacgtctttgcacagcaaagttcttattgatgaaggctttgggtttgccaatctgtgaaaagtgctcgaattgccaggaacacacaaatcatcattcaagaagaatctgggattcccagagtggctgatccttggggcaggttcttcacatgatgcgaatgtctcagcaaatgatgttctatgatgctgctttacaagctcattacatgaacattgacagaacatgggtggacatggccaaagctgtagcatgagggcaatacctaaacttcgaattgaagaatgtgctgcccgaagaacaaggctacgcaatacgcacttctggctgcgtgacacgtaccatcgttggacgtagactaacgtagccagttggcacaaaacgaaggcacgctggtagaaagctactggcccacttgcacctaataaccttacagttgctgaaaaccaggaccagaatttgacaaaacacctttcaagcacgcatctacaataccaagccaggcgcattcacaaccctccgggctgaaagcgttgacctaggctg

SEQ ID NO: 611151 - DNA, 208 bp, Homo sapiens
tcaccatacctggtgggtgcgggggtcccctaagcaggtgggctgtggctggggggcgtctcccgggacaggcggggcggcccccccagatgggtctgcatgtaggccggccagctagggcagagggtcttgcatgtgcacggctgcaccagtttgccacaggatgcggtcaagcccgctgggccctatggagccccgtggtcccttc

SEQ ID NO: 611152 - DNA, 133 bp, Homo sapiens
gatccctcttcgcgaagaacaacggcacatttccagtgaggccccatattaaaactagcgacgacctcatactacctaggattacttactaccctcccctagcttaattttagctccacagcaataaattcta

SEQ ID NO: 611153 - DNA, 135 bp, Homo sapiens
ccactgtctcgtctctcctgggcgtccccggcccagctcgatctgccgcaggtccttgtcgacgtttctctgctccgtgttgccgctggcgccgacgtgcttgttggacatgaagcccttctccccatcacggat

SEQ ID NO: 611154 - DNA, 115 bp, Homo sapiens
ctcacctggatcttatgctatacacccacacgtaatctcatgaggtagtgctttcttatactggccgtgatttaacaggttggtatggtggtatagagtggatagggtggtatag

SEQ ID NO: 611155 - DNA, 220 bp, Homo sapiens
aattactgcctatctagtctactgtttccttactaatattgctctcttgtacataacggaaagtgaagatatggaatatcctactataattgtattgctactctttgtgtttattcagttttgtgagtatttgcttgatatagctgaaaccccaatatgagacacacacacagtaatacacacatgtttagtagcgaatttttaataccggatcccctag

SEQ ID NO: 611156 - DNA, 582 bp, Homo sapiens
ggaacgttttgcctgttctagaggcaacggtgttattttcacaggcgcgatttgctattcagaaagcaatccagtcaggagaggggggatagcttactatgccggggaaatcagccactttttcaaaacataaaatgactcccaatggcattcagtgtattgacaggaattgctgatgattgcgaaaaacgtcttactcattgcgatgtttgtaacgcagcaaagaactcacagcactcttggatggtgagccaacaagcgctgagagtcaccagggtccacatttatgtgctcttctcacctatacctctagccacctgtcttaacaatgacacaggtattatggagcatgagctcatggtccgcaagttataactgatgatataactttactcgacacaagctcctctaacatgttatcagcacttccaacccaattaaagttccactatatttagaacatggttgagttctacaactttacatattatttgagcataaagtatctcaagtcttaaacagatttagtatactgggggacccatgctattcttgtactacacttaccttcttgtgggtgtc

SEQ ID NO: 611157 - DNA, 810 bp, Homo sapiens
tgacatgcggaaaagccctgacggacgttcaatgcaagaggaattccagcatctgaagactaggctagagcagctaccactaccacctccagcctgggagataggaccttgcttgtctgccttctggattcttggcccgcaacagagctggggactgagggatgcgactgatgctctttagctacaaagcgtggctttttagacagatttgttcatagaccctctcaagtgcccgtactccgagctggtaggcattccagctcctcagtgacttcctcagttacacaaaggacctcagctgcttctcccacttggccaagcagggacggaacgaagctataggccaagggctctcctttcaacttcttcgccttcagatgttctctcaccaggggctggcttcacggagggagcacatgaaaggcaaggtgaagcaaccagcttggctaggcggagcacgggggcccaccagagctgtggagaggggaccctaagagctcctacggcctggctcctacccaccgcccttgccgaaccaggagcatgcatcactacgtcctcacgggatggcacgattggccacgtcttccttgtgcctgaggttcccccccacgacaggccctgtcactcagggcaaggtccggcctcaggtgggccgcaggcgggaaaagacagcccatggccagaagtcaagcccagccacgaggagcatagagtgaggccctgaggtctggctgcttgccccatgctggcgccaacaacttcgtccatcctttctggcctctcaaatacacctaaagcctaggcgcc

SEQ ID NO: 611158 - DNA, 428 bp, Homo sapiens
ggaggaatgtatgtggaacgacatgatgctgccgactcgccgtacttcgattaactgttaaaactcatcagggcatcggctaacagtgtgacaactgccaaatctgcctacaccttctgacctcactctggtgtggacttgaagagggtgctcttggatccaagacttgagaccaactctaactatcttaatctatttattgagagtgtatcagagcttgcataaccaacccaatgtgtgggtttgggtgtagagagcaaacacagtagtcctgaaggctggaaagctgctctttcacctggaatgggtgggcttggacattacctctgcattgttggactgtggaatggcctcacaccacataaagatgcagacatccttattaacttaataataaatgagaggcgttgagcctgtcaaaaaaaaaa

SEQ ID NO: 611159 - DNA, 872 bp, Homo sapiens
ggtgatcatgccgccggttccccaacgggtggggtcggcccgccccccgtgggggtgacaccaccagtgttgggagccagagaacttactccgcggggtgtactcacactaacgcctagcgggtgcgcccacgaccatgtctgtctgtatgtgaacccgcgcctggtggtgaccccgcactccgtggtttgtctcagccacgctctgccgaggtgacccaacaacacaggatgtaccgtgctccacccagcttgtctcggcgagccagtaagatagcttgctactctcgggagtagcaaacaacatgattggtgtctcatgtggcccaaggttgtgcagatacatacacaggtgggtacttacttgaacgctccagttgggagaatagaattttatctacggacggctctcgtttcgtcacgtactcgccgcgctggaagaaggttcgcggcatctcctgcctcgagtggatctttttgactcggcacgtacattggtcggagcaaatcttgcgtgagacacaacctacagcatattgtgggggatatacattcaatttttggtaggtactaacacaaggatggcgggcgcggctccccgacattcttctcctgggaggatcgccgagcgctactactatatgattttgttggttggagccacactaaagttgcggtgaagccactacgcggaagtccattcttgctggtccgccacgccgcgccctccgtggggtgagcaattctttcttctctctccctcgcctccccgcgtctcaggcagggcatcgtgtgatgatgtgcccaccgtggcagcagtcgtgtcatatatactgtcatgggggcaaacaccccacaaaccaacataacaca

SEQ ID NO: 611160 - DNA, 1450 bp, Homo sapiens
ggcgcgagcggccgccgctggtgcttcttcttcttttagtgcagcgggagagagcgggagtgtgcgccgcgcgcagcagtgggcaggccgaagggggcaggccagggcagcaggcgccaggcagcctttgccagcccacgcgcgcgccttccctgtcttgtgtgcttcagcgcaggtcagcagcgggcgcgcggcagcgcgcggggcacttaccttcgctgctacgcttatcgcgcttcgccggcacgcggccgcggctgtacgtcctcgagcggcacgccggcgcgacgaccacctagccagctatgttcgggacggagcacgcttccggccgaggcgcaccgcggcgccggcgaggcacgcccggccacacggggcgcggcagggttcagcgccgggctccggcgcgtgcgccgccggcccagggcacggggacgcccctgggctcggcccgcgatgaaccacacgcgggcgccacccgcgtgccgcgggccgccagcaacagcgggcaccaccgggggcaccccgggcgagagcccgcgcatacccggcgctttccttgggcaagggccacgaccgcacagcgggggagccacgcggcccgcaagctacggcgcagcgcgcggaccgaacatcaatttggacggcccaggtctcacacgcacaccgcacgtgccacggcactgcaccggggcccaagctcgcccagagccatccagtcccccccacacgacacagcatctgccccagcgcaggagcccagggacaccaaaaccgtgggttcaggcaccctgggccacccacaccggctacacactccggcgagcgacccctctacgcgccgcggcgcccacccccacaccaaccaccgccaccacgacccttcgaccaggcgaaccccaaccctacaccccccaacaacttccggcacggacacgccggcacgccagccgcgacacagcctcgacaccgctcaagaaaccccgtcactcacccggccgcccgaacccaacgggcggctccccggggccactcacgcacgagcaccccccccgcacagtcgcgcgagcagcagacccacccgcagcgctccacgggcgccaaaccaacaataaccttctacattatcaaatagccacaaacactatccaaaccatcaccaccgcaaccaactacatacacactaccccaattctccagcaccctctccctccgcccctcctccctctcctctcccactacacccgctgcaccatattgacatctctacacgacatctatctacacaccccttgcacccacactctcactacaacaacacaacgctatctataccttcatcatctattcacatatactcctacctcaccacccacacccccccccctcaccctcattctccctctctcttcacatcaacacgacaacaaccacacaaccacccactacc

SEQ ID NO: 611161 - DNA, 101 bp, Homo sapiens
tgcgaaggggacggtgtgaggcctcagagcctaacctgctcagagggtgtcagtggggaaaaatgtggttagaggtcaacccagaggtggtaggagaggaa

SEQ ID NO: 611162 - DNA, 524 bp, Homo sapiens
  misc_feature (235)..(235): n is a, c, g, or t
  misc_feature (312)..(312): n is a, c, g, or t
  misc_feature (420)..(420): n is a, c, g, or t
cacgttccaaagggtctcgctgttggagttggatttggggctataaaaaagacggcatctgctacctttgagagggccaggaatttggccattggaatcgggatccagaatttccccgagggcctggctgtcagccttcccttgcgaggggcaggcttttccacctggaaaactttttggtatgggcaacttaacggcatggtggagcccccggccggggtttttggggcctttnccgtggggctgggtgagcccatcctgccctacgctttggccttttctgccggggccatggtttacgtggtcatgggngacatcatccccgaagcccagatcagtggtaatgggaaactggcatcctgggcccccatcctgggatttgtaatgaaaaagtccctggacgttggcctggggtagggnttaaaccctttggaccccgggaaaggccatacgaaaaaacaacagtgggtgggttttatggggcaacaagcttcttttttcccattaaaacttttttccctcca

SEQ ID NO: 611163 - DNA, 593 bp, Homo sapiens
agcgacatttgcataatattcatgatactttctcctttgtaccgcgtggatccaagcattagcagattagaaggataatgtatttaaaggcagtctgaaaatgggacactctgtagagaagtcatttccttcttctcctccgcatgtggaatggaagctttgagggaaggaaaagtaggaaaagagcggaatgggatgggatgggatgggatgggatgggataggaagagaggctggggaatgggcagagaagggggtgctgagtgtgctgtgagatagagcaagatcacaagaaggcctatctgtaagtgctataagataaggtgcagaagctgactgcaatgtcgctagtgctgcctatgtacatattcacaagaatcaaaaattccagctagttcacattatctcgtccgttctgaggcatccactccaccttgcgggccttgaccggaggcaatgcagcacctccactgcccttgtgggtccttgaacttgagtgagtagccctgggagatccagcaggctctagaaacacacgtctaccaatgggctggagtcctgagttaaagagaaagtccagtactggagttgga

SEQ ID NO: 611164 - DNA, 281 bp, Homo sapiens
  misc_feature (116)..(116): n is a, c, g, or t
catttcgtatacgtggattccagaggggtgacagcgcaacgtgtgaccatccagttacaggaaaacaagcttaacatgcgcactgattctacattatgctcctacctcccggcagnctctccagtgccagaactttctccagtcagcctctacagaccaagctcatgactcacaatgggctatttagtgccataccctacctcatggcagtctccgcagatgatgctactagctcacaacagactccacaggcacagctccatcgttacaatggcctcttt

SEQ ID NO: 611165 - DNA, 162 bp, Homo sapiens
tactggccggtgtcctctactcaccttcttcgatcccgccggaggacgtgagaccccattctattaccaacacctattctgattattcggccaacctgcaggttgagtattcatattctaccaggcgtcggaataatctcccatattgttacttactactcc

SEQ ID NO: 611166 - DNA, 297 bp, Homo sapiens
agcttaattttgaaaggggaacaaagtttcctattccaaccggttcatttttaatactcttacgaaaactattttaaagggggcgggagccaagccccaaaggacccccccggttttaaatggctgtgataaggccccgcgggtattaactgaaaccttcccccttgggtttttgttattttgtttttttagcccccccccgggtttaaattatggataacccgaaagccagccccggggaaggcccgtaatgatttttttgaagtttcaagggggggaaaaaaatttctgttttta

SEQ ID NO: 611167 - DNA, 116 bp, Homo sapiens
atatactaaatcaagctaatctcataacaaagtgataaccatacacaacactaaagagacgaccctgatcgcttatactagtatccttaatcattggggctcctctagagtctgac

SEQ ID NO: 611168 - DNA, 460 bp, Homo sapiens
  misc_feature (57)..(58): n is a, c, g, or t
  misc_feature (86)..(86): n is a, c, g, or t
  misc_feature (152)..(152): n is a, c, g, or t
  misc_feature (165)..(165): n is a, c, g, or t
  misc_feature (217)..(217): n is a, c, g, or t
  misc_feature (219)..(219): n is a, c, g, or t
  misc_feature (221)..(221): n is a, c, g, or t
gagtttgcgttcctgccaacagtacaggatttttccagtttgtctatatcttcatgnntgcttattttctgtttgttttttaatangagctatcctaagtggatgtgaggtgtgtagattttttttttttaatcagagttgggttttagccnagctaacctgctngccctttgagaaatgtatttgcatgagggagtaaagcataaggccagctagnangnaattgcattgacttagatttgtggtaatgaggaattggtttgattgtggtgggacaatgtgattttgagaggtgacagaaaaatggaaataatttattcaaatttaagaaactgagagaaatgacatgaaaatgacttttacatttgaatttgattgtaatagaaatgtggaagtaaagggaaggagagaaagaataacttactgttcttcagcgttttgggtgttgcgcggggtaccg

SEQ ID NO: 611169 - DNA, 244 bp, Homo sapiens
ctgtgaggtcgtctagaggatcccattaggcgcgttctgcgtcctgtggggacgctcctagagagagtcggccgcagcgagggcacagacaggctcgtggacatcacgactgcaccatggacgtcagccagcaggccccggggcagagtggcatgggggcaggaatggtggttacaccaacggcatgagctcattttccaagatggatctagagcaggtcccacccacgcagaacgcgcctaat

SEQ ID NO: 611170 - DNA, 219 bp, Homo sapiens
cttttggggggggggggggcccccccggttcccttttttccccccttgggtttttccccccaaacaaaaaagggccctttggtaaaaggaaacccgccctttttaaagggaagggccccccccccagaaaatttttttggaaaaccctttttttccccccaattttttttcccctttaaaaaccccctttttaaaaaaacccctttttttggggtttta

SEQ ID NO: 611171 - DNA, 120 bp, Homo sapiens
ctacatccgcgctccgcatcatggactcgcgtaaacttttggcttcagtgtcttccctgttcatatggttcgcagtgctgtcctgtctgccactgtccctgtggggtccgtgctgtcttg

SEQ ID NO: 611172 - DNA, 789 bp, Homo sapiens
taggtggccccaagggggtttcctagctcttttttaaggggcccgcgcccgcaaagtcaattataaaaacacaaaaatgtcccatcagtttaataacaataaaaaaccccaaaatgtgtggaaaatctggagggggcaggggaaggagaccctgtggccaggggcacgaggacgccctgctcttgggcaccaggcctgggccgcagggtcccccggttattgctggttggctacaagtgttgggggggcacgcgattggtcctggtggggacgccaccgttctcctgggtgttgggggaccctccgatctttcttcctggggtgtgtgtggctccagtcttctggctgttgccccggtttcttgtcccagcaggccagaatatggaaaggcctcctgtgggtgtttggtaccccattgtcaaaccagggcagtctctctttggacctcctggggcaggcccgggatatcgtgtacactctccaattgtccagggagctcatctccaggtcaattcttccagttctggggatcctcctcttccgggcagtcgtaaaggcgcgtgagctgctccaggatccactcctctaggtggagggcgcttcacagaagctcctagcgggcaatactgtgagggagaccttccctttgggccctcatggggcctctttgtccgcccgaccgggcccttctctggggccggggggctataatgtacagcttgtgctggcccacattgcggcccggggccgggccgaaagccgccctagcgttttttttgtttcagaggc

SEQ ID NO: 611173 - DNA, 224 bp, Homo sapiens
tacaaaattgtgaaaatgtgagtgcctgggaagtgtgtgccttgggtcacgctctttgagtccaccacagccgctgggagggggaagggcacctggggagcacctggcctccttactgagcatgtggtgtccctgtctggacttgcctggccccaggagtgcggccaccacagaaatcagggtatagggctgtggagcaggctgggatcctgcccagcatgccc

SEQ ID NO: 611174 - DNA, 105 bp, Homo sapiens
taagctccagaatgtcatgtctttggttaatctatcattgttaggcaccgttgatgtattcacttaaagtactattgttatgcagggtacctgacgctcgatctt

SEQ ID NO: 611175 - DNA, 296 bp, Homo sapiens
actgatgggaccagagagctagcagacgcactttagtagcttatagcacttcctgactggaagagagaggtggtggtgtacttgatggtggaactgccgcctccaacagagactgaggccacccccaatggctctgccactgctggaactgaagccaactccaacgcaaagaacactgccactaggagtagctgcttcctccacccaggcctaagccactgccgacaccactggaaccgccatagccactggaagacggtagactgcaccacagagatgttgcctatcggagaaga

SEQ ID NO: 611176 - DNA, 101 bp, Homo sapiens
atgatcgtgatagttcatcgagcatctgtgggatcagtggaaagaatgattgctatcctcacagaaaactatgggggcaaatggcccttttggctgtcccc

SEQ ID NO: 611177 - DNA, 727 bp, Homo sapiens
  misc_feature (72)..(72): n is a, c, g, or t
  misc_feature (82)..(82): n is a, c, g, or t
  misc_feature (84)..(84): n is a, c, g, or t
  misc_feature (92)..(92): n is a, c, g, or t
  misc_feature (152)..(152): n is a, c, g, or t
  misc_feature (158)..(158): n is a, c, g, or t
  misc_feature (167)..(167): n is a, c, g, or t
  misc_feature (227)..(227): n is a, c, g, or t
  misc_feature (308)..(308): n is a, c, g, or t
  misc_feature (355)..(355): n is a, c, g, or t
  misc_feature (400)..(400): n is a, c, g, or t
  misc_feature (480)..(480): n is a, c, g, or t
  misc_feature (494)..(494): n is a, c, g, or t
  misc_feature (508)..(508): n is a, c, g, or t
  misc_feature (510)..(510): n is a, c, g, or t
  misc_feature (552)..(552): n is a, c, g, or t
  misc_feature (658)..(658): n is a, c, g, or t
  misc_feature (680)..(680): n is a, c, g, or t
ttgatggtacatgacaaggtgcggctccctaggcccctaccctctacaaggggtctacatggcaactgtaangaggggagantnagtgtggngggggactgagtttggcagggactccccagcagtaagggtctctctctacctctagtgcncttgcnggggctggnggtccaggggtctaactccttggaggccatgtgggccatgaggcccaccaccctgtcgcngtggccaaaaccgtggtaataccaggaaatgagcctgaaaaagtggtcgtggagggcaatgccagccccagcgtcaaaggnggaggagtgggtgtggctgtggaagtaagaggagaccacctggggcncagtgtagcccaggatgcccttgagggggccctccgacgcctgcntcaccaccttcttgatgttatcatatttggcaggtttttctagacggcaggccaggtccaccactaacacgttggcagtngggacacggaaggncatgccagttagcntnccgttcagctcagggatgaccttgcccacagccttggcagcnccagtttgaggcagggatgaagttctggagagccccgcggccattacgccacattttcccggagggccatccacagttttctgggtggcagttatggcatggactnttgtcatgagttcttccacganaccaaagttgttatggatgaccttggccaggggtgctaagcagttgg

SEQ ID NO: 611178 - DNA, 437 bp, Homo sapiens
  misc_feature (408)..(408): n is a, c, g, or t
ccggcaacacgcatggccaggcgtacccacgatgatatggggagcttccatctgcaagtttctgcaccgtcagcacgcttcgttggtgcccccgatacatgcgttacaggaggcgcccatgtagtctcctagtgccatgaccaccttctgtatctgagcagagagaggcaggtgctcatatgtcagttaccactgtgcccagcaccattctttcatgtttttcactgtattgattcctaaccaacaactttgggtcatgcactattattatactcacattcagcttagatacaggcataggctataatccactttagatcgtgctgtctactagtgtttcaaagactggatttcaatctctgtctggttcctgagtgtacagtgattcacaatgaggccgctcagatnattatttcagtttctttactctagatatt

SEQ ID NO: 611179 - DNA, 421 bp, Homo sapiens
agcgtgtgcagggagagcccattttattgataccccccagctgttgcagtaaagtgttcattgaatgcaggcgcctgggagaagtaacttcctgggcatgtgcatgaaaagacaaaatggcggagtatgacccactcggggcactccacaggaaaagggaagaaagcctcagaccggcatgtgcacagctttttaaacacactgcctgtgctcacttcccaaggctaaggaggaccccgtgcatttgggaaataatgccccccctgagggaagaatcatgggaaaggggcaagcctacaaagtcctggggtcaaggttaaacactgcacctgacctcagtgcccacttgggactcttccaagcgtactttgtttttttccctgttttaaagcctttttaaataaacttccactactgctca

SEQ ID NO: 611180 - DNA, 307 bp, Homo sapiens
gaaatgaatgaactgattaatgaaatgatggaatgatgtgaaaaaatgagtgaaatgaagaaaatgatgaaatgaataaaagaataaggaagaagaaaaaaatgtgaataataaatgcatgaatgaaaatgaaatgaaaatgatgtgaagatggaagatgaactgaagaaaagaggaaagaaggaggaggagaagaagaagaacaaggagaagaagaaagaagaagggagaaggagaagaaaagaaggagaagaggaaaaggaagaaggagaaagaaaaggagaaggtaggtatgatgaaggacggt

SEQ ID NO: 611181 - DNA, 317 bp, Homo sapiens
  misc_feature (28)..(28): n is a, c, g, or t
  misc_feature (164)..(164): n is a, c, g, or t
  misc_feature (242)..(242): n is a, c, g, or t
  misc_feature (274)..(274): n is a, c, g, or t
  misc_feature (298)..(298): n is a, c, g, or t
  misc_feature (311)..(311): n is a, c, g, or t
gcggtgcttaccctgtttctatataatnattagacgtattagaagcaggaagtgccgggcgtggtggctcacacctgtaatcccagcactttgggtggccgaggcgggtggttcacgaggtcaggagatagagaccatcctggctaacaaaggtgaaccccgtntctactaaatatacaaaaagttggccgggcgtggtggcgggcgcctgtattcccatctactcgggaggctgaggcagnagaatggcgtgaacctgggaggcagagctttncagtgagtcgagatcgtgccactngaattccagcctnggtctc

SEQ ID NO: 611182 - DNA, 291 bp, Homo sapiens
ttttttgagacggaatcttgccctgtcacccaggctggagtgcaatggtgcggtctcagctgactgtaacctccgcctcctgggttcgagattctcctgcctcagcctcccaagtagctgggactacaggcacccaccaccacacctggctaatttttttgtatttttagtaaagacggggtttcactatgttggccaggctggtctcgaactcctgacctcgtgatccacccaccttggcctcccaatcttatttgctttacaagtcctgcttcagggttaccttcgtcg

SEQ ID NO: 611183 - DNA, 525 bp, Homo sapiens
gataaactgacgatatacaggcacattatgtgacacatacacatcgcaattgaaaccgaagcttggctggactgggcgtggtcttgcaaaatgcttccaaagccaccttagcctgttctattcagcggcaacctccataagcacctagttaatgcactcactgatcacctcaatgtggcatgcagcccccatgcccaccgggacctggtcagcacagatcttgatgacttgccctttctagggcagactgggagggtatccaggaatcggctccctgtgcccacgggcgttttcatgctgtacagtgatcctaaagttggtaagatgtcataagtggaccagtccatgtgatttcagtatatacaagctccatccagaggcccgtccgaacgccgatataacaccccacccctgttcgcttcctgtatggtgatatctatatgtaacatttactcctgtttactgctgattgttatcgttacatgttctaggttagtccattgacatcagctgtaatcatttcca

SEQ ID NO: 611184 - DNA, 470 bp, Homo sapiens
  misc_feature (8)..(8): n is a, c, g, or t
ttggagtntgaggagtgtggtggttgctcatggtgtaggatttctgtcctggcaggggggcatggggtcacagaacgtgggcccctggggagctctctctgtgcctgtggccccccaggagtctctcagttttgctgtggtcttgaggatggcacagcgtgtccctgagcgccctcagtgtggacagctgggcttcaaactcacttcagagccgccgtgtgggggtggcgcctctgagggcttgaggttattttcttgtgcggtttctctctcctggcctaggtttttctgggttttttgcacctcttggtgttgataagaaacaagctcccttccccttttaaagcccacagactttcccgatctcctccccatcccctgccccagcactgtcagggcgtctgggcgtctgagctcagctccttcctggtggcatcctgcaaaaagatacactcgctcagtgactcgga

SEQ ID NO: 611185 - DNA, 634 bp, Homo sapiens
caattccattgccagcgtacaatccagttcgcagagtatatacaataccattgcagcgtagaaatgagtaagtattcaatcaactaagtgatatatggcttcttaaagaccttgatgttggtatttgataatgagatttttctttcatgcagttagaaaacttggaacagttacgtaaggaatcatctgtgttctcaggttccatctcagtagaactggtaaattttttcaaagtcagtgggaatgtatggtgtccctatccttggtgtttctctaattcttttcatctgtggcccattttcttctcatggtttgtcttttcttatatggttaaatattcagtcatcacttaaatttgggctgccaatatagttatacataatctaactttctggagaagatgaatttagaacaagcaattctccagagctggaggacgcatcagcactggcctttagagtggggtagtccagtttacagtctgactccactggttctgtgactggctcaggcaaatttttctcattggaaatatgaagatgatgatagtgcctattgaacaggaattttctgagaattaaccagatttagtacttaaagaccttggatagtactgggatataatagcaacaat

SEQ ID NO: 611186 - DNA, 564 bp, Homo sapiens
tgacagtgaatgacttttgtaggacctgtgcgtgcaaaacccatggcaatgtcacatcctcttggtatgctggcagatgcttctcttggtgaattatgaaatccactgttcacattgggtgcctaacagaacatttgcttcttgtgggatttagtgaaaactattaaacttgttaagttgattttatacaaaacgataaataaaaagctctaagaagaaaatgtataatcttagagctgaaataaaatatagagaccatctagtaaatgacctcattaatatatctgtgaaaactggagactcagatggtatgtctctaagaacacataattagtaacagatcaagacacttaacaacttttccctacaaaaacccttccccttggggcccccccccccttttgggacctttctctttcctccttggcagatttctaggaccggcttctggctcagtgtcttcattttcttccatatttgtttatttcatttttctttttcctaatttaagggttttcccaattgggtttttaccattttctccttggaaactcaaaatttaca

SEQ ID NO: 611187 - DNA, 533 bp, Homo sapiens
  misc_feature (512)..(512): n is a, c, g, or t
gttcagtgggaatggagtctctctggatgtacttcaaggaacatcatcagctgcagaggattggtggagtcagaggatctgtgcaggaatcgtgtcctgtcctgtgctctccagatgccagctacgtcaatcggggtagtaacaattgacggtgtgtcagtgctatctccatctcggcttctgagagtgtagtgggtgtcggctgcgtagtctgtggtcccaggcccaggagcctgagggggtgtctaggtgatcatttggatctggaggcagagtctgccattctgccagacatagcaaatttgggggcttactcatgctaggcattgaggaagaagaaaaacgcattcggcattctccttaggacttatctgcttgtagatttggctgatcacaaattaacaatgtggggttcttcggtgtgggtcataggtgagcatgaaggattttatggaagctagtgctaaggaggaatcataagggaaaggagtagaagctcaggcctttgaagntacccctcggcctctcttaat

SEQ ID NO: 611188 - DNA, 1318 bp, Homo sapiens
  misc_feature (1318)..(1318): n is a, c, g, or t
gctttaaaggtgccaagaaggcaccgtgttgaaaggtgtccacagcgcagcaaacaaagaagaagatcccgcacgtacataccacgcttccgggcggccgaagtacactgcgactccggcagactagtcgccaaagtatcctcggaagatgcgctacccaggagacacagagcttgagacaactatggctatcgatcaaggctttctcgactgaacgcagagtgtagctctgacagtgaagaagataggaagataaaaacacaccttgtgtgcaattgtggatgttaagagccaacaagcaccagattaaacaggctgtgaacgaatgctgtaatgaccatttggactgtgagtcacaggtcacaacacgcctgatttcgagcctgatggacgacgaacgaaaggcactagtgtatcgattgggcttcctgacttacgaatgctttggaatgtatgtcaacccaaaagttgggatcctctaagacttgaagtccatgcttgcgctaatgtctgtgaatatatatatatatatatgcctgacaccagacgactataaaaaaaacaccaaaaacaaacgaagagacattcacaagagaaaaagatgtgaagcggaggagaggggaggccaaagagaggactgagccgcaagggggccccaaatggagcaacacacaccggtatcaacagagagaacacggaagaagatcaaaatagggcgaagcacaagcgtcgcgcaacaaaatgcaaccggggaaacaagccccaacataagagacacaaacacgcgaacaataactaggaccgatcgacaaacgcgagggcaacacacaaatggaaaaagaaagaccaaaagggaccaaaaccaccgaagacaggaaggaaaaaaagagacaaaaaggaaaaacaaagagataagaagaagaccgtagggaagaggagaaagggcgagaagggaagaggacgacacacacagaaagagaaacaagaacaaacgcgccggaagagaacagatagaaaaacataaaagccaaaaggaaacagaaaaggccgaccgacaagcggaccgggagaggacgaaggaagggcacaagagaaggagcagagaaggagagcagcaaggggagagggaaggaggggaacgcacgggaggggacgagacggagagcaggacggaagacaaacagacaccagacagaaacgaggggagaacggggcagcgaaagagagagagagaaggacaaaggacaacgacagaaaagaggagagaacgaagaagagggagcaggatgaaagaagacagaggacgcagagagagcgn

SEQ ID NO: 611189 - DNA, 369 bp, Homo sapiens
ccattgttcagctagcctacgtttgataagctcatccgtacagaaatacaagcatcagaatatcacgacatatattgaaagtgtttcacgcctgtaatctcagcactttgggagcctgaggcgggcggatcacctgatgtcgggagttcgagtccagcctgaccaacatggagaaaccccatctctactaaaaatagaaaattagccggacatggtggcacgtgcctgtaatcccagctacttgggaggctgaggcaggagaatcacttgaacccggggggcggaggttgcgacgacgagccgagattgtgccattgcactccagcctgggcaagaagagcgaaactcttaacaacattcttcagcacg

SEQ ID NO: 611190 - DNA, 152 bp, Homo sapiens
cccccccctttttttgggtttttttggggggaacccccggggggcttttttccaaccccccttttcccccccaaaagggggggggggggggggggtcggggtcctttttgtttaaaatcccccccccccccaaaaaaattttttttgcccca

SEQ ID NO: 611191 - DNA, 709 bp, Homo sapiens
agcggattggtgcgggaaggatcctgaaccgcgcggccgaactctccggtgtaccgatccaggctaagcttgagcatggctgaggcaggagcccacagccgcagcagctggctcctagattgcaagctggagaacgaggaggatgagcgactcggttgcaactacatagcccccgggcccagaatgagcatccaggagatccaggagctggacaaggaacgacgtagtagccgtgcgaataggtatcaaggaggccactgactgggaccgacgttggccagtgtatccgctagacccgaatcgttcctccaatgctcgtggtgactgggctgactcctggttgtgcatgctcggatccacggagccccctggagactggtactgacgggcgagctggaaagcttcaagaagccatgtcgtttgtgctgaaggagggtgtggagtaccggataaaaatctctttccggagttaaccgagagatagtgtacggctatgaagtacatccagcgatactgtactaggataaggcgtcaagattgacaagacgtgactacatggtagagcagctatgggccccgggccgaggagtacgagttcctgaccgcccgtggaggaggcaacccaagggtatgctggcccggggcagctacagtcatcaagtcccgcttcacagacgacgacaagaccgacacctgtcctgggagtgga

SEQ ID NO: 611192 - DNA, 524 bp, Homo sapiens
  misc_feature (86)..(86): n is a, c, g, or t
tcatcttgggcctgtgttatcttttgccataggttattttatagattttattttaatatgtcatctgtgtttttaatgtatgctgnatattattattgcatatacttaggtattagttatccataatggtgcaacaatattaccacaaacagttgcttgaaacaacacgcatttattatctcaccatttctgtgtgtcaggaatgtatgtgtagcagagttgggttctctgcttaagggtctcacaaagctccactcaaggtattggccagagaggtggtttcatcttagactcaatgggcgatggatctgcttgcagacttacacagttggcagaattcagttcctgtaggctgctggacacagggcttcagtttcttgctggctgttagcttgagtctgctctcagcttattgccctgtggccctctccatatggcagctcacagcattgcagcttgtttcttcaaagccagtaaggaagatagtcttcttcaagacaggcattatagctttatgtaatgta

SEQ ID NO: 611193 - DNA, 888 bp, Homo sapiens
  misc_feature (28)..(28): n is a, c, g, or t
  misc_feature (151)..(151): n is a, c, g, or t
  misc_feature (167)..(168): n is a, c, g, or t
  misc_feature (171)..(171): n is a, c, g, or t
  misc_feature (175)..(175): n is a, c, g, or t
  misc_feature (211)..(211): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (246)..(246): n is a, c, g, or t
  misc_feature (249)..(249): n is a, c, g, or t
  misc_feature (262)..(264): n is a, c, g, or t
  misc_feature (303)..(303): n is a, c, g, or t
  misc_feature (337)..(337): n is a, c, g, or t
  misc_feature (423)..(423): n is a, c, g, or t
  misc_feature (452)..(452): n is a, c, g, or t
  misc_feature (456)..(456): n is a, c, g, or t
  misc_feature (474)..(474): n is a, c, g, or t
  misc_feature (520)..(521): n is a, c, g, or t
  misc_feature (551)..(551): n is a, c, g, or t
  misc_feature (618)..(618): n is a, c, g, or t
  misc_feature (620)..(620): n is a, c, g, or t
  misc_feature (867)..(867): n is a, c, g, or t
ctctttaattaattccttaggataaatncccagatatttaacagctagggcagacttctaatacaataccgaaagtccttccaaaaaccaagtggttgccaacttatgtcccttagcattataacattcttgagccaatagtgtaaaaatncgctgacaattttatnngcnaacntttctcttggtttctttctttccacttattactaangttnttntnccctaaattgttgctcctcatctgtnggncttcttcctggtnnncctatcataagttgatactatcaagttgaaatgcatttngtacccggataaacctatcataaagttgacaatntgtcaattgaaccagtgtaaatcagaggccatcttccttcatactcatgaagcaactatagtgggatatttttcccctttcgaganagcctaggcttgttgacacactgtcctcntttnctggctctctggtaattnagtcataaatggtcaaacatcaaattctagacaagcgtatatttgnnttctcatcgctataattcaggctgactggnttgccaaactatgttcatagtatttgggttatatctgtggtgattgtttcaactggcaagctaagtngnatgccttaaagaatctatccaagattagttggcaggcatttccagtgttggtaaatcaaaggcccacgaaggtatgctgagccttgatagcacaaccttgcttaggactttgcctcaactaacatactttttagtttggcaagttacctgaccctccaggtaactcatttttctccatagtctgctacttacaagattgtcatatttttgtaatctagaagcaattatagaggatattttattagantttacaatgacaactgcataa

SEQ ID NO: 611194 - DNA, 911 bp, Homo sapiens
  misc_feature (192)..(192): n is a, c, g, or t
gtcttcgggtaaggatggcggagcgcgggtacagacttttctggctgtagctacattcagcccgtcgtggtaaatcttgtcacagattgacatatgctttggactgctagtagctggaaggagccccagtccgtggggatattaaacgctgcaacatggtgtggctattatgcagcgtgagacaagaacagnaaattctcgattctcgtaatagatgagcgaagttgtacaacgagagtagaacccaacttcaccatgacatactaagggtttgggtgctacaggtggcctagttggagtccccgaaatctacagaagtgcgtatggtgcaccaagacgacttgcgaaaagcgtagacattcgaatcaaatacccagtcgtttggatgttacccacaaggaaccccgaattcctggacagcctcgaagttggttacgagcagcagtgagctgtctgatgcagtgcaagtaataatacttcagtcaggtggtggatccgactccaatctctggaagtaatctttaggtatatgcgcttggtcaggaagtgaagggaacgaccctagtaattatatttcagatcgggatggcactcatggacgcttacgtttgcccgtgggaaagcgtacaagctagatggtggagagaactctgtggaatgggcaagaagtttccttgcgtaaaagatatactgaagatctggcaactcggaagatgccaattcataccgcccatctttaacctaagggacagcctcgcaagggccgactgacggcggcctcctgttgacactcgcgaatcttgcactgcgccggatcgggaagctaacccaacgggacgtgacggtcaaggctgccttgatatccggcgcgccgggcatcccaaatcccacaccttctgctcccctgtcga

SEQ ID NO: 611195 - DNA, 859 bp, Homo sapiens
cgtctgactcaagcgccgcacagcgatgtcttcatgctgagaatgtaacgcctgccgggatcagtacagattctgcgagagattcgacaaggcaatacaaagcaggtatcgatgagttgaggcaatgtgagagctggaatcatgcatatatgttcttcataagctgaaccaccaacagagaaaacgcaggcctttgcagatatgatggaatagcatcccaccttgccaaagcacttacaccagtttgactgtgctagctaaaagacaaatttaaggggagctcttcaacattaaggcagtatgatatcatgcttggttccttaccctcatcggtccaggcactggcgcaactggtgtcccattgccgtcttttcacatatttcttctttcgcctcctctctctttctctgtttgccacgatcacaccactcacatacactcaccgtcctgacaactgtgtcatgtcgtggtcccccgaacttgttgtccatttttcacacgcatcccatggtgcacccatttccacacggggttccccgttgccccttttccacttattgtaccgcctacttgtcccccatttcctgcttcttcacctcaccctttctccgtcacggtggttggccccttcctccttttgattctttgccacgtggttcgctttaggccagtcaatttgcccacccctgtcgccctaacgaggacctcgctggccagtgctgttgttaagacaccttgactgtgtcgggttctgcccccgctgggccaagctcctgtcgaacccttcctggttccgcctcttcggcctcatgactctcggagacgccattaccgagcgtttcactcgatctctgtgttc

SEQ ID NO: 611196 - DNA, 420 bp, Homo sapiens
ggtacccggggacgaaaggagcacgaagaacaggcacggagcccaagggaatgcccaagtccctccaggtgtttcctcggtcacggtccgccggcgcaggcgccaatcacagggtcctgaggtcgcctgacgttcagggcagccggaagacggggaggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgccaacagaagttccttcgatttgctcccacgggagttccgtctggtggaagtccatgacccacccccgccctttcgtcccccgc

SEQ ID NO: 611197 - DNA, 901 bp, Homo sapiens
gtgtacagcttaaatcatgggtccagcctagaaaccaccatttaactttacactgatcaatattgaatcatggaactgtatatggctcatcgttttaagataaagcatcattaatgcacgatctgctggggttagcctaaacaggcccaagactgtcaatacacttcacacatcattagagaagttctctatattcttcttttataatcataagataatcactataaatacaataatataaataagcacaacaaattgttgctccgtcgtgagctccttgggcgtaaagtctatttaacagcccaatcgcgagtcgcgagggtgaattgcgtgagtccaccccgtaaggctcaatggggcgacactcgcgcgcgtctatggaggcgggggcggccaagagggataactcacgcactctgcagctctgagggagtgtgagatctcttgcccctaatgaacaaaaatatacgtgctgaccgcgagcgagaggagcacgaggcctgattgtactccgacatataataacccccaaatgaggttgagtttacttgaagtggggacaacacatcgaggccttactacatgcgagaggctacactaagcgcccgtggccggtattgcactaatccgtcacccgtttcggggggggatgggacaccctacgtcattggcaacgctaagttgtggaaagcagccaacccttagcacatatcaaaaccattaaaacttcctctcacttacagattaatcatccttcacaaattctaatgtctaagttgaataatccatagaaaattcgttggtcgactttaatgccagagcttactgttttgcacaacttcttaggtagcttctacctgccacgaaacaattataagagaacacagtgaacccaaacaca

SEQ ID NO: 611198 - DNA, 258 bp, Homo sapiens
ctgagctcagctcatcctgccgctcgtctccacagtgctgcgataacaggtgtgagccacgacccggcagctgctctatctaatctgaacttggaaacaccttcctactttaaggcacaggatcaggataagaacccacattgtacgagctaacagagctgcaacttcaaatttactacagtaattaattttcccttcattggcttgcgtctttggtcgaacagttcacaattcccttttccttagatacacctgatt

SEQ ID NO: 611199 - DNA, 828 bp, Homo sapiens
gtcgctgcacgcaggcgccgtgtagtcgtcgccatcgctcgcagcccgtgctgccctcggcgtcgtacccgccgtgctctcatgcccgtcgccggctagtggcgcgctcggccgccccggacagggtccgctgcggtccgcggcgatgggcacgcgaaagatcgacaatacgtagggtgttgctcgcgggcgtgccgtacaagcctgggtgcgcgacttagcggcctcgtgaccgtcagtcatgaggttgatccgtttcgaaatatgacggctccggaccactcgttcccctggacgagtcaggggtagcggactaccgcgagcaccttctagtcgcatgcatgtggcgacagcattgactgtccgcgttagtatttgcctatacggtgcgctatcgagccgaactcggggggatgccaatagatgcaaggaggtcccagatgttttgcgccatcatcgagcgttggatctggtggagaacggtccaggcggggactgcagcgagcagtccaaatagcgggcatgggataaatcactcgctggctggaaaggtgatggtcggtaccaagacatttgtcgcataaagcgcacgttgtagaatccagagtgaattcggacaggcgacggctggcgaatggacatgagttcttcgttccaatgacgcctgaagatgtgacagcaacggcataggagagtggacccgaatttacccgaactcgcacgggataggtaagttaaactcccaaagcacgccaaaagaaatgatcactctgctgaaaatgctaatcgacttattaccccgtcgcgataaggatctgacggcacatc

SEQ ID NO: 611200 - DNA, 376 bp, Homo sapiens
gctcaagttgatccttccacaccttcagcttcccaagttagctggaactacaggcaatgtgccaccaggctgggctataatttttaaaattttttggtggagacagaatctggccaggtggcgtaggcgggtgtcaaactccgggcctcaatggatcctcgggcctcagcctctcaaaaggctgagatcacaggcataagccacggtgccgggcctattctcttcttataagacaccagtcagatgggattagggcccacactactgggcctcgctttcacctaatggcctctttaaaagcccggtttccgaatacaatcccacgctgaaatacggggggtaagggcttcagcgtatgaatggtgcgaggatcact

SEQ ID NO: 611201 - DNA, 559 bp, Homo sapiens
catcgcctaagcacgcagtcttcctcactctgttgttcatcacacctgcataggaaatatgagatacacagagaaaaaaaagtcacactttcagaattctgatgctttatatttctgatgcaatttaattatttattgtgtcctttcccaaggtgttatctaaaaattactttgatgaagaggaattttcaccccacttttctccaaaataaggttattttttctttttctttttctttttttgggtgacagagtctccctgtgttgccccggcctgggactgccagtggctgtgactgcaagctcactgcagccttagccttcctgggctccaggtgattctcctgcctcagcctcccaagtagctgtgcctacaggtacatgccaccatacccagccaatttttgtatttttagtacagacgggtttcgccatgttgcaaaggctggtctgaaactcctgagctcaagtaatccgtccacctcggcctcccaaagtgctgggattacaggcatgagccaccgaacctggcagaggtcttaattttttaaagaatctc

SEQ ID NO: 611202 - DNA, 821 bp, Homo sapiens
  misc_feature (26)..(26): n is a, c, g, or t
  misc_feature (126)..(126): n is a, c, g, or t
  misc_feature (171)..(171): n is a, c, g, or t
  misc_feature (191)..(191): n is a, c, g, or t
  misc_feature (193)..(193): n is a, c, g, or t
  misc_feature (195)..(195): n is a, c, g, or t
  misc_feature (207)..(207): n is a, c, g, or t
  misc_feature (210)..(210): n is a, c, g, or t
  misc_feature (227)..(227): n is a, c, g, or t
  misc_feature (259)..(259): n is a, c, g, or t
  misc_feature (270)..(270): n is a, c, g, or t
  misc_feature (281)..(281): n is a, c, g, or t
  misc_feature (286)..(286): n is a, c, g, or t
  misc_feature (300)..(300): n is a, c, g, or t
  misc_feature (317)..(317): n is a, c, g, or t
  misc_feature (322)..(322): n is a, c, g, or t
  misc_feature (326)..(326): n is a, c, g, or t
  misc_feature (330)..(330): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (386)..(386): n is a, c, g, or t
  misc_feature (392)..(392): n is a, c, g, or t
  misc_feature (431)..(431): n is a, c, g, or t
  misc_feature (510)..(510): n is a, c, g, or t
  misc_feature (562)..(562): n is a, c, g, or t
  misc_feature (607)..(607): n is a, c, g, or t
  misc_feature (631)..(631): n is a, c, g, or t
  misc_feature (731)..(732): n is a, c, g, or t
  misc_feature (759)..(759): n is a, c, g, or t
  misc_feature (769)..(769): n is a, c, g, or t
gggagagcatctttcagagcattacnccaatagaaataaatatgattgtaggaaaagaccagaggaaagtttctattaccaacggtttagactcttggcgcgaagaaatgctcaatgatcaaaganagtctatacgtcgatggtgactgcaaaatggacatccggaaaaanagacaaggaggggagccaanananaatatagctgtnggnagagctaaaaaaacatnagtaataatcatgggaaaagaaagtgtccacngaggcacactnaacaaaaaagnatatnaactcgctttatanctgaggaggtctgatgngtaancaanctcnccccatctaactaacaactgtcttcatcaacaacccnaanttntctttacctattntctaangtcataattccagtttacacaatgagatcatatgtatgntaaacacatgtatgtaaccaacccttatctggcaacataattgcagcacaataatgatttgcatgataccttgaaattngggggagggggcatgccaagttgggcatcactttgtcttagcaattaatggngatattgattactaaaataagttaatattaagcaaggtgccggtngtacaatctctgatcagtgtcttntcagcactttgagcatttacttggctcatttagtcttccttttgtagcgcatggttggggaggaaaaagtgcatgcatcattccttcactcttctctttnncccgcccccccctcccttcgcacatangcatttggtnttgcttccatctttttttatgcagtgcctgttttttttttaaccaattaaaa

SEQ ID NO: 611203 - DNA, 159 bp, Homo sapiens
cgggggacagggaggtgaatagaaggacacagctcctgccctccaggagctcacaatctgatggaggaggtgacgttcttgggtggtgttccaggaaggacagattcagagggagaggagacagggaagaggaaaaggtttcactttggacaatgatga

SEQ ID NO: 611204 - DNA, 247 bp, Homo sapiens
ctgatctagagtatccccctgcttgtcctgcccttgaagataagttctacaaaaaaattccaggtctgggtgtggtggcgtcacatcctgtaattcccaagtaccttgtggaggccaaggtgggtgggtcacctgaggtcaggagttcaagatcagcctggacaacatggtgaaaccccatctctactaaaaatatacaaactagctggatgcggtagcacacacctgcagtcccagctacttggga

SEQ ID NO: 611205 - DNA, 244 bp, Homo sapiens
  misc_feature (5)..(5): n is a, c, g, or t
  misc_feature (234)..(234): n is a, c, g, or t
ccggntggatcacctaaggtcaggagtttgaggccagactggagcctggccgacatgatgaaaccctgtctctactaaaaatacaataaattagccaggcgtggtggcaggcgcctgtaatcccagctactcgtgagaggctgaggcaggagaatcacttgaacccggaaggcagaggttgcagtgagccaagatcgcgccattgcactccaggctgggcgacaagagctgagntccgtctttt

SEQ ID NO: 611206 - DNA, 626 bp, Homo sapiens
  misc_feature (143)..(143): n is a, c, g, or t
tcaagggaacggccaagctttttgcccgaggagttctaaggcccactatggccaccccacaaagggaaccacaggaggttttcggtgtcccacagtttgtccgcacggcacaattgacccacttcacggcgtgcacagtgttncacagcggtatagcgcccctccacagaactgtttttggcgcccacaacaataatatgtgagccacttggttcacgccacatgttataagaggcactcacactttgggtctctcacggagatgagcacattacactggaacgccttttatctataaatatcccttaaagaagaggagactgaggcacggagggcacgcccacaaaccacagagaaagcccacgagagtacaccacggagaatatgacactttcccccacgtacattcagaaaacactggtttggctcactgagtgaaaatggaaagtccccggggacctggctaacaaggctgaggggagaaaataccaagatgagtcctgttgagtctcccccttgatattggacgtcgttaaaaacataaggagagagatttttaacgaggtaaatcgagagaatcagtggattcccgagactcccagtcactcaagggaaaggtcagctga

SEQ ID NO: 611207 - DNA, 224 bp, Homo sapiens
ctggggttcgcattgcgtgaggtttgccagccgggacacccattttaactgctcgttcagctgctccagcagcggatgaggttttgagcatcttccactggcacccactatagcagctcgctgtatttcctgttcaacctctcagcgacctggagggattcgtcgagctcccgccgcagcttagcctgggaggcgctgttggtggaacagtccacagacaagat

SEQ ID NO: 611208 - DNA, 226 bp, Homo sapiens
gtggcagacgcagaatgggagcgctggcccctgaggaaggccccctctcctgcgcatctgctctcttcgctcacctaagcctgtccctccccctaaagagctccctccctcgctcgcgagccctggtctgcgccacgcgccactactcgcctcccacaggcaccactcgcctccccgttgtcgcccacaggtggcgccgccattaggcagccccttcacggcgcag

SEQ ID NO: 611209 - DNA, 251 bp, Homo sapiens
  misc_feature (21)..(21): n is a, c, g, or t
tagcattaaaccgcgcagtangttgtagaaactatgtcctgtgccttgagaaaggtgcttgtgacaatgcacacttaggaagaggtgtcaccattaccgtctgagcctggcccaggaggtacacatccggattctcacgacttatgtgttttcatgagcacagcctgtggtcctgggtggatctgggagcatcaggaagcagcccttccttcctctctctccctcctccctccctctgattctccctaaga

SEQ ID NO: 611210 - DNA, 263 bp, Homo sapiens
ttctcaggtagaggtcaggcggcgcggggggaggcagtcccgcgcagaggcgacccagtgaagccaggccccatacggacgggcctctccggggaggagaactcgcttcgtattggtaccggttccgagttttccaggcacgatagtctctctttaaaacacatggtctacctcatggtagaaggagtgcctcgaggggttggaacacacttctgtcatctcagggaactgggggtcctgcgaaggagctggccttagggtgg

SEQ ID NO: 611211 - DNA, 1040 bp, Homo sapiens
ccagccaaggcaaattcagttggcatctagggcttgaaaactgcccaagattaaagagctaagatgaacatagtttgaataaactggtaaaataacaattcatactatctctacatatttttaggatatgaatttttttttcctgctgggtagatggtccagtgacttatggcatgaactttcttttcatgctaccttcaatcttcaactaaacgatttctaacaaggggtaagaacatgaggcagtagctttacttaaatacatagacagtacacagctatcatatgctgtggcttcgacgaacgtcacactttagtggactatgaaaccaaaggcaagaattcccatgtagcatacacttaagaatagggcaaaaacatctacctaaaagatggttgtccctaaaacactggaaacatctgcaaatgctctatacatgtccaaattcctgggagcttatagccccatgactctgacgtttgtcaattcaactacagacagaactagaaaagaagctaaaactgtcaacaacctttggactcatagagtgctatgtgcccaatagggtctcgtcattagccccagtgtacatgtgagtgaatgctcaccgtgccgttaagtcacaacagtggtcttgaaatatgttgtacacacgcttatctcacgacaccacgatcgaggcccttgggccgcaacagaggccataagtgagagaaaaacactgtaatgacaataccacactgttcatgccccatcctgagcaagcatagtcaatccggggaaccaacaacgcaactgaggcgacagggagcacacaattaaagattactaaacttaacacggcacgagaacacagacaacgagaaaacagggctgtggacacccatgacaagagcttaacaacagcagaaaggctggaccccgaacataaacaactaagcgaccagcaacaaccacagaactacagcaacaatatgctatgttataagacctcagagagacattagaagacaggaaacagaaacacagagtctagcgc

SEQ ID NO: 611212 - DNA, 868 bp, Homo sapiens
gagcggaaggagctattcgcagagaaacagcctcgcacaaaaagccacctgaccccgaaaccctgcgggaaatctgtttcctgtgaaagtgcctgtgcctccggtgcattgtgcggtttccctgatcctctctcccaaattttcctggcaggggattgatcgaggcgacatttatgactggggtgggcgagggagtggcaggttctcgatacccaagttacaggtgcaggacgtcataggccaatgcgtagccaagatcgcgccgacctgtatgcttgagggatgtgcgccgggattcgaaccaatggactgtgcccaatcctaagccctgctgaggtctttgtggaaccgacatgacccactctttggtttgtccagagaccagtgagccaggtaacgagtactgtggtatgaccaagtgcaaaatggcacatgccactaacacacttgagaaggtctgaagaccacatcaagttgagaacacgatctttgggatgtgagattcagtggcacctacccgacgtgacaactagaccatgactatggtactacaagcaccccatcactacttaacgagcactttgaactcactgtgcaagaaatacccgagttgggatggcagctttacagacatcgtcctgtcatacaatcggcaaacaacacattccgcgaccgagcctcttctgggtaacaccaacagacgccgtccttttgcacgagaccccacggaattgtaggtacaaccaaatgatagcgaacactccagcaaccaggtgtcccctctccccaaaatgggttggaacgctattggctgattatcccccaagtattcaattcggtggtattcgccaggatatgcccaatcccg

SEQ ID NO: 611213 - DNA, 409 bp, Homo sapiens
  misc_feature (287)..(287): n is a, c, g, or t
aagaagtttctttaaaggtgtcagagaccccaaggtcagcgaggaccagcaccccaaatagaaggaagtgtggaggtgagacccaatttggagcaactggccccgatgcttttgctgcccggaagtcaaggggttcaaggggtggaggctgagagggatgtggtagctaagaggctgagaagctaagtggggccttctcagactcatggagctggagggacaaacactggaattcagtgtccatctaggaggagaggcgcagccgggcatggtggtatgcacatgtngtcccagctactcgggaagttgaggcagcagaattgcttgaacccaagaggtggaggttgcagtgagccgagatcatgccactgcacttcagcctgggtgacagagcaagactccttctcaa

SEQ ID NO: 611214 - DNA, 496 bp, Homo sapiens
  misc_feature (41)..(41): n is a, c, g, or t
  misc_feature (95)..(95): n is a, c, g, or t
  misc_feature (97)..(97): n is a, c, g, or t
  misc_feature (234)..(234): n is a, c, g, or t
  misc_feature (379)..(379): n is a, c, g, or t
  misc_feature (491)..(491): n is a, c, g, or t
gacaccaccgggcggctggtatgtgtccaccggcccctagngcctcgagcccgcccctgggagacgcaggctcatccccgcggagagagcccgangnctgctccgaaacccgcgggagggcacctccggtcacccgagccgcaaatccccgccgtccgaagaaggtgtcgccccgggctggcggcccagcgtggcttaggcaggtacaaccggcagcgccgccaaagccctggntaagggacgcctgcgggaagttcacggggaaggcgccggtgtctgaggtctgagaagacaagcggccaccggaaaaaggtgctaattgtttgcagaccccgatccatcgacaccccaaggaaattgctgtgaacaaaatttcaangagggcctttttcgaatagacgcatgaacggtgttttgtgtctggattcgttcaagcttcccggattcatttgggaatctagcttcttgctttgccttttccaggcgcgaancaaca

SEQ ID NO: 611215 - DNA, 129 bp, Homo sapiens
accaatcagcgccgccagcaacgatttcagtggattttgactcatcatgctacccagacaggcaatagcgaataccatcagagcaaaatattcggccggcccgaacgccagcgaccaacgcgccaacag

SEQ ID NO: 611216 - DNA, 1154 bp, Homo sapiens
tgtgtgtagattcggctttgcggggctattgtcgttggagaggatcgttttgtggtgaacacaattcgtggcgtgatgcttgagggaaattttaattaaacgcatgggtgaaaaggtttttcttaatgttcttgggattaagtaatttatttagaaggatggggctaattggcctgtaatatatggcagacgagatatcggcgatgtagcatagtcggctatatgttgtggatggaaatattggctaatagatatagggaaggattgggaaaagcaaataatgtacgttttgtttgacaggtgtatgcatatgttagggctcttttggattctggaatatttttagatggacataaccaatggggattggggcatttaaaatgtatgggaatagaattggattgaaaaccattgtttattcagctatacctatagggctatggcctcaaattttcttcgtcattgtcgcgtagttgatttcgatatcaacggcaactctaaagtggtaagtggcttccagtactcaccagtacaggatactgatatgtcattccttgcgtaatcattcacggatggcgctcttgttgcgcaaatatacccttaactcgatagatggcgttccgcccaatgcaattacctctgcaagatctctacctagcggtgaactagaagatgttgcgcagtttgcaggcaacagcgccggcaaggactcttattaatgcaacttactgaagaagaaaggcctaaaaacttcttaaagagcatgctacataacttactaggctatctcgcctaataggagtagtgttacaaaagacggatgatattgaatcctgtcttggtgaagagtatcaggacacagtatattcaagcaaagcgagtgacaagtatgtgtgaacgagaaaagtgactatcagtcaaaagttgggctaaagcatagattttttgtagtgttaccatctagatgtcagcataacgtatgtgtgggacagttcgagctggcattaggctatccattgtcggtcttggattttgtaaatcatcactgaatattcatcacatgtaaacaagttatcagatacaaagttaattttaatcaagctgttatttttgtactgataatttcgaaaatccgagttcgagaacataagcgc

SEQ ID NO: 611217 - DNA, 233 bp, Homo sapiens
ccctaagggcaaaaaagttttgttttggggcttaccccggggaaaaaaattatttttttgttttcccaactttgcttttaggggcatgaccctctttggagctttatggtaaaccaaaatttttggtcctttcctgtccaaaaatttttttcccttgtgttagtgaagcctgggttttccgggttaaatgattgggacccatgtataaaaagtaaaatttttgccaaatttta

SEQ ID NO: 611218 - DNA, 629 bp, Homo sapiens
gcccaaggggtggtggacagaaaaatggatcaacacactgtggtccatccacacagtggaatattactcagccatgaaaaggaagggaatcctgacgcaggctacagtgcggaggcatcttgaggacctcaggctcagtgagagaagccagacacagagggacaaatgccgtgtgattccactcctaggaagtccctggagtcatcaaattcacagagacagaaagtaggatggggatgccagggctggggagggagatggggagtgagtgtttcatagactcaaagagtttcagtttgggaagataaagttctggagagggtggaggtgatggttgcacagccacgtgaatgtgtttttaacgctgctgaactgtgcacttagaagtaggtcacgctgggcacagtgactcacgcctgtaatcccagcacttcgggaggccaagacgggtggatcacctgaggtcaggagttcgagaccagcctggccgacatggcgaaaccccgtctctactaagaacacaaaaattagccaggcatggtggcgggcacctgtggtcccagctacttgggaggctgaggcaggaattgcttgaacctgggaggtggaggttgcggtgagctgagatc

SEQ ID NO: 611219 - DNA, 1765 bp, Homo sapiens
  misc_feature (1285)..(1285): n is a, c, g, or t
  misc_feature (1295)..(1295): n is a, c, g, or t
  misc_feature (1441)..(1441): n is a, c, g, or t
  misc_feature (1488)..(1488): n is a, c, g, or t
  misc_feature (1525)..(1525): n is a, c, g, or t
gttgtcacttatctaatgtcgtcctagtttccttaatgtggtcatattgtaattgtggcccccaacaccacgtcgtcggtgtgttataaatgcggaaccacccctcctcctcccttcggggttggtaatataatgggggcccctacagaggaaaaactagggtttttttaggaagtggagtgcaaacacgcaacagagtggctctcaagcacactgtatctgacacacagtggtgtttatataacctcactgccataatatatcgtgtcccaacctcttcgctgcgctatagttaatgaaataggggcggtcccccaccactcggtaggataggggtagagatcgctctgtgcactctctcttagaagaagtatttatagtggttgagaggaaacaccctgtttttaagggtggggtgagaaaaccccacacggggaagttcctaccaatgttggtgcacctcggggtaaacttcgctcactgattgatgttgaagaaagaaatctcccacggggtgataaattgcctctcaggtatgatggtataataggtatctcctcctcatggcctttcctaataggagaggggatgggtaagggaaaacttctttttggggaaattatataaatgacgggaatatctatagaaatggaatttatacccgcggggggtcttattatgtgataacttccactcataggttgctccaccgtaggacgaccaaccacaaacgttgtggcgtttatcaagagcacccccacagaggggttttcaagaaggtggacacaagtatgggtccactctcgacggctatttcctcccccatgaaaatgggtctaaagaaatgactctcgtgggagatttcacgaccaacacttggtttcctccaggaatataagtctctcgcctcatataagggtatccccagtcgacatgtattagacgagatgtgatgttcttataaaagaggtttctgtgtggttaaaaaaagcgtattaggggcgtctcccactgttggagtctgaagtatttctctcacaggagagtttttgatagagcgctctctcacaaggagccacacgcgcgtgtttaaaagtcacacaggtgtctccgaccacaggtgtcttttctggacacccccccccccctctcacacatttgagagagagtgtgcccccctctctctccacgagaaaagggagacaccgtgagatctctctctgggagagatatttctcaagcgctgctttgagagagaggagcgcactacgcgcggtgtattagntacaccaccnccccctctatattttgtagagagggagagttctcatcgccaccagctctccttttctctgccacagcgcttctttatacccaacggagtcccacatgtgaactccacgcggtgtctcttatgagagagaagccccacgcgcacagntctaataagggagcacacacgggagaatgtcttgtgtgggcctcgtntgtgtgagacacacggagaatctcacagagatatccnccttttgtaaaggagagcacattctctgtctttatacaagagagtctcgtgaaaattgtatgacctcatatgtgaaagtgtcttctgagattttctataaatattttttgagaaggttaaagagaaaacacactaaactttaaggttctaatggggctagagtttatcgcccccacgttgccacgttttctaagcgcttacccaatgaatgaattaacatgagcttgcgctccttagcca

SEQ ID NO: 611220 - DNA, 465 bp, Homo sapiens
  misc_feature (234)..(234): n is a, c, g, or t
aatagtaggtgtatatatttatggaatatatgagatatttcgggccaagcatgcaatgtgtaataatcacatcatggaagatggggtctccatcaccttaagcatttatgcattgcattacaaacaatccaatgatactcttttagttattacaaatgtacaattaaattattattgactatagccaccctgttgtgctatcaaacactagggcttattctttctatttttttngattcatcagccatccttacttaccctccaaccccccactacgctttccagcctctggtaactatccttctaggctctatgtccatgagttaagttattttgatctttagatctcacacataagttagaacatgtgatgtttatctttctgtgcctcatttatttcacttaatataatgacctccagttgaatttattttgtctaaagtttttcttttaacattggttttt

SEQ ID NO: 611221 - DNA, 246 bp, Homo sapiens
ttactaaccctaatcgcattggtcatttaatttctttaaattggcgatggatatggtgatattacatcttttctctgtaagcgtttggatgtgtttcgtctgcccaagtattatactttttattccttataagtaattgggtatgaatgctgagtccttttttctgttcaggtggtttgtgccagattttattgtaccaacaatatggttatcttatttggtcttatttgggcgattagggttagt

SEQ ID NO: 611222 - DNA, 828 bp, Homo sapiens
gtcacggtattatagtacaccttgttaccaaataggtgttctcttccccacccacctttgagctttgctctaaaatacattcaggttccaagcctgaccatcctgtttaatctatcatactcttccaggtttttttttttgggtctaaggctggaactttttctttttttcagctgaagtcttatgacttttcatgagtcaaaatggttgggatttcagcaagtcaaatctggcaaaggcctgcatattttttttaagattatatgaagtctggtgcaaaagctttaaaaaaatgcctctgcctggcctgcaatacatgcaaggtatgtaacttagtctctcttctcagacactgtgggtagttatttccggtgtttccctttttttaaaaaaaaatatggacttatgggggtctatctgagcaggttctaacattcacatgcaattgggtgtggccattagctataaggagtcaaggggcagaactggtccgatatcggaagtgtctctccccttttcccatgacgtaaatacataggtgtgtcccaggattggtcaggttttcccccctcctaatctggtacattaaggtggtactatgtgtcagtacaacatttaacttcgacctggcatgtcccagtgattcatccagcagggataactgctgggggcgtgacccacactggagtatccgcaccgtggaaatgggccctaaggacagcggcaacgtcggcacagttaaaaacaaaccggggggggggcaaacaacaaacacgtctgcacaacagtgcaaacacccaacggcagcttacaactggacaaagagat

SEQ ID NO: 611223 - DNA, 306 bp, Homo sapiens
gacatataggcggtggtggtgcatgtctgtaatcccaactactcgggaggctgaggcaggagaatagcttgaacctgggaggcggaggttgcagtgagccgagattgtgccattgcaccactctgcactccagcctgggtggcagagcgagaccctatcacacacacacaaaaaaaaaaaaaaaaaaaaaaaaaaaaggggaatttaaaaatttcgagattacaacccccgggggtgtttgtgtgcacagatgaaagaacatgttaaaaacccaatgaaaaaggggtgcccatctctgcacccaag

SEQ ID NO: 611224 - DNA, 183 bp, Homo sapiens
agaggtactaccactagtctgcagagataatgctggtcagtcgagttcctctcttctagagaaattccctgttcgcccttcctagtctaactccagacccccgccctctctcctgagcttctctttttttatttgttttggccatttccggaatccttctcatcccctttggttcccaactcc

SEQ ID NO: 611225 - DNA, 863 bp, Homo sapiens
  misc_feature (4)..(4): n is a, c, g, or t
  misc_feature (75)..(75): n is a, c, g, or t
  misc_feature (101)..(101): n is a, c, g, or t
  misc_feature (109)..(109): n is a, c, g, or t
  misc_feature (134)..(134): n is a, c, g, or t
  misc_feature (151)..(151): n is a, c, g, or t
  misc_feature (157)..(157): n is a, c, g, or t
  misc_feature (209)..(209): n is a, c, g, or t
  misc_feature (736)..(736): n is a, c, g, or t
  misc_feature (862)..(862): n is a, c, g, or t
gtgnccgtacaagctgactcacgagatactacagcccgattacactcgccactgagtgctttgtgacagacagtnctgagtgcacgaagtcacactgtctntcagtcanacgggctttgtcaatatctctgatnactccagcccctctacnacaganactaccctacagtctcagactcacacacccagctctctccaggacaagaggntgtcctggtccctgtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcactttcaacggcttccgcacggtcatccgccccttttacctgaccaactcctcaggtgtggactagacggcgtggcccaagggtggtgagaaccggagaaccccaggacgccctcactgcaggctcccctcctgggcttccttcctttttgcaatgaccttcaacaaccggccaccagatgtcgccctactcacctgagcgctcagcttcaagaaattactggaaggcttccactagggtccaccaggagttttcccaccncctcaccagtttccaggtggtaagcaccaggacgccctcgaggttgctttgggatccccccacagcccctggtcagtctgcccttgtcactggtttgaggtcattaaaattacattgaggttcctna

SEQ ID NO: 611226 - DNA, 579 bp, Homo sapiens
  misc_feature (155)..(155): n is a, c, g, or t
aacgccgcgatggctgcgcagcgagagccccaggtccagttcaacacttgtattcggttggtgatggtggtactggaaaaacgaccttcgtgaaacgtcatttgactggctgaactttgagaagaagtatgtacgccaccttgggtgttgaggcncactcccctagctgttccacaccaacagcaggacctattaagcttcaatgctactgggacacagccggccaggacgaacacttcggctggaactgacgagcactggcctattatactccaagccccagctgctgccactcactaactgctttgatcgtaacactcgagcagttacttacaacgaactgtgcctacactggcactagacgatctggctacgagctgtgctgaacacacatccccacttgtgctcgtgctggcaacccaacgtgcgatcttaacggaccaggacacagtgaacggcgaaactccaccgctcttccaccgcacaagaagaactcttcagctactaccgacactttctgccaacaagctaactacaacctttgcaacacagcccctttcctcctggctctgctaacga

SEQ ID NO: 611227 - DNA, 508 bp, Homo sapiens
  misc_feature (381)..(381): n is a, c, g, or t
  misc_feature (507)..(507): n is a, c, g, or t
ttggaaaggttttttttttgccatagtttcccctttttaaggttctggaaagttttcttttcccaattccttgaccctcccctgtttaaaagccccttcttccttcccttgccgggcagggcatttaagggtttccgcacggtcatccgccccttttacctgaccaactcctcaggtgtggactagacggcgtggcccaagggtggtgagaaccggagaaccccaggacgccctcactgcaggctcccctcctgggcttccttcctttttgcaatgaccttcaacaaccggccaccagatgtcgccctactcacctgagcgctcagcttcaagaaattactggaaggcttccactagggtccaccaggagttttcccaccncctcaccagtttccaggtggtaagcaccaggacgccctcgaggttgctttgggatccccccacagcccctggtcagtctgcccttgtcactggtttgaggtcattaaaattacattgaggttcctna

SEQ ID NO: 611228 - DNA, 447 bp, Homo sapiens
ctagagtatccccgcctggagctcttgatcccctggagtccgcacacatccgcgggttcatcacaccagggatctcctcgcgtcctatctggaggctcaggaggactacctgtgctcgcgaggccaagctcctaaagcgcgaaggctcgccctccgcccccaccgccctcacgggacctgatctaggcctacaacacgctggccctgggtccccctgaagctcaagcccgcccatgagggcctggtgcgccaccggtgcaatgacgcgggccgcctcactccatgatatcccgcgcgaggagctccggcacacgccccatctgcccctggcccccctgccgctcaatgagggctccatcacgcagggcccccctctcaattacatccctgcgcgttcatcactggctccaaaaagcacgacttaccccccctcatcggcagccccgc

SEQ ID NO: 611229 - DNA, 682 bp, Homo sapiens
cgcagtggctctcgcctatgatctcagcacttcggggggcagatcgaatcgcttgagctcaggagttcacgagtagcctgtgctaacatggcaaaaccagcgtctctaccaaaaatacaatgtacattagtcgggcatggtgatgtgtgcctgtggtcccagctacttctggaggctgaggtgcggaagattgctttggagctgggctaggcgcaggttgcagtgagtcaggatagcaccactgcactccagcctgagtgacagagtcaatcaaaaggaaaacaaagacactactgagagacagtgtacccgccccaaaatcagcaaatataaatgacagtcgtatctaagtggtgccacaactagccttgaatgtagcagcagcatgacgaactttggactagacatctagtgtcttaattcaaacattcttacacagttactgtgacttatctggttccccactctattcacttgatacggcatgatgggtctggatatttgtatagcttgggatcgaacagaattaccatacttttaaaacagaagtaggctgggcatggtggtctcaagcctgtaatcccatcactttaggagacctgaggtgggtgggcttgcttgacgctctggagttcaagacgcagggccggggcaatgttagtgagacctgtctctataccaa

SEQ ID NO: 611230 - DNA, 375 bp, Homo sapiens
  misc_feature (32)..(32): n is a, c, g, or t
  misc_feature (71)..(71): n is a, c, g, or t
cgaaaaccccgggccgcacgcaactactcaanttcttcaagctagacgatgatcggcgtctggtcgacctnccgggctacggttatgcaaaagtacctatcccgctgaactgcactggcagcgtcacctggaagcctatctgggtggccgggagagtttgaagggtttgattctgatgatgacatccgtcatccaatgaccgacttcgacctgttgatgctcgattgggccgtcgccagcggcatgccgatgcacgtcctgctgacaaaggccgacaagctgacatacgcgcagccaagaacaccctgctcaaagtgcaggcagaaatccgtaagggttggggcgacgcggtgactatccagctgttctcggcgc

SEQ ID NO: 611231 - DNA, 849 bp, Homo sapiens
  misc_feature (849)..(849): n is a, c, g, or t
gagccgagatggcaccactgcactccagcctggcctataagagtgaaactgtgtctcaaaaaaaaaaaaaaagttacttgggttcatgcctgtaatcccaataattttggggaaagaactggaggtgggaaagggtcacttgaaggccaggaatatttggggaccccgtttgaaccccaaggaagttttgaggggctcgcagtgatcgtcctgcattggtcgccacacttggcactccaagcctaaggcacacagaattgacgaacactggtctcaactatcagagggaaaaaaatttgtgctgggcaacgggtgggctttaatccgccgtgtaaatcccaaagcaaattttggaggaaaggcgctttggagggccggaacagtatcaacggaagggtccacgggcaagatatttgggaacaccaaatcctggcgtctaaaccacctacgtggaaaaacccgcaacctttcttactaaaaaaatgtcaccaaaaaaaatgtaaaggctgggcgcatattgctgtggcgcaagggcccaccctgtggttaatgttccccccaaagcataaaataccggagggaaggcgccttggcaagcgcccactgggaacaaaaaattgtgcggcctttagacacccttgtgggagacggcgttggggaacgcctttgcgccatcgtcagaccgctttgagaagaaatccggcacaaccacatcttttgtcagtctcccaagccctgggtggttcgggccatggctggcaaacagaccctcttgtgttcgcccagaaaacacacgaccaacgcgcgcgggcggcgacaaaaaagccccccaaagcttaacgtagcatn

SEQ ID NO: 611232 - DNA, 433 bp, Homo sapiens
taatcggatagtacttgagctttcatgatgttctcatgggccgttctgggagatgccagattggtgaaagaagctccagtgtagctaacacgtgaatatagtgagccttagtttccactttagttgtctgaagttctttctctatctgggaggcctggctaggcttctcctgataattggtgtgttcattcggttagtccacaaatatttactgagtacctcatctgtgtgtcagattcccggagaagccccgttatatcagctgtactctcctattttccctcgacctcctcccagtactttagggaagggggcagatgagaattacagccaggagaggacaattatgtttggtagtcccatagtgctctagtactatcctggaattacaatccaccgtaggtatggtggggggtgggtcagaacatccggg

SEQ ID NO: 611233 - DNA, 356 bp, Homo sapiens
atggtccgagccgtcaatccccactgacccactaactcgctgtcagccatgggctcctctccaggccgtgccctgcccgctcccatggccgagttgaccctcgtacccaatgagccacgctgctcctcgcttcatccaggcctctgctctgaggccagctcctcaggctcggtcagctctggtaaaacagcagccctaacctcggggtcctctgtctcctccaccagtttgtatcccttctacagttctcactcccttcacagcagcaggtggaatggacttgtttgaatccccaattattatgcagcttccggaaagaaaacatttttgccccagcaccttttgggaacctatgg

SEQ ID NO: 611234 - DNA, 212 bp, Homo sapiens
ctacaggcagtctaggatttgaatattattatcaagagcctcgagatctaccagacaaaactggtgactgatgacccaacgtgctaagacgaaaaataacctggcatcctgctatttgaaacaagggaaaaggggttttttccaacacaatgccaaaggccaaagtgggaaacaaaaaaaaaccaaaaacccgttttggggatttaaaccac

SEQ ID NO: 611235 - DNA, 272 bp, Homo sapiens
  misc_feature (35)..(35): n is a, c, g, or t
agttcgacggagactctctctgtgatactttctgnttggttagaatctgtgaaggaagctatcaccagggaccgagaaaactaagctcccggtgaagaagccagtgtacagatccaagaggaggaggagacccttcaggacgaggaggttagggatgctctgacagacaattacatcccttcagtctcagaagactggagggatccaaagatcgaggctctgaatggcaactgttctgacactgagatccatgagagtctccgtcgaactgt

SEQ ID NO: 611236 - DNA, 896 bp, Homo sapiens
agcggaagtcacgggagggcgtagcaccgaagtggtagagagctgtggctccggaacgcccggcaggcccagagacgcagcgagatggtgcctgaaagagagagggcgttgatgaaagcgcccgtgggctggagagcaatgccgtgacccggccaccggtgcatgccgctgaggagaccgcggacagccccggaaactccctatccggaggttctttctgctgcacatccaccggcaccggtctctctctagaccccagtctgaaatgaaggccataccgggggactacagaacctgtggttcaagtttcatagaggcataactgtagatccctcggattatctgcttcaatgtgaattactgcctgccgtgctgccgttagaggaagccagcggagctcgttcgatgtggctgcgaagtgtgcccttcgagagtggagactaaggcacttactcgtcatagggtagcgtaccagcatcaagcacatcttctgggaatactgggcattcatctctctcaaattcagtcttctttcattcaatacaacaacagatctctactatacctcggcagccgtcagcgaggaaaccgtcatggaggaggcgcgtggagcacactcggcaagatggcccgcgggctggttgacaacactgtcggagggtcgtcgtgcctctattgggacacattcgagcactggcttgccatggacaacagcttccggacaaactgcctcaagcgatggaccaggaactagccggactctctgacaacctcgcgtgacgctacccaaagcgcatccccaccacgcaacacaagaaccaaacaagccaagagaaggggtccagaaggcaaactcgccggcacagaagggggccagacctcgccacagaaggcgg

SEQ ID NO: 611237 - DNA, 281 bp, Homo sapiens
  misc_feature (17)..(17): n is a, c, g, or t
  misc_feature (111)..(111): n is a, c, g, or t
aaaattttttttttacnggcccgggtggagggggaatttttacccccccaaatttttttcccttttggggggggaaaagcggggccccccaattcccaagggcttttgggncgtgtttttaaaaacccccctggggcaggggagggggagggttttggttgggcaaaatttttaaaccccccccaaacccccggggggccccccacctttccccctttggttttgggggggtttggggggggccccgggggttcccaaaaaaaatttgggggcggctccca

SEQ ID NO: 611238 - DNA, 423 bp, Homo sapiens
gccggcggggtgtaaggtgatataacgattaaatgctgaattaatctatgaataaaagaggcaaggcttttgctgaggaggaggcttttgctttaggaggggcagtacacacaatttgacgtaaacctggaacttcagtggtatcaatcaaccaacaacagcttattgtgagactactctatgctgctcactttaccaggtaatagggaaactgctgtgaacaggcatgcaaagtagctttgccttctctgaagaggagctgtgaaagatcatatataaccatgttaatttcacaaaccagtaaggatggtgaagaaaacatagtaggataaaataaggtgtaaaggcagacattggtagcagcttatgcctgtaatcccagcctactcttagatcttaaactttataactctcagtcccgcc

SEQ ID NO: 611239 - DNA, 146 bp, Homo sapiens
tatcatcgacttgctctgctggtattatcccgtgaaccttctcttcccgggatgtactttttaggttgggtctctgcaaactttatagcatcaaactgggccatcttctcacacagtttcacttcgcccaagacagcccggaaaga

SEQ ID NO: 611240 - DNA, 629 bp, Homo sapiens
catagaaaaagtaagtgttttattttggtgtataagtgaattaatattttttggacgtttctttaaatggcatttcatttcttctctgccattactccctcttgtttttgaagcagcaaaaggcttttgaatagtctttacatttcatttataacgtgtttcaaaatatctaaagttttaaaatgtatattctaattcccaagtttttaattgacaaacttgttagtagtatatgtctgatttttacaaaataatatatatgtttagaaaaatttaaaaatagtacagaagaacttgtaatgaaaggcaatagtcctattattctctgtatccattgaagccaccactgtaagtcacttttgttattattttatatatacatgcacatattattcatatacatatttttaaaattttattaaacattcaatggatatgtgccagcctttcatatgaaagaaattacttgttcaaaactgtttctgtgaaattttgatcaatattttttgattataggtagctaaagcagccttttatagaaagaatgatcctttagatgctgccattttttaccttgcaatgaaaaagaaagctgtgatttggggattatataggtaggtaaaaaaaaa

SEQ ID NO: 611241 - DNA, 489 bp, Homo sapiens
  misc_feature (204)..(204): n is a, c, g, or t
  misc_feature (260)..(260): n is a, c, g, or t
tgaggatccagtgtgaagaagttgcagagtgtctttttattttattttaaaaagggggaaggggcttttggttttgctttgttttttggatgaaggagtgagggaaatgagggaatacccccaccagaaacatactgaaaagcctgcctgtctcttgtagatccttctttgtcttgttagtggtacatgggaagttatgttttnactggtgtgtgtgtgtgtgtgtgtgtgtgtgtgtgtgtgtgtgtgtacttaatgangggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccata

SEQ ID NO: 611242 - DNA, 87 bp, Homo sapiens
tttttcccccttttttttttaccggggggggggggggaggggtttttttccaatccccctttgggggagggtttaaattaggcccca

SEQ ID NO: 611243 - DNA, 2084 bp, Homo sapiens
cccccccccccccccccccccccccccccccccccccccccccccccccccccccccccccccccccccccccccccccccccccccccccccccccccccccccccccccctaacctctgctacgtgtgctgatggccctgtgtgccttgctgaactttgtgcactgagtgcccctgccccttgctactttcacttgcacacgtgctgtgactacttggctgctgatgctcacatgctcctgccacccaacctatgccacatgtgtgccacaccaactgtgcctacctcactccacttttccactctcctccatgcaacactttacactgctccactgctgcacgctgcatgccctccccaccttcctctccaactgcacactgtggacgcactttgcttacacacctgtgacacctctcttctctcccacctcccaccgcatgctgctcccccttgtgccaatgccactcgcccccttgccttgctggcctctgcaccccctccacccttttctaccctctccccactgctgcacacactgctacccccaccttgcaccctcctgctctcttgccactgccccacctccactccccacgctcctcccccctaactccactgccctctcccttgcttctcttgctctgctgcacacccccctctcacccaactgcctctcttgacaccgcaacaccctctccttgactgccctttgcacaccgcactccctgcccactcctcctctcgatgcacttgccgcctctctctctccaacgcactctacaccaccactgcctttgtgcttgcccactgcacgcacttgccttgctactcctgcgaccttgcttggcgcgtgtgcaacgcccttgcacccttgcggaatgcttggacacccttcccttgcaccaccccaacttcaccttatttcctcttggcaccaactcctgtggccttgcttgcctgcacacccctttggggcttgctcgaacctcttgtggccccttcctccttccttgcgcccttccacgcccactacccaacttccttctgctgcggcttcccctctactgcgccggcaccttctcggacacccttctgcctccctcgcggaccgcccaatcgcggccaaccgcttgcgggaccgctgcaccttcgcccacaccgcaacctgcgcaaccccttggcaactcgccctcccttcttccacaccttggcggccaacttcaaccccccaacacccctcccttggccaccaactttcttctcccaccttaaacccttggcgccccttccacaaacgtccccaaccacaccgccaaccacccaaacttctccctcttgtgccacaacggcggctaccccttgtctcccttaaaacccaccgcgctttcccacaacaaacgccgtcacacaccgccaccttcgtgtcaacccaacgtcctctccaaaccctactcgtcttctctgccccctaggcctgtccggcttgtcaaacaccccccccacggtccccccccgtggcctcgcccccctggtcgaagccctttgcgcaactttcaaccccaagactcgcgccttgcaaacttcttccaacaccctcgccccccaacttttccctcgagcacaagcctttctccaaacagttggcgccccacaactccccaactcaaagcgcgcccctaaacagcgttcactcacacttctggttagctcccccctgttgggccaagacatgggccttcccccaagtcgccgcgttcaaaaactttccccaaccctataagctcgaaacacattttcgttctctcatttctgagacaccccctctcgcgtctgcctctcgattcccctctccccacacagactcctctctttggcctcaaacacccaaacacccctctccttacaagacgcacgcaaacccgcccctctcttctgtcgtctctcttcggtccacctccacaaccccttcttgtcatacccttccgtttgctccgacctctcttcggtcttctccccgttcacacacatcatacccccccacaaccattcttcgttcaacaaccatctcagctcacgcca

SEQ ID NO: 611244 - DNA, 151 bp, Homo sapiens
ggctaggaatacggttcatgcaggagcataggcatcggtggcctacagccgcagtggtaaatgcacagatcgatctcacagaagcaccaccgtacactattgtcacaccaacgtaaacatgatcctcgagttcacagatgaacgactcatg

SEQ ID NO: 611245 - DNA, 451 bp, Homo sapiens
  misc_feature (77)..(77): n is a, c, g, or t
  misc_feature (118)..(118): n is a, c, g, or t
  misc_feature (438)..(438): n is a, c, g, or t
gaggggcatgagctgattcacattctgaaggacctctctagctggccagtgctgaggaggttggagagagaaagggntgaaagcaagagagaccacgtgcagggcctgttaacagggnttgcaggcgaaagactgtgggtgctgtggctcccctagactaggactccaagtgccctcctcttcccaaagagacaaaaggccacttgcacttgaaaggaggttggggaaaatgattatgattcttgaacactatggtaaattatttttcacagtcttttctcaaaagaatacaaaatatttaacaatagtttttaatctatgttaaatataatacaatttatagatgtccctaagtgttttaccttaaataagtgtatcactgtttttcccctgttggtgaatgtagcgctgggataaaatgcttcttaccctataaanaaatttctgtcga

SEQ ID NO: 611246 - DNA, 205 bp, Homo sapiens
cagtggggactgcacgacctggatcaggcactgtaagtctgggtagtgatagatgactatagatagcttctgtgttgaccgaaaaatcagaataggtgttggtatagaatggtgtgtctcctcctaccggtggtgttcgaggaagggtggggtagcggttgcggtcggttaggagtataagtgatgggtaccgaggcgacgaagt

SEQ ID NO: 611247 - DNA, 202 bp, Homo sapiens
gcaacagctatctaccaggctcgggaagtttgtcgcctctacctataaatcttcccactattttgctacatagacgggtgtgctctatttagacatagtgcttagagtagcccgcactggtttacgaggggtcttcagctttggatctccttgcaaaggttatttctagttaattcattctgcagaaggtatatgggttagt

SEQ ID NO: 611248 - DNA, 106 bp, Homo sapiens
ttgtaaaatatccttcgtttcccaaataatctcctgaaaattgttgtcgatacgttacaaggaaaattgtgtgggaactctccgtttcctcccccaaaatgaagca

SEQ ID NO: 611249 - DNA, 448 bp, Homo sapiens
  misc_feature (7)..(7): n is a, c, g, or t
  misc_feature (14)..(14): n is a, c, g, or t
  misc_feature (86)..(86): n is a, c, g, or t
cttgttngaacggnatcttttcctttttcaagccgggaaggtttcgaggccaattgatgggagaccaccggggatggccaggtgantagagccccgattgcccaaaccctgggcccacttgtaactctgtgcaggcatagcggaccattttcttagccaggcggccgcttgattcccagagaggtggcaaccaagtcagcactttgggaagcttgaggtgggtggatcacaaggtcaggagttcaagaccagcctggccgacatggtgaaaccctgtctctactaaaaatacaaaaaattagccaggcatggtggcgagtgcctgtagtcccagctactcgggaggctgaggcaggagaatcgcttgaacccgggaggcggaggttgcagtgagtcgaggtcgcaccattgcactccagcctgggcaacaagagcgaaatccgtctca

SEQ ID NO: 611250 - DNA, 907 bp, Homo sapiens
cggcaggacaggtgccggctgtttgcaggagaggcatgtgtgtggagaacgcctaggagacacgtgggtggccaccgaaccctgatcgtgcaggtcgagaaattcttccaggataatatgtggtggatcgtgtctgcctaaaagtgagtcaattctgcccatgagcaagtcttccagaacggtggggccctcgacgaagaacgacctgcaaagccgggtaattctctgcgaaaggacaatgtccaaagactcatcgtgaggcactccatgtctgtcctacagacgaagcttccgcgtggacactggcagggacctaggcgtcccggcagttgtcaggagccagccctgggctcaggtggctccagagtacttgtcaaaaccacaacgatgttccaaaaagccaatttgcattcagcccatgtcagaagtgcgctgataaggaagtagcgtctctatttcctgggatggggagttatatgctctggggtatcagataatattatgctgtaagctagtcagtcaacatccttcgttttcttctgccgttaggcagattcaggtcgattcatggctactgcctatcactgctttgaagttatcaaaaatcttctaagagacacctgccggagaattgcagaaagtggagttgattgagagaactcctgacggtggtccgttgaaggtaactgcttacaggctcagcgtgacctttggagagaaagcaattatcagaatcgggcagacaattactggacacagagttctagcttgatacaattcacgcgtttagcaaacaaggatttgtgaaggggaccacagcagtaagaggtcaccgggtcgtgatacatggatctggaagtacctttgaccgcatggtcatcaagatggggccactctggtatgggcg

SEQ ID NO: 611251 - DNA, 129 bp, Homo sapiens
tgtagtcccaccacacaagctaaacatgtctgatcagatttatacctaaatgtttattttttctaaaacaaaaaaaaggtgattgtaattggtactgtttaaaatgttggcttctttatttaattacaa

SEQ ID NO: 611252 - DNA, 445 bp, Homo sapiens
  misc_feature (61)..(61): n is a, c, g, or t
ggcgagcggaagcctgcctcctcttatgtggggccccccatcaacaagaatgctcgcgccncgttcagcagcatcagacacatgatccgcaagaacaagttccgccccgacctgggcatggtgagctggggtttggggatcaggcttggggagactggccagtgctgtggggaagggcctccccctactggttgcaatatggggtggaaagggatggatttttgctttcagcctactccccccccccagcattggcctagggggcggcttgtggagggtatggggtgagccctgttttgttcccccgcccccaggcagccatccgcagggccagggccatcctgggcagccaaaagcctgtgatggtgaaaaggaagcgggcccgcccccccaagagctcttgagccccctgcccccagagcaataaagtcagctgggtttttca

SEQ ID NO: 611253 - DNA, 999 bp, Homo sapiens
  misc_feature (149)..(149): n is a, c, g, or t
  misc_feature (193)..(193): n is a, c, g, or t
  misc_feature (254)..(254): n is a, c, g, or t
gctgatggatgatgggtgggtatgtctgttgtgtgactacattgtgatgacgtctgtcgtgcagtgtgcgtgcggcctgtgctgcctggtgcgcgttctgctcatgtgtctgtctacatagtctcgtcgtggtctgttcagctctcgtntgttgtgttgtctgctctggtctttttgcgcggttagcccgcantgttgcggggtaaagcgcgtgttcccgccccttttgcgtgtgttcatcatcccgcgccccnagtatgtgttaatgcaggcctccacatatggggccctttgtgtttctctcgcccaccgccaggctatgttcgcggggctcctctcgagtatcccatttggtctcggaggatatcggccgtcgcgcataagcttctgctgtgtggcacaacccctgcttgagcaatgtttttcacattcgcctgggttccgggacaataattgcccgcgcggttttcggccccctatcctcgtccccgcgggaggtcttctatttttttctagcgtgccgaccagttgtccggttaccacagccccgacggcgtccgtcaatatcttcgccactacctctcgccgtctaaaaatattcctcgtttggggcggaccctcctcgcgaggacgggatcgcccaccgtcgcggcgaccgtgacaaacgctctcgtagtagtgtctcctcccttgccaggcgacttctttgaattatcgcctgcggggctgcccataccgcttggcgccacaccggggccacacattttccctcaatgggaagtaccaccgccccactgtcgcttttttgtaagagagccgccacattatcaaccacatataggggggtaacaacgcccgaagctccggagcacaaggacaatcttcctgttgggcgccacccccccgttttaaaagtgtccgtattgtcttcacacgaggtaaaatttcgtaaccctgttgttgttcccccgggtcccccgcgggtttttttctccccac

SEQ ID NO: 611254 - DNA, 106 bp, Homo sapiens
ttcagaagtgatgtctgtgtgctcacagctcactgcttgcaaggtacgtctgggtagtagtttctggaaatgactgtagagtgtgccaaatgtcttttgagcttct

SEQ ID NO: 611255 - DNA, 220 bp, Homo sapiens
gatgagctcggtaccctctcctcccacctctaaaaagaaaaacataaatgaatcaataaaataacagctatatatctgaaggcagagatttggggaaaaaaaaaacagccttaggaacccatggtacaggatcaaatgctcctcactagaaaaaaatgagggttgggcgcggaggtttcaagcctgtattcccaacacttttgggaggccaaggttaggt

SEQ ID NO: 611256 - DNA, 112 bp, Homo sapiens
accgctgagtatactctggttagaaatgagtcgcataagaatgcgatttccgtgtaaaagatctttaatattcaacagactacacttttaaggtaaaagtatgctcagcgct

SEQ ID NO: 611257 - DNA, 277 bp, Homo sapiens
ccagtgaactaacccagtagcctaccttcacagatattgtaatttcttatagatggattgtggagagagatcatgtgtagatgaattcctacatggtcccagtgttttaagtatagtagtcttctgccactctaatattgaataagaagtgctagtggaaaaattgggtgatcgattacttatttccactctgagatcaggtctcatttaccttgaatttgatttgttcttcctcagactcagtgtttctgatgcaggtggtgttaggtctacctgg

SEQ ID NO: 611258 - DNA, 672 bp, Homo sapiens
tctttctccctttctttctctttggtcctttttttctgctttcttatttcggtctgcttttgctgtcttcacttgacgccctctcgcctgttccttttctcgttgtcctttttgtgctgttccctccatgctcgtgttttcatggtgtatgcttggtctccttcttgtttgacggtcatgctctcgcttttgtccgggtctttctccttctctctgtccttgcgtgtttctgtttgctcttttcgttttgcccaatatgcctgttttggtatctctgttagttttgtgtctgctgtcatttagtttctctggtgtcatctgtactgttttgtcccttggtatctcttccttttgcttgtccgctttctctccgcacagccttcaaggccaccctctacggtcatatatatcactcaggcgtagtaagaaaagacacatagttttatcagaatctttgtaataaaatggaagtgtgccaacgaagaattctgataagaactacctctaggtgtgcctccacgctggccctagctattcccattgctgttccattgcctgagacaaactgcgtaaggctccctttctgttattgaagttttatgaatggtaagtcaggctttgctgttcgtcacagtgtcaatatccagtcaggtaccatcacctggtcccatt

SEQ ID NO: 611259 - DNA, 883 bp, Homo sapiens
  misc_feature (87)..(87): n is a, c, g, or t
  misc_feature (90)..(90): n is a, c, g, or t
  misc_feature (108)..(108): n is a, c, g, or t
  misc_feature (122)..(122): n is a, c, g, or t
  misc_feature (125)..(125): n is a, c, g, or t
  misc_feature (127)..(128): n is a, c, g, or t
  misc_feature (157)..(157): n is a, c, g, or t
  misc_feature (221)..(221): n is a, c, g, or t
  misc_feature (780)..(780): n is a, c, g, or t
cgaccgacgtagaacgtaggtcttacatacgtccgctcggcggccgcccggggatttccgaagaaatacacaatattccagatttgnagnactggtaaaaatattcgnggacccaggccttnggnannacctgacctcctccaagaaagaaatccanaaagccttaagactaagacaacttgactctgctgattcttttttccttttttttttttttaaanaaaaatattattaactggacttcctaatatatacttctatcaaggggaaaggaaattccaggcccatggaaacttggatatgggtaatttgatgacaaataatcttcactaaaggtcatgtacaggtttttatacttgccagctattgcatctgtggatgaaagtaacaatgttggccacgtatattctacacctcaaaataaaaaatgtgaatactgctccaaagaaaaaaaagaacagcacgaccaacacggacaaaatcgcaacaccgaaaaaaaagcaagaaggaaagaatgggcctccctggacctcaagggaggagctttgcgccccctttccttttggggggggataaagacacagaccccgctctctcccctcacggaaacaggaacaacagccagcggataggagtgctactcgtccataaaggggagagatctgagctgcacgaccaaaatcagaggcagtaccctctcacaacaccttgccagctccacccttaacgaaggcgctaccctaccacatctttgcgccacgaggagcggcagatttggcncggtgggtcgcatcacgcagagcgagccgaatcaatgaacgcgatctccgatgtagggagtgttccctccaccgctaagtgatgtataatagctccctcgtcg

SEQ ID NO: 611260 - DNA, 792 bp, Homo sapiens
ggaagtgggggtggctatggtggggacagaggcggcggcccctcgacgtggcgcccttccctccgcttctctgtgctccccgacgccccatattggcgtctggccccggaacacgaacatataatcacgaaaacatatcacctacaatcacaaaaagaagagaaaaaaaaaaagaaagaaaagagaaaaaaaaaaaaaagaaaaaaaaaaaagaaaaaaaaaaaaaaaaaaaaaaaaaaaaacaaagaaaaaaaaaaaaaaaaaaaaaaaaaaaaacaaaaaaaaagaaaaaaaaaaaaaaaaagaaagaaaaaaaaagaaaaaaaaaacaaaaaagaaaaaaaaaaaaaagaaaaaaaaacaaaaaaaaaaaacaaaaaagagaagaaaaacaacaagagaagagaaaagagagaagaaaaagaaaaaaaagagagaaagaaaaaaacaaaagaaaaaaaagaaagaaaaaagaaaaaagaaaaaaaaaaaaacaaaacgaaaaaaaacaaaagaacaagaaaaacaagaaaaagagaagaaaaaaaagagaagaccaaaaaaaaagagaaaggaaaaaaaaaaacgagagagaaagaagaaaaaaaaggaagaaaaacaaagacgaaaaagaagaaaacacagaaaagaaaaagaaagagaagagaaaacagaagagaaaagaaaaagagaagaaagggacagagaaaaagaagaaacgaaagagagaagagacaagaaaagaaaagaagaacagaagaagagaagagagaaaagagaagagcacgctat

SEQ ID NO: 611261 - DNA, 575 bp, Homo sapiens
  misc_feature (18)..(18): n is a, c, g, or t
  misc_feature (29)..(29): n is a, c, g, or t
  misc_feature (32)..(32): n is a, c, g, or t
  misc_feature (34)..(34): n is a, c, g, or t
  misc_feature (37)..(37): n is a, c, g, or t
  misc_feature (44)..(45): n is a, c, g, or t
  misc_feature (48)..(48): n is a, c, g, or t
  misc_feature (55)..(55): n is a, c, g, or t
  misc_feature (57)..(57): n is a, c, g, or t
  misc_feature (61)..(61): n is a, c, g, or t
  misc_feature (76)..(76): n is a, c, g, or t
  misc_feature (89)..(89): n is a, c, g, or t
  misc_feature (92)..(92): n is a, c, g, or t
  misc_feature (108)..(109): n is a, c, g, or t
  misc_feature (117)..(117): n is a, c, g, or t
  misc_feature (120)..(120): n is a, c, g, or t
  misc_feature (124)..(124): n is a, c, g, or t
  misc_feature (138)..(139): n is a, c, g, or t
  misc_feature (158)..(158): n is a, c, g, or t
  misc_feature (166)..(166): n is a, c, g, or t
  misc_feature (178)..(178): n is a, c, g, or t
  misc_feature (185)..(185): n is a, c, g, or t
  misc_feature (188)..(188): n is a, c, g, or t
  misc_feature (195)..(195): n is a, c, g, or t
  misc_feature (198)..(199): n is a, c, g, or t
  misc_feature (220)..(220): n is a, c, g, or t
  misc_feature (223)..(224): n is a, c, g, or t
  misc_feature (232)..(232): n is a, c, g, or t
  misc_feature (238)..(238): n is a, c, g, or t
  misc_feature (240)..(240): n is a, c, g, or t
  misc_feature (248)..(248): n is a, c, g, or t
  misc_feature (269)..(270): n is a, c, g, or t
  misc_feature (272)..(272): n is a, c, g, or t
  misc_feature (282)..(282): n is a, c, g, or t
  misc_feature (285)..(287): n is a, c, g, or t
  misc_feature (290)..(290): n is a, c, g, or t
  misc_feature (297)..(297): n is a, c, g, or t
  misc_feature (302)..(302): n is a, c, g, or t
  misc_feature (307)..(307): n is a, c, g, or t
  misc_feature (314)..(314): n is a, c, g, or t
  misc_feature (320)..(320): n is a, c, g, or t
  misc_feature (334)..(334): n is a, c, g, or t
  misc_feature (337)..(337): n is a, c, g, or t
  misc_feature (342)..(342): n is a, c, g, or t
  misc_feature (345)..(345): n is a, c, g, or t
  misc_feature (351)..(351): n is a, c, g, or t
  misc_feature (354)..(354): n is a, c, g, or t
  misc_feature (377)..(377): n is a, c, g, or t
  misc_feature (387)..(387): n is a, c, g, or t
  misc_feature (391)..(391): n is a, c, g, or t
  misc_feature (397)..(397): n is a, c, g, or t
  misc_feature (401)..(401): n is a, c, g, or t
  misc_feature (405)..(405): n is a, c, g, or t
  misc_feature (410)..(410): n is a, c, g, or t
  misc_feature (417)..(417): n is a, c, g, or t
  misc_feature (429)..(429): n is a, c, g, or t
  misc_feature (431)..(431): n is a, c, g, or t
  misc_feature (434)..(434): n is a, c, g, or t
  misc_feature (442)..(442): n is a, c, g, or t
  misc_feature (445)..(445): n is a, c, g, or t
  misc_feature (447)..(447): n is a, c, g, or t
  misc_feature (455)..(455): n is a, c, g, or t
  misc_feature (460)..(460): n is a, c, g, or t
  misc_feature (466)..(466): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (476)..(476): n is a, c, g, or t
  misc_feature (478)..(478): n is a, c, g, or t
  misc_feature (497)..(497): n is a, c, g, or t
  misc_feature (501)..(501): n is a, c, g, or t
  misc_feature (503)..(503): n is a, c, g, or t
  misc_feature (507)..(508): n is a, c, g, or t
  misc_feature (510)..(510): n is a, c, g, or t
  misc_feature (525)..(525): n is a, c, g, or t
  misc_feature (528)..(528): n is a, c, g, or t
gccatgtggctgcataangaagatattgncananagntgccctnnaanatcttcncnaatnttttcgataggagcntctctaatgatanggnctacctcattgcgtcnntgatgtgntgnccanaaagcacaattgcnngtgcacttgcagtttcctnctttctanctcttataagcnaccccanganttagcanttnnggggggtacatcagtgctggncanngttgcccnagtatncnatcaagcngcagtgtgcaacctctatttnncntttgccattntcnnnttnaggaatntcctnggggnactaaanactttngcagggtttttccnagntttgnttntcccgnttngcccaaagccgagcccctgcctnacacagctgncaangaatgngaanctgncattntactctnaaagatggtgtntntgngcataagnttngnctgaaaanctttntccatncccntncntnanacaaataccatgtcatganaacncncccnncnaaagagatttatagncanaattattttattgtaaagattttaactaaagtttttccttttctctc

SEQ ID NO: 611262 - DNA, 330 bp, Homo sapiens
  misc_feature (12)..(12): n is a, c, g, or t
gacaccattgtntggactccagctatgctcaagctttctttcttggccccatacctagaaggaacctgactatttgtgcatttgtgcaatggaagcacagccaggcaccaccattcatcggtggcagctactcaagttgcaggcataatgcctaaaaggagatcatgagcttctccagacaggctagccctgcttaacccagacttatagagtaacaataaatgtcacagagggtagcccattaagctactgatacctagaagtgggatcactttcctccagggtggcagagacttctgggttgctgggagacaaaggtgacaggcattt

SEQ ID NO: 611263 - DNA, 199 bp, Homo sapiens
ttagcactttgagaggctgaggcaagagaactgcttgtgtacaggagtatgatactagcctgggccacatggcaaaaccctgtctctacaaaaaaataaaattagcctggcatggtggtgagcacctgtggtaccagatgcttgagaggctgaggtgggcggatctctggagccagggagtttgaggctgcagatgagc

SEQ ID NO: 611264 - DNA, 798 bp, Homo sapiens
gtgttccctgtgcttatgtctcgccgtcgttgcctgccccgtccctgccttcgtgccccccgcctatgtgaccctgcccagcctgctctccctgtcctcctccccttaaccagccccacggtttcttgcctgtcaggtggccctggtggtgacctggtgctggatagatagcctgtactggagcagctggagcttgagctgcaagttgacctggtgcatgtgctagctccagtgtatgtgtcactgtgaatgcagtgccaaccgtgcaggtggaacacaggcagacccctggcatgtgctgtatgtgccccctgaaccctgagagtgcacttaatcagagcacataatcccactggaactgtgacaccttgaatgtgggtgcttgagcttgggccatcatgtgtagaaggactgacttggaactgcaatcattcttgaatgctgaatacctaaataaccccaattccaacgggtacctgctgagacaaaactattcccacaacaggcgatgaagctgattatacaagagacgcccagtagcaaggagtccagaatgacaagaagatgcgaacccccgcaaacgcacacccccatgggaaaagaagaacgcaacaggtggaacccctaccaagttggttagccaccccaagatggttggcctgaggcattgccaatagggagtttccaaaacaatttggcccaaatgcacgcaacccggagtgccattggcaacacccctagcacacaatcatggggcccattgggaccatacagcagggatgacatcataggaaaact

SEQ ID NO: 611265 - DNA, 314 bp, Homo sapiens
gctcatagaggatcctctctgtctcgcctgacaggtacgcatactagactctacatgtacaaaatcgaatacaggatgatgggagtgacaagacaggtcatctatgcacaaacacggaaatacttcattaccccaactcaacattgaaactgcttacagatatgctgaaattgtctcaatttggctatcagattcggcaggttttcctcacattcgtgtaagaaaaaaaaaccctgacattcgccatcaattatttctccagagactggggagtgggccctcaaaagctacagacaagatgcagtgactataag

SEQ ID NO: 611266 - DNA, 297 bp, Homo sapiens
  misc_feature (3)..(3): n is a, c, g, or t
  misc_feature (17)..(18): n is a, c, g, or t
  misc_feature (26)..(26): n is a, c, g, or t
  misc_feature (37)..(37): n is a, c, g, or t
  misc_feature (56)..(58): n is a, c, g, or t
  misc_feature (60)..(60): n is a, c, g, or t
  misc_feature (80)..(81): n is a, c, g, or t
  misc_feature (90)..(91): n is a, c, g, or t
  misc_feature (95)..(95): n is a, c, g, or t
  misc_feature (108)..(109): n is a, c, g, or t
  misc_feature (120)..(120): n is a, c, g, or t
  misc_feature (124)..(124): n is a, c, g, or t
  misc_feature (134)..(134): n is a, c, g, or t
  misc_feature (139)..(139): n is a, c, g, or t
  misc_feature (145)..(145): n is a, c, g, or t
  misc_feature (148)..(148): n is a, c, g, or t
  misc_feature (169)..(169): n is a, c, g, or t
  misc_feature (180)..(180): n is a, c, g, or t
  misc_feature (183)..(185): n is a, c, g, or t
  misc_feature (193)..(194): n is a, c, g, or t
  misc_feature (220)..(221): n is a, c, g, or t
  misc_feature (230)..(230): n is a, c, g, or t
  misc_feature (272)..(272): n is a, c, g, or t
  misc_feature (290)..(290): n is a, c, g, or t
gcncgagaatttgcccnnagaacccnctaaatccccntgtaaatttaactgttagnnngnagaggaacagctctttggannctaggaaanngccntgtagagagagtnnaaaatttaacncccntagtaggccnaaaancagccncgnattaagaaagcgttcaagctnaacacccactnccnnnaaaatccnnaacatataactgaactcctcacaccnnattggaccnatctatcaccctatagaagaactaatgttagtataagtaacntgaaaacattctcctccncataccc

SEQ ID NO: 611267 - DNA, 692 bp, Homo sapiens
tcaatgcaggttgtcgatcgagtactcagcacagaatgtggatgtcatcctccgaaaacatagtgatcagcgaatgagggaaaaagcatacattcaacttcttgttcacactattgatgagttaattgataagctctgcaagtatatgttaagtagtatcacatgttgtggttggtatgtaaactaatgtatccagaagattggaagagggataagaaatgagagtatcctgatactgtataggtatgtccctttaccgtctattttgtaaatataagatgagtattatttaatgatgtatttgcataagtagtgcaaatctgtgagagaaggaccagctgctgtttagagaaattttctccttccttctgtccttgatggttctccattaaagtatttccttgtttttaattcaagaaaagtttacctttcttatgcttatgttagactatgccagctcttaatgggcatccttttctaacttaggattattcaataacagcgtgaatattgtgttccctattatagacagaaatttgtaacattacttctgagtttgaacaaatgcaagttcacaaaatatagggaaatttttatcgaagtaaattttgaaatgatggagaaatttgcagaagcatcagtaaagttcacgaataaggataatactttatataatgtctaacagtatatat

SEQ ID NO: 611268 - DNA, 183 bp, Homo sapiens
tttgccaggtcatttttcctcttttttttttaattgggtaggccccccaatataaaaccagtcaatatttgccaatgtggaattcccaaattaaaaaagaatcctatgaatgtattcatattttttttatattgaataaccaatgtaacatagataccaatataaataaaagtggtatgccca

SEQ ID NO: 611269 - DNA, 165 bp, Homo sapiens
gcactagcctacagaggagcgcgacagatatcgggatagaacctggagagcctggattggtcggtttccaggacctacccggactgccctgggctgtgggacagatggttcagttgatgctcaggtataccaggatcatctggaccccctggaccaaaaggacag

SEQ ID NO: 611270 - DNA, 141 bp, Homo sapiens
gaagcactggtgtgagtgactcgagcactgggatactgaaagtgtcactgtcctatagacattaacggtctgatttgaatcttttcgaagggactgaataagttggcgaaacaacatgctttagtggtcatatgactacac

SEQ ID NO: 611271 - DNA, 768 bp, Homo sapiens
  misc_feature (30)..(31): n is a, c, g, or t
ccggtacctggaacttcgggtctcggcaannttaataataagatcgaagcttcaggactgagtttagctgtggtggaatgtgaagagatgttgccagttgataacctttaaagattttttaaaattagggggaagagataaattagaaaaataaagatttccttcaagttttataccaaaagtctcactgggctatttttgtattttaaataaattacatgatattttgctggaaaataattttttctcctatcccatcctctccaagcaacttctactcacattataagactcactgtcagttttaatctcccctagtaaaccttttggcctatggtagaagtgactacttctactctgcctcccctgtaccatatatttatttctatcatatttctaatagcttgtggtacctatttatgtttatgtcctactgaaatatatccattaaggctagggattatgttttagtggtctttgtatctcctagtgctcagtaaattgcctggcacatacttaatacatgtttgataaaactttttctggtgccaagcgtggtggcttttgcctgtaatcccagcaccctgggaggcggaggtgggaggactgcttgaagccgggaaggttcaagacaaacctgggcaacaaagcgagaccccctctctacaaaaaaaactttaaaaattagccaggtatggtggcatgcatctgtagtcctagctactcagaggttgaagcaggaggatcactgagcccagggatcctcta

SEQ ID NO: 611272 - DNA, 265 bp, Homo sapiens
caccagtaatagactattaccgagggccatcaagttcatcactacatagttatcaagtgtaaaacgcacttgcctactaacccaattaccgacagacgcccctcttcctctgagtccgtcctaatttcagacattcctacttctcctatctctcccagtcctatctgttggcatcactatattaactaaacagaactgtagaggctactacatgagccacctcgttctttccgcagccctgcacggaacgatggagtagccccga

SEQ ID NO: 611273 - DNA, 456 bp, Homo sapiens
acgagttagtcaggatgttctcaatctcctgtacctcctgatctgctatgcgtttgtgctcccaaagtgctgtgattacaggcatgaggcgctgactggccaaaaattttagtctttctaatagatgtgtagtagtagctcattgtggtctttatttgtatttctctaattattaatgatttttaatatcttttgatgtgcttacttgctgcctgtatgtcttctttagtgaagtacatgttcaaatcttttgcccatatttttgaattaattttcttttattgagtttcaaaagtgttttatatattcttgatacaagtcttttgtgacatacgtgatttgtaagtatttccttacagtctgtggcttgtattcattttttttaacattgattctcacagagtaaaacgtttcccattttggtggcatcgataaacacggggtcctctagagtcg

SEQ ID NO: 611274 - DNA, 261 bp, Homo sapiens
  misc_feature (212)..(212): n is a, c, g, or t
ttccccccttccctttcttttaatagaaatgtttcttggtgaggtgcagtggcttacacctgtaatcctagaactttgggagaccgaggcaggtggatcccttgaccccaggagttcaagaccactctgggcaacatagtgagactccatcactatttaaaaatagaaaaatttcctaggcgtgatggcatgaacctgtagtcccagctacnttaggggactaaggtggaaggatcatctgagcccaggaaggtcaaggct

SEQ ID NO: 611275 - DNA, 422 bp, Homo sapiens
  misc_feature (234)..(234): n is a, c, g, or t
atgagggcatgtgaagagacaccattaaggcttgtgtgagcaacatggctgtttatttcacctgggtgcaggcgggctgagtccgaaaagagagtcagcaaagggtggtggattatcattagttcttacaggtttgggatagggggtgaagagccatgttttgcaggcaggggtggatctcacaaagtacattctcaagggtggggagaattacaaagaaccttcttaagggtnggggagattacaaagtaccttcttaagggtgggggagattacaaagtacattgaagagttagggtggggcagaaacaaatcacaatggtggaatgtcatcagttaaggctatttttacttcttgtgtggatcttcagttacttcaggccatctggatgtatacgtgcaagtcacatggccactcaata

SEQ ID NO: 611276 - DNA, 246 bp, Homo sapiens
cgacaaagtgcggaagataacgtttggaacatacgtcgtgtgttgccagtagcgcatcgccgagcgttctgcttcgtcgacggtcagcatcagataaggctcgctcgccagatcggccagcttgatactatccttgcgcagaagcggatgattggcgcacgtccacaagcggcgtggcgagcgtagtaacagccgggagcggatggagtcccggtcatgcagattcgagacgagtatgattgccgc

SEQ ID NO: 611277 - DNA, 555 bp, Homo sapiens
  misc_feature (421)..(421): n is a, c, g, or t
ggacccctcatggatactcacataagaaaatcatactgtagataacctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgagaaaatttatactgtagagaaaccctggagatgtgaagaacgtggcaaagttctttacctcattctcaaaccttgataaacataagagaattcataccggagagaaactgtacaaatgtgaagaatatggcaaagcctgtgaatggtccacaaacctgaatgagcagaagaaattcatagtgcagataaaccctacaaatgtaaagaatgtgacaaagcctttaaacaattntcgctcctgagtcaacataagaaaattcatactgtagataaaccctacaaacgtaaagattgtgacaaagcctttaaacggttctcacacctgaataaacataagaaaatcatacttgaggtaatccgtgaggg

SEQ ID NO: 611278 - DNA, 143 bp, Homo sapiens
aagaagccatcaggatcgcagcgaaaaattgtgagctgcaagctaggctgcaggccaggaagaacagcatcaggaagtcagaaggcaaaagagcagacatagagaagctgaaccaggctgtgcttcgctacagatgaaaggag

SEQ ID NO: 611279 - DNA, 764 bp, Homo sapiens
gttatagccatttcatagaagaaactgaggtacacagaagttaactaacttgcccaggttcacttgacttaggaggtagttgaacagaagattaatccgtatatggctaacatgaggcttctgtcttctgagcctggtaagaagctggaagaatgttaagtaattacaaattgttaattttggcagttttctccagtagataaaagcaaataaatttttgcagacctattcttataaagcatagttacatcaacaccttaaaaagtctacctgtagtttaatcagaaaaacattaggccttatcttatcagtttattaacgttattaactcatgacacatttagaaaacttttgtttcctgacattatatatatttattagcaaaataacattttatattttacaaaaatctttctctttgctttgtggaatactgatctgatatatgaagacttcaaggatgggtgtcgtatctagggtatatataaaggggttatgaacaggagccaaaattactgtggtgaataatatttaaaagtccaaatgtttactttttcttgtgttcttacagagataggcatttaccagaactaaacacgatgatcagattataaacttggtctttaaaactgagctactaaaaaatttccttgcctcatcaagctgccatgtagaaacaaagtcagagtgtcagaactaagtaagtacctggaaatggatttaactaggcagaaacgtatatacactatatacataacacctgt

SEQ ID NO: 611280 - DNA, 1475 bp, Homo sapiens
  misc_feature (199)..(199): n is a, c, g, or t
  misc_feature (418)..(418): n is a, c, g, or t
  misc_feature (1075)..(1075): n is a, c, g, or t
gcttactatcagacaatcttgaccaaaccatttacccagatataaagatataggcgatagaacttgaatgtctggcctcgagtagatatagtaccgcaatgggaaagatgtacataggattgagtacccaacgacattagatataggccatggactaaccccataatagcatgtcttgctactaggtgtaatctatccntagtaataatagcttctctgctataacggagagccagcagcttaagtacccccgcacaaccaggacgacgctatgcttaaggagacagcataaagacgagctcaggccgatctagtgctgaaccaaagacagtcagtgtgggacacagcagtttctcatcaggttgagtagtgccgaaccctagaccctatcacggagcacgtggaatgtcactcaccntgtggtgtgatctccaaggtcatagaaactcgttatgcttctaaactctctccaattatgaccacgactagaagcccaacgtacacatcgctcccctaatagtaaaaggtttgaaacacgtagtattcaaatacgcctatagaggcaccgagatatccagggttcgttgaagaaggacaacgttaagggttacgcaagaagaccgtctgatacatccatgcatggagttgacacagagagatgatctacacccatctcctattcagatcacggcgcgttcaaaacaggcgaaggaccctattccccaacatatgaccagaaaaaagggccgatggtcgaaaggccctacgaaacacgaaggaccccatcatggacctccttttagacaaacgaccatttggcccttccaacaccacttatctcatataggactttgccataaccgtccgctttcggcaattacccctaacaatgtggggaggtaactctcacacttgcgtttcttccaatagccgcgttactctcatgcaaagaggcaaaacgcttgaaaattgtttctaaaagtacttaccacacgtaaaaccattttgtacctcaaaccaattttcgtatcacgatacgcggaactagttatagcgccccttttgcgcgaatccnaagtgaattaataagaaacatcaacgtatggacatcccttgaacaacactttaaaaaccacaggcgcccaaaaacttcaattccttatgcgataacagacccaacactcccttaagattataaaccggtcacagtgtaagatcttccactccccacttacctaagttggttcccaatacccccaaaatcacaactaagggccactttggtctaccatttaacgtcgacaaaggatggttcaatgacctacagaacgtccaacaacagggaaacgctccatggagcaagacatcgtattaagccccccgggccttgattgaaaccgaagcaccagccattccacacctacttgaaagacattccgaaccaactggagcttccaggaagggacgaccccgga

SEQ ID NO: 611281 - DNA, 492 bp, Homo sapiens
accggaacgctgactggttctaattttaacagggaaggaaaaagttacagctttttgcaccatgaagttgaggcagagatggagacgcctcattcccacctctctggaacaggaaagatgattggggagggagcacaggtcagcgtgggaagagggtcatggtggacatgggggtggggtggtctccccacctcctcacattatgcctacaagaacacagacacatgcaggtgcctttgcagaaacaaagccagggttcttcaagtcacaaagggaagggcaggaacaactcttgcctctcagtcccacacaaggcagctgtctcacactttacaagctgtgagagacacatcagagccctgggcactgtcactgcttgcagcctgagagtagctccctccttttctatctgagctcttcctcctccacatcacagcagcgaccacagctccagtgatcacagctccaaagagaaccagtcagcattaacca

SEQ ID NO: 611282 - DNA, 117 bp, Homo sapiens
gcgtatatcacatgatgagcaagaaggatataattcctacgaccttctcagccgatgaacagttggaataggttgtacgcggtaactaagattagtatggtacttaggaagatgagg

SEQ ID NO: 611283 - DNA, 883 bp, Homo sapiens
ttcgttgtggacggagctggtttgtgcgactcgtcgattgcggttctacctcgggctgcggacacgcggcgcggaggtctggagtagactggctcaaggaatgcaggggtgacgatagaatagggagaaatggccacgagaccaagctagactggtcgctaaggtccacgcggtggcgaaaggcccccgtgaacaggtgggcgcgaacagccgtcgaggaaaggctgctgccactcctactcggcagggagtggaattaaggcctccattgactaaagaggctccggggcaccggtgtgcctgctatgcgatgagcattacgatcgttgatcgagaatgtgcggaacggagcctgtgtcagcccggaagggtgggcctgccagtaaggtagagcgagggataatgcgggcaggattttgcataacgctgaactggtagggttatcaggaagggcaagaccccttgggcggtagccagccggcccggagagctacttcggaaaggcggaattaacgctgggttgcgggtctgtgcaagaaggataaccaaaacactgttgtggcaaatcgcagtggcgaacagaggagggtcaccagtcattgggccaaaagggaacgcttcggatggttatgagatacagacacagtgataccgggcgaaaggcggaagaggctgcaagggtgaacggcaggtcctaggatggagagttcctgtaggtcaaaattaacgggcaaaaaataacttcgcgccggaaatgccgcgaagtttttgggtgacgaaaatgggtccataattgttgtgcgcattcggcgttcatgtcctgccatctttgactccgggatcaattgcaaaccttgctgttccccgaacctccggatgtcgg

SEQ ID NO: 611284 - DNA, 233 bp, Homo sapiens
tggcagcgaagcatatcgtgagtcttttgtccctcccactgcagtcctcggtgtcagacatcatctctgccacagcatactgacgagcatatccctccgattattacttcaggcaccctaagtacatgatgagtcgcggccttcactgtcgttactacacagcaagcagattcagtagtcccatgttcctttccatgatagttggggaggcggggtgggaaatatagcgctca

SEQ ID NO: 611285 - DNA, 244 bp, Homo sapiens
caaatcccccgggggggggggcccggggtttttaaaacccccggggggttgggggggggggtttaaaatttttaaaataaaaaacccccttttaaaagggtttgggggggggggcggttttttttttgggggaaaaagggtttttgggcccaaaaggggtaaaagttttttaaagggggggtttggttttttaaaatggggggggtttcccccccccccatttttttaccccccccggggggga

SEQ ID NO: 611286 - DNA, 299 bp, Homo sapiens
taggcgggaggtcaaagtggaatatgagccaatagaggcttcttaatagacaaaatggggatgttagcatgatgcaagggaaatgaacagtatcgcaatgtccggtatacaaaataacattaattcaaggtagatccacttcacactagtttaaaatatgtgcattcacttgtatgggtcagtgtatcagtctttttggaaagatgtgctctgtaaatgtagcttttttttttttttcaacaaccttgcaagtcaaaaatacccgggcacaagtgccgagcatcttacaacaagggcca

SEQ ID NO: 611287 - DNA, 344 bp, Homo sapiens
tggtaagtcagggatttttccattatgtgccaggtgtggggcctagcctgggacccaccccagacaaagtgcagatgagggcagaccctttcccgcatggctagggtgtggctctcccacatgtccccaggccttagctagaatctaatgtccccaagctaggtaaattggacaattttcaaaagtcaaataagcagtttatgaccttaaagcattgagtaaacttcatatcctacctgcataatttagaccaaatgtctttattttaccaataatctttaaaactttttatttcccaaagattacttcagtcacatgagctaaataaaagttattacactatt

SEQ ID NO: 611288 - DNA, 723 bp, Homo sapiens
  misc_feature (20)..(24): n is a, c, g, or t
  misc_feature (26)..(27): n is a, c, g, or t
  misc_feature (30)..(30): n is a, c, g, or t
  misc_feature (85)..(85): n is a, c, g, or t
  misc_feature (258)..(258): n is a, c, g, or t
  misc_feature (270)..(270): n is a, c, g, or t
  misc_feature (273)..(273): n is a, c, g, or t
  misc_feature (275)..(275): n is a, c, g, or t
  misc_feature (280)..(280): n is a, c, g, or t
  misc_feature (294)..(294): n is a, c, g, or t
  misc_feature (307)..(307): n is a, c, g, or t
  misc_feature (310)..(310): n is a, c, g, or t
  misc_feature (324)..(324): n is a, c, g, or t
  misc_feature (327)..(327): n is a, c, g, or t
  misc_feature (342)..(342): n is a, c, g, or t
  misc_feature (356)..(356): n is a, c, g, or t
aacatttttttttggagctnnnnncnnggnataagccagcttaatatttaacaatcacttatatgtgtgtcgaagagttggtttngttcgtcatgtatgggtacaagcagatacagtataaactcacaaacacagatttgaaaataatgcacatatggtgttcaaattggaacctttctcatggattttagtggtgtgggccaatatggtgtttacattatataattcctgctgtggcaagtaaagcacacttttttnttctcctaaaangtntntcccngtgtatcctattanggatactggtttngtnaattatgattcttnatnttctctccttttttnaggatatagcagtnatgctattactgaattggaatttcctttttctggaaatggtaatcattggatggctggattggatagaatttaagtactggtaacacagggcttatagtcatcactggtgagagatttgagaaaaaaggcttagagggacctattaagtgtgcctaacaggactttggtgcggccacggggtaatcctgggggtttccctcactttaatacacggtatttcagacctggtactcctatcatggcgttcagcagtctttgggagtgaccagcaactttgactgttggccctaagatttcatgtgaatgccagcaacgtgcaagaggttccgtcggtccactacaataattctctgactactgtgcgcc

SEQ ID NO: 611289 - DNA, 248 bp, Homo sapiens
taacatcatgttaaagtagcagaaaccaagtacagcagaaaatctggacatgtcgtagctaaactcaccttggtaggccacattttctgcggaccccaaagccgcattctgatacattctgtttcctcctgggatgcacattcaccccagctgactctccccctccttcccggggctcccttactgggcgccttcagaaatttggagctctcatagcaccgtggtcctctctctgaagtgtatcgtta

SEQ ID NO: 611290 - DNA, 244 bp, Homo sapiens
gatccgaaccgaagaacaggtagtttttgcggcccagactgaccatccgcaacgcattttcagcgatgttattgtccgcctcagcccagccatcatctgcatagtacgtcagcgccggccactggttcaggggcgtatgcgaacgctttcgccagttctgagtgtcgcgacagggttttcatcttttcacgcagccagctttccagggatttagcagcggtttcgttttcaactgagcttcggg

SEQ ID NO: 611291 - DNA, 123 bp, Homo sapiens
ttatttccataaaacctgttgatgctgttgttggcgatcccgtttccatcgtggtcggcttggtggtgatctacctatgctacctgctcgagcagcgcatcctatacggtggcctggatggaa

SEQ ID NO: 611292 - DNA, 443 bp, Homo sapiens
cttacatagtgttataatccatactctcataatgccactgtcccaaatttggccattgggagcttcttggaaggtcatcctctgtctttctgacatggcactaagggtctttcaacacctcctcgctttctgacacaagcatggcaagctaaccttgtatgtttcctgtcccagacctcaaatcagccatttctccaaggagccctgaaacctttcactgggaaatggcatttaaaaaccaagctcggagaacacaatgcatctcggttaattaagtatcactgcttgtaggctctttggacagagcaaggatattttaaataggtaaatcacaagttcatggtgacaccctgaattcaaatccaacacggaggcttcttcctctgctccctcatctctccctcatctcacattagcatcgccgttccaccacaaggaaaacc

SEQ ID NO: 611293 - DNA, 547 bp, Homo sapiens
atcatctcaggatcggattctagtttcagagtgtttctgggccacggatccgggccccgtggcctcctctgcacctgaccacactccctactcagggctagtctgttcttcccggacatcttactggtagaccgctgcaggagcagggctagggtaggggcagaggccaggagagggacctaggtagtagtacacctgcccaccacctggctcatccctacaggcccaccctgaccctacattacataggttacgtcagcctactgtggactgttgagcaaagcattatctcctattctgggcctcatttgcactagatgggcctgtggtcccaaagtaggtcagtaggttggggttgctgacaccccattggagtgcagactttgggacagatgagctggcatctgatactgtacactgccctctccctagactgggggctatgtgcactccagacccacatagccaggctcagtgcccatgaggtatggagacacaccataggaccaccaggagctaggaggcaccagaccaactccacctggaa

SEQ ID NO: 611294 - DNA, 967 bp, Homo sapiens
gactgaagataccttcatcgctgagctgttttgttggggctagtgcactgggcagatcaagactggtgccccttgccgatctgatgcgcttggcacaagtactaaccagctcctcagaattgaatgaggagctgggcagcaaggctaagtttgccggcaggaacttacagaaaccccttggccaagataagctgtgggcagagcaagcccattcggtcacctagttaggactacacagaccacctcaccctacgtgtcagctacaggcagctcgaggcccccgagcaaccacttgcaggagtcccatgctagttaagcgcccaaacgcctgtgagagttcagtaaaccgactttccttaacgaaaatatctaacaagaaagccaaagctccctagagaagaccactgataagagcacgatacttacgctattagaccagtacctgtgttacacttggagaccaaagtacaattcggtatctcgcatacagcacctcaacgtattactcatagcaaacagatgtgctaagcagcgctcaatgtagacagcacatcagttgattcaaatctcacgagggatgggcccacacatgagcctacgaataccccatgggtggtgtaataggttgcatcacagaagtaaacaaacgacctacagagtgaaccccaaaggaagaaacataaaagcaaaacacaaacgacagcgaaaacaccacacaacgacagaccccacaccggcaccagacgcgaaaagaggaggagcgaggaggagaatacatcaagataacaagaaaaaaagcaccacagagtttaacaatgaccgtgcatactaaagcacagcgccactgtactgcacaccacacacggcacagaaaccccgcgaaaccacccacacatcactacggcgaccatcaaacatttagcgaaccgagcgcgataaaccccagaggacatccgacactgacgag

SEQ ID NO: 611295 - DNA, 177 bp, Homo sapiens
gtcacccatccatcaagtatacttcaaaggaaatttaactaagcactcaactcacagtttactgctaaatccaacttcgaccctaaagtttcataagggctatcgtagttttctgaggtagaaaatgtagcccaattcttgccacctcataggctacaccttgacctaacgtcatta

SEQ ID NO: 611296 - DNA, 720 bp, Homo sapiens
  misc_feature (304)..(304): n is a, c, g, or t
ttaggctaggtagaggctgggtgtttaatcggcgaggctgtcgcggggttgagggaaggggcgtgcccggtgcagcccaggtgctcgcgtgctggctcatggccctggtcacagtgagccgttcgcccccgggcagcggcgcctccacgcccgtggggccctggaattcctgagagaggggaggggacagccctccccgccctcacctgccctggggctgctctctcggcaggaccaggcggtccagcgaaggagtcgactccagcgaagagctttgcggtgctccgtggggctgtcctgggantgcaggatggaggggacaatgatgatgcagcagaggccagttctgagccaacagagaaggccccgagtgaggaggagctccacgggggaacccagacagactttcggtgcaaggatcccagagtccccagaagcaggaggagcagaggcagcaactgcaacctcatggtacaggcgtgctgaggccgcagggatgacatccgacttggaagcccaagctggaggcacccccgggctccccgggatccggataccttgcttggtagtttctacacgagaagggagaaggtctgagcccaggatgagacggtcctcctgggacgtggatttccctgacagcaggttcgagcagggagaggaaaggaggggcaaagaggggcttcacgtgagtctggtggcaaagcggatcttcaagcc

SEQ ID NO: 611297 - DNA, 296 bp, Homo sapiens
gctggaggaggaacttcgaaccatggaccaagccctcaagtccctgatggcctcagaggaggagtaaatttggggacctagaggaggagctgaaaattgttacaacaacttgaaatccctggaggccaggcggacaagtattcaccaaagaagataaatatgaagaggagatcaaactctttgaggagacgctaagagagcgcttagacccgcgcagatgtacacccacatgtctgtggactagattgagagacatcactatctcgagagtccttggcagatcacacggagagagg

SEQ ID NO: 611298 - DNA, 646 bp, Homo sapiens
ataatggtagcataaaccatctgcagttctaggaatactaatatgatcgctcacacctcatatcctccctactatgcctagaaggaataatactatcgcggtggcattataagctactctgcgataacccgtcaggacgccacgtccctcttagccaagtattgtgcctattgccatacgtagtctttgccggctgcgaaggcaggcggtggggcctagccctagtagtcgcaagctccgaagcacagtatgggcctaggaggtacggtaacaataagcgtagagacctagcgtccaaatggctgaaaacgtaagtcgtcccaacgaaatctagtagttactaccgactgagcgatgacgtttccagaagaagacacgataatttgggagtcgggagcacgaaggcaggcccaacgagggcctagatttatgtagggcatgtccatgtcgcgcttcataacgctaagtgttgttggggaagaggggcgaaaaattccaaaacgaaaacaaaggccctcaattttagggcgttggttttccgcccaaaaagcgtttatgatcccgtgcgcgaagccgcgcgcattaaacaaaacacgcgtcaccttcccttagaattaggattagaggttaagcctggaacttcctt

SEQ ID NO: 611299 - DNA, 165 bp, Homo sapiens
gtctgaccctgtgcacaggttactgacttacagtgttttgttgtagcgacgcgaaaagttcaactgctgcacccatgacaagtcagcatcattagggcatccgtcgtgtcccccagagacatctcatcaaaattgcaccacgtcaacaggagcttccgtcaccat

SEQ ID NO: 611300 - DNA, 110 bp, Homo sapiens
gtctatccccatcctccttcagcttagtcaacttgaagatgacaaggatgaagagctttatgatgatatacttcccattaatgaacagtaaatgtagtttttcttcctta

SEQ ID NO: 611301 - DNA, 384 bp, Homo sapiens
  misc_feature (16)..(16): n is a, c, g, or t
ctagcagcacctcgcnttacgttatgtaggaaaaaaaaaaagggggtgttctatggaaactgtactaaattttggcctacaatttaccttgttacatatggtagataaatggctaatactaatagccaaatagataccactaattgcttggttaaacaaaaccggaaaaaaacaaaacaaaacaaaaaaccatgagcaggggtgtcctaatgaagttatgacatctgtcctaaataagtttctcaaaatacttttactaactaaaagggtttggaagcaactgttaaattttaaaaattttggaaaactggcaaataaccctttggtccagaattaagtagatggttaaatgcaggacatcaactacataagggaaacggggac

SEQ ID NO: 611302 - DNA, 975 bp, Homo sapiens
  misc_feature (132)..(132): n is a, c, g, or t
  misc_feature (163)..(163): n is a, c, g, or t
  misc_feature (165)..(165): n is a, c, g, or t
  misc_feature (170)..(170): n is a, c, g, or t
  misc_feature (172)..(172): n is a, c, g, or t
  misc_feature (178)..(178): n is a, c, g, or t
  misc_feature (183)..(183): n is a, c, g, or t
  misc_feature (193)..(195): n is a, c, g, or t
  misc_feature (247)..(248): n is a, c, g, or t
  misc_feature (270)..(270): n is a, c, g, or t
  misc_feature (299)..(299): n is a, c, g, or t
  misc_feature (331)..(331): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (369)..(369): n is a, c, g, or t
  misc_feature (387)..(387): n is a, c, g, or t
  misc_feature (390)..(392): n is a, c, g, or t
  misc_feature (406)..(406): n is a, c, g, or t
  misc_feature (417)..(417): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (431)..(431): n is a, c, g, or t
  misc_feature (435)..(435): n is a, c, g, or t
  misc_feature (455)..(455): n is a, c, g, or t
  misc_feature (540)..(540): n is a, c, g, or t
  misc_feature (552)..(552): n is a, c, g, or t
  misc_feature (611)..(611): n is a, c, g, or t
  misc_feature (617)..(617): n is a, c, g, or t
  misc_feature (623)..(623): n is a, c, g, or t
  misc_feature (631)..(631): n is a, c, g, or t
  misc_feature (636)..(636): n is a, c, g, or t
  misc_feature (638)..(638): n is a, c, g, or t
  misc_feature (648)..(648): n is a, c, g, or t
  misc_feature (654)..(655): n is a, c, g, or t
  misc_feature (666)..(668): n is a, c, g, or t
  misc_feature (672)..(672): n is a, c, g, or t
  misc_feature (697)..(697): n is a, c, g, or t
  misc_feature (738)..(738): n is a, c, g, or t
  misc_feature (753)..(753): n is a, c, g, or t
  misc_feature (773)..(773): n is a, c, g, or t
  misc_feature (789)..(789): n is a, c, g, or t
  misc_feature (807)..(807): n is a, c, g, or t
  misc_feature (820)..(820): n is a, c, g, or t
  misc_feature (826)..(826): n is a, c, g, or t
  misc_feature (844)..(844): n is a, c, g, or t
  misc_feature (846)..(846): n is a, c, g, or t
  misc_feature (848)..(848): n is a, c, g, or t
  misc_feature (851)..(851): n is a, c, g, or t
  misc_feature (864)..(864): n is a, c, g, or t
  misc_feature (866)..(867): n is a, c, g, or t
  misc_feature (963)..(963): n is a, c, g, or t
ggagctcgcccaccgcccgcccagcagtggctgcaccatgcacgtgaacggcaaagtggcgctggtgaccggcgcggctcagggcataggcagagcctttgcagaggcgctgctgcttaagggcgccaaggnagcgctggtggattggaatcttgaagcaggngnacagngnaaagcngcccnggatgagcannngaacctcagaagactctgttcatccagtgcgatgtggctgaccagcaacaanngagagacacttttagaaaagtngtagaccactttggaagactggacatttnggtcaataatgcgggagtgaataatgagaaanactgggaaaaaactctgcaaantnanttnggttctgtnatcagtggaacctatctnggnnnggattacatgagtnagcaaaagggnggngaaggnggnancatnatcaatatggcagcgttagnagggagcgctgcgggatgcagacattggaaaaccgggcgggcagaagtgcggccggcttcagcagggagcgcccagggggacttnagaaccgcgggnttcccttttcccaagcagaaagagagaaagaacatggaggaggcatggcgactcttttnagaatnccagcncagtaatngcagntnttctgctcanatttcnntatagaacttnnnctcntgtttcacctaactgtaagcgagtntgtctgggaaatgcagtctagctgtgtgcctaagagaagantggatttcagagggnagctaatcatcttttccacngcatgcaatcctaaantatagtattttcagagtngtatgatttagtntcagcngatatcttatccttcaanantngcnttaaacctctgtntnntttttttggagcaactgagttaagtgactttactctttaaaactctaggaaaaatcatcaatgattcttgaatagtcaagtgaattgtgaggttangaagctgatcac

SEQ ID NO: 611303 - DNA, 1202 bp, Homo sapiens
tggactgacattgcgagtcgtcagggtctccggaggctttgtcttgctgctgtgtgccggctgtgttgatgtgctgctgtggctgtgtaactgcgggcaccctgggacccctgtatccaggtacctgggacggatggcgtcagagccgcgcaccgcggacgagcagggccaggcatcagtacccctgctgactctgagcatggccccacagactctccccatgctctgtcagtggagaccctggtgccaagagacccttctcccatttctccctatgggtgcctgaccttgaggggctgagaccatctagacgtgttgtattcaaggccacagcaggggagcagcacaggacctggcctttgaacgacattttccttctacgcgttacgccttcttggaattatctacagacgagggtgccttgttatggactcccgtgctccgagactttggtgccccggctgtccaaccttggcaaagccgtgatggttgtcgagctcccgaagggagcggttggtgggccttgcgaggaagcgccccccaagcccaggattgcaagttgcaaaaaaggcgcttgcacctgagaatttggaaaatttcgttgcctaccaacacttggcacaaggccaagcttgggacaaacctcttgggaccgatggggcttggccctggtaggacccaattgcgcggacatcaacccatattccatcacccccggagggtaaagaaatccaaggagataacccacagtatatggtaaccaacaagatgtccttgtgcgacagctaataaaggggacattgggcagcttggctggggtggcccagagtagacgtaacacgccatgggggctattgcgcatattttcattttcccgttacacaacaagtgttgccttcgttatacccaccggattgggcattgtcttcttttctcacaagacacgtgtgtgaacactgcagacagcactttgaacgcgccgtgcgccccaatccaaaagacgggccttggcgcccccaaaaaattgagccaccaagggttccatacaccgttccgaacggtcggaggaaccgaagtgagtctttgtccgctgtgcgacagtaattgcttggttgccaacggtaaacctttgcgcaatgcggcaatcggacgcagtatctatggcggtagagagtatcacggttaggtccttggacggttcc

SEQ ID NO: 611304 - DNA, 889 bp, Homo sapiens
  misc_feature (132)..(132): n is a, c, g, or t
  misc_feature (163)..(163): n is a, c, g, or t
  misc_feature (165)..(165): n is a, c, g, or t
  misc_feature (170)..(170): n is a, c, g, or t
  misc_feature (172)..(172): n is a, c, g, or t
  misc_feature (178)..(178): n is a, c, g, or t
  misc_feature (183)..(183): n is a, c, g, or t
  misc_feature (193)..(195): n is a, c, g, or t
  misc_feature (247)..(248): n is a, c, g, or t
  misc_feature (270)..(270): n is a, c, g, or t
  misc_feature (299)..(299): n is a, c, g, or t
  misc_feature (331)..(331): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (369)..(369): n is a, c, g, or t
  misc_feature (387)..(387): n is a, c, g, or t
  misc_feature (390)..(392): n is a, c, g, or t
  misc_feature (406)..(406): n is a, c, g, or t
  misc_feature (417)..(417): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (431)..(431): n is a, c, g, or t
  misc_feature (435)..(435): n is a, c, g, or t
ggagctcgcccaccgcccgcccagcagtggctgcaccatgcacgtgaacggcaaagtggcgctggtgaccggcgcggctcagggcataggcagagcctttgcagaggcgctgctgcttaagggcgccaaggnagcgctggtggattggaatcttgaagcaggngnacagngnaaagcngcccnggatgagcannngaacctcagaagactctgttcatccagtgcgatgtggctgaccagcaacaanngagagacacttttagaaaagtngtagaccactttggaagactggacatttnggtcaataatgcgggagtgaataatgagaaanactgggaaaaaactctgcaaantnanttnggttctgtnatcagtggaacctatctnggnnnggattacatgagtnagcaaaagggnggngaaggnggnancatnatcaatatgtcgatcttttagccaggactcattggcccggttgcaccagaaagcccggttcattgtggctttcacatgcattggtcaatagtgggattcacaacgctcaagcaagcggtggggctgggaaatcattatgaaccagtggtgtgacaactgaatgacaattggtacagagctttggtgaaccaaccaagcacatccccttggaattccaattgggacaccaacgacacgaacaacaacctttgggacccaccagtatttagcacagtcatgaggggaatcacataatcaagagcgacatctgcccttcgaccattctctaagctcgcaacgatctggggcacaccccaccaaatggaggtgggcccaaggagactttgcgaacacaacttccatggcacaccaacgatgtctcctaaccgtggcggcccgataacgctactccatc

SEQ ID NO: 611305 - DNA, 209 bp, Homo sapiens
actctgaggatcccgtagaagacgacagaagggggctgggagggagaaggggatcgacagctaacaaatataagatgacatatacagagaatccttatccaaactaactgtatatatttcttctaaaatgggtatgctgttcagagtcacagagaaactccatcgtctaacccacctgagagggcacccagccactgtggtgttgcgtg

SEQ ID NO: 611306 - DNA, 366 bp, Homo sapiens
cctgaaacctatttacctttcatgaggatgcacacgattctcctcttgtgaaagccttcctcccgagaaccatccctcccagtccactgcaactggttctcaaacagagacggctttggtaccccataggacatctgccaatgcccagagacatttatggtatgccacactggctactggtatctagagggcagaagccaaggatgctgataaacatcctccaatgcacgggacaggcctctacaacaccagcagaaacatcacagtgccaagctgagaaaacctgctctaagggcgaagcaccctctccctcttccttccctgctcccactgtgcttgctcgcatttccatcatcgcctttagaa

SEQ ID NO: 611307 - DNA, 1038 bp, Homo sapiens
  misc_feature (523)..(523): n is a, c, g, or t
agcgggagtctgttgagcccctggccggaccagcctgggccccgtacagacgaggaagcactcccttggcaggacaaatggaggacatcaagctggaggactctctcgccccgggatcaacgtgggactgtcgtcctgccatgctgagtctctgacggacgaccgccaagtgacgacaggcttctcatgtccttcataacgtacggtgcttgaggtgcctggctgcctcacatggatggacaagctgtcacttgcgaggacatacggaggaggacaacgggtgcactgtgtagcggacgcgggcactaggggacacgggtcgggcaacttgccactcgtgatggcagccagacctggtagccaggagtagctgagagctcatactacccttacagagctaagttcctggtcgctcctctctgtaacttgaggccatgccgcttggatcaaagtacttatagacgagatgcccagttgttgcactagattggcacatggacttaccatggagcaagagaaacantcgcgggatcgattgtggcgaagtgcccgcgtcacacgttcgagggacaagtggaactagtagaacatcgtcggagcgcgatagttgcgaggcatggacagggggccgccgtatcctcgggaggagaagctaggcgaaggaagaaggcgacggaggagggggaatatgatgagtgtatcattgatagtgatgtgaggtaaattgcggtttctatttctttattaacaatcaggatcaattttattacgttgaccgtgtgccatggaaagccatagtgttatttcataaatggtaacttcagatgaacaacgtgttcggagaagctatttaatagcaggcttcaattgtagggtaacatatactactctctggttgcgggtgaacggggatttaaccaggaattagagaagtattaacgtgaaattctatgagaaataaaaaaggatgaatctgtaaggagatatgtagggtcttaataatgtattaatgcttgaaaagtgcagatggataaatgg

SEQ ID NO: 611308 - DNA, 197 bp, Homo sapiens
gggatgtatgcgaaccttcttcatttggaacttgatttgtggactatcaactacatacactttggccaccatgtaagggtcgtgtagtagagcagggaagggaactattcctgcctatatattaaaccctggtgccgacggattcgtcggaatactgcttgatcatgagactctagaggccaacacacgcatacata

SEQ ID NO: 611309 - DNA, 604 bp, Homo sapiens
aagcagtggtatcaacgcagagtggcattacggccgggggcggggcgcggtggctcacgcctgtaatcccagctctcagggaggctaagaggcgggaggatagcttgagcccaggagttcgagacctgcctgggcaatatagcgagaccccgttctccagaaaatggaaaaaaaaaaaaccaaaggacaaaaaaaaaaaaaaaaaaaaaaaaaaaaattttgggggcgcctcgggacctggaaaaggtttgaaacacattgggggggggcgggggcccaagtggtgtcaagggacacgggggccaagaggggtcccaagggaaacccgggggacagaacaaaggggcgggagggtttcccccccatataagaaaaaggcccgggggggacacccggggcgtgtcgtgagaccaaacccagagaagggagctccagagagcgcccaaagagggggacgctatcaacacacggggggtgtcccaaagggggagggcccagattcaaaatttacgccccggggcgtgtggggggggaatgacgaacttgaggacatgccagagcaatcgcacagaggacacaacacatgagatacacacaggacagg

SEQ ID NO: 611310 - DNA, 726 bp, Homo sapiens
gggtcgcagcatgtctggggggcacatacgtagactcggaggcagacgtctctactccgttcccatccggtaacgaggacaacatctacaagccctacaacaaggccagggcagacgagctgatcggtaagcaggtgtacggaagcgcacatgcatagaaagatctggacactggatcgacacacggcgacccttattagctactcttccaagcgatagacagttggtcccagattgacttttgacagatgatgattttgcagacacccagaggagggtgactaagcttactgcttgaaggacgtggcatttgaggacaggccgcgaaatatcagcagctgtactatgtagaactgaaataacatgggttggtcacccgctgtgtctggatgcgtgtacctgcgttgggtggatccccagataggccatcatcgatctagggtgccattccacgttgcgacgacttctgggtcttacctgccaatctgggtcatgtgtggcatgcttttaagagctttcctgatcagagcattcaaagttgcgttcagccgggtctataaacatgctactgtacgcgaaaccgtgcgtgtgactcagtctgagaagctgtcggggaaaaatatactaagacaacgtgggggataaaattgcatgtggggacatatcactgaccgtttacgataaagtaatacccggattgattggcatgaaatttttccggtgtgc

SEQ ID NO: 611311 - DNA, 918 bp, Homo sapiens
gatgctaaaaccattagttaaagattgaaacattctgtgaacaatcttaggatcactaaaagtggcgtcaatcgcacgacaattcatatagcactcgctaagtataatgtggacagcgtaacaaactatgatactagaatctgattaagcctcgcagatctaacttctaatttagaggacatttggacagggtagagataatcaagttcattaccaccatgaggaatcatttgggataatccagaaggcgaagatcattctacaagagtcaataacttggtttattcaacaagtaaatgttatgggatgtggggcagaaagagcaaggtgtcaggaggaggactgtcctagcttataggatacttaagagacataacagcataagtgtaaagatgtgggtctagtgtggagtactgattcaagataagccgactgtaaaatgaacacattgtcgggacagtcagggtaaaatatgaataaggactgagtgttaaatgatattaagtagccattgttaatcttgttggggtgaaattggcctgtgcttatgtaaagaaagataagaccagcattacctgctgaagtatttagtgaatacacaggtctgatgttagaatactccagcagtcagtcattcagtcagtcactgggaccgaagaaaccatgatgggcaacctgttgagttattatggaaggtcgtgtactggggtgcctggaggttattatactattctctctaattttattggcatgtctaaaaacttccgtactgaaaacttgaaactttaagttccaaggctgggaatggagggtcatgctgtaattccaggcacttggaaggccaagcgggggaataacgttagcccggaattgaaaacaaccgggtaacattgtagagccggtcctaacaaattacag

SEQ ID NO: 611312 - DNA, 105 bp, Homo sapiens
agagacgtgttgcatgggatgtcaggtgtatgaagcttatggtcaaacagaatgcacaggtggctgtacatttacattacctggggactggacatcaggtcacga

SEQ ID NO: 611313 - DNA, 145 bp, Homo sapiens
ccatctcgttatttcaaaggtatgttgcccggggttgtacacctgccctttgcgcaagggttgggacacagccatctgggcagagcctatacttgggctaactctcctccaacagtccttgccctgactgcccagatggctttgt

SEQ ID NO: 611314 - DNA, 147 bp, Homo sapiens
agtggctcatgagggggtagagggggttatagaggtaaatacgggccctattacaaagattttaggggaattcattctaggacgatgggcatgaaactgtggtatgctaccacagatttcagagcattgaccgtagatatacccccg

SEQ ID NO: 611315 - DNA, 261 bp, Homo sapiens
ccaggtccattcttcggattggctccatgtctcacgattggtcggggcaggagactccgagctcactgacagtcacagctgagatctaagtagtgctatctcctggacctgtatgtggatcactcatttaatactaaacaaccttatgacttaggtactagttttattttcatgtctgtttagcacatcaggaagctgcaggcaggtcaagtgacttgtcccaggcccacacggctggttagtgaattctaacccagtgtg

SEQ ID NO: 611316 - DNA, 402 bp, Homo sapiens
cgcggtgcagggtgctcgatatatagaatcctcccatgatatattccaactagttggaactaaactcaactcacacttagggccttgtatgcagaacgatcaccatctttttaggacacttaggtttatttacaaaataattctttgaaggcccgaacatttctagaatctgattgatgatgagcaggagagagaaagtgcatactacaaagcggcagagtcttaaaaattcaacatcagcctaattaccaggaatttgcagtttagttactctgtgtacatgtaactatttataaatttcgacatcaacagcttctattttaactgatgagatgtccaattgggacacaattataaatgctgtgaggctgggtgcagtggcttatgcctgtactcccagca

SEQ ID NO: 611317 - DNA, 106 bp, Homo sapiens
ttgcctcatgcttgttcttgagcttgaggaggctcttagatttctcctcttcttctgtgaggggggtggtgaactcagctattctgtcttccagcagtttcttttc

SEQ ID NO: 611318 - DNA, 228 bp, Homo sapiens
cgcttcccccgggtgctgtcccaaccgcaggtccgagccctccctggccggggtgagctcatcaacattcccccccttatggtggagctcaagaagcataagcccaacttttgatgtgccagaaaccgccctgagatttgccggtcatttccttgaaccctaacctctcccctcctgggtcaagaattactccgaagtcagtttgcagaaaataaatatttagtatga

SEQ ID NO: 611319 - DNA, 195 bp, Homo sapiens
ccccaatagacagtacaaggcatgcaactagcgggtcaattccagacactgcactatataccccaccatgaaccctgactggtctggctgtgacccctatgccggtcccgtggtcgggagccagatgaccagacaagcccggcgcctctacgtgggcaacatcccctttggcatcactgaggaggccattcaacg

SEQ ID NO: 611320 - DNA, 99 bp, Homo sapiens
cttcctggcaggaagcgacgttgacttctgctggaacagcatgctaggtggaggaatcagccacgttgtaaacctcctgaggtggatgggcgcctcacg

SEQ ID NO: 611321 - DNA, 140 bp, Homo sapiens
aacccctccactatctacccgacaccttggccaaccatttacccaataagtttggcgatgaaattgaaacctggcgctgattgtccgcaagaaaagatgtaaatttaccagcatatttgcaaggctacccattcccttgc

SEQ ID NO: 611322 - DNA, 384 bp, Homo sapiens
cgatggcagtgtggtgttccaggtccccacaagaccttccgggcctggtcatggccagacaagctcattcatctggacgatcaaacccgcaattctcgggaaccacgatcataagggagctgcaggttctgcatgagtagcacgtctccgtacatcgtgagcttctatgagtgcgttctacagcaatggcgcagatccagtatctgcatggagcatatggatggcaggtctcgtggatcaaggcctgaagaaagctggaaaaatccgtgaacaagttttcaggaaaagtcaggatggctgtaataaaaggcgctgccgtatctgagggagaagcacaagatcatgcacagagactgtcaagccctccagacatcctagtcaact

SEQ ID NO: 611323 - DNA, 415 bp, Homo sapiens
  misc_feature (272)..(272): n is a, c, g, or t
gcggccggtcgggcggaaggcaggaggcgggcggtcggtagaagcggcggccaccaggcaggcaggcaagaggaaggaagtgggtggctggcggcggttggaaggaaagcaaccaccgccggcggcgacaggaggaggcggcgccggcgggacgatggtttttcctcctacgcggcggggaggcggtcggtcaccacgacgatgactactactacttcgtcggcggcgctctcgtcgcccctcttctctcctcgcggcgtctcgtgcggggntgtgaggagatagagagcgcgcgcagagactctctctctgctctctctcacacacaaaatagaaatagaaatataaaatatattctctctcccactacccacacacaatataacaaataataataacaaaacaataaaagaaa

SEQ ID NO: 611324 - DNA, 266 bp, Homo sapiens
  misc_feature (209)..(209): n is a, c, g, or t
gggcttggtagggacttggtggctccgccagagagggttgagtgcccggcacaggctatgtctcgatctccgcgcgctggtactgtggtccagcgagagcgtcaagttttcgtccagtgaaggactgcagtgtactcttatggtcggcctcgtcctcctgggtccatggacgcccagtgtctgttcgcactggaactcgctacacgcgnatgcttggactagccctgggaagggtcgtcggcaatgtgggttagcccctggctctc

SEQ ID NO: 611325 - DNA, 307 bp, Homo sapiens
cattacctttaacaccatgtagcgtatgttgtgttctgaagaactgcaaccacagagttatttgttggtactgagagacttctgctttattctttgtttttgctatcctgtcctatataactttttttaaagtcataagcttaaagttttttattacgaagaattttatatttatgcaaaagaaaatagtatctgtatgaccaatcatccagattcagcaactaagaggatttataatagatttaaaggttcaatgtttaataaatatcttaaagttcactagagaaaaaatccttattgcgagata

SEQ ID NO: 611326 - DNA, 386 bp, Homo sapiens
cctggcttgtcaggtctcaggatggagtgcagtggtgtgatctcagctcactgcgaccagtgtctcccgggttcgagtgattctcctgtctcagccccctgagtagctgggattacaggcacccactatcatgcccagctaatttttgtattttagtagaaatggggtttccccatgttgcccaggctgatctcgaactcctggactcaagcgatttgttcgcctcggcctcccagagtgctagtattatatgcgtgagccactaagcccagcctcttccttttttttctttttctttcttttttttttttttttttttggaccttcctggggtgctccccgcaaagggcattcggccgggtccccggccccttgggggggggggc

SEQ ID NO: 611327 - DNA, 383 bp, Homo sapiens
tttctgacaatccttaggagctctgccatcctttcagttaccaagactcaaatcttagaggaaccaaaagctcctcttttccctgatctccaaacaatcaaagctcggtaagctctccacattcttctttccccacactggttctaacacccgttctttttccttttgtcaaggccatcatcccatttcacgtcatctgaatgtcagatctgatttttagccatgatttcctaaagggcatcacttcttatgaccaaagtaattggttacatttcacttcattagaaggaaaagtttgtaagggaagtgatttccgcatatcttttcactaatgtgttatcctaatacctaaaactgcctagagcatacacagaagacactca

SEQ ID NO: 611328 - DNA, 443 bp, Homo sapiens
  misc_feature (416)..(416): n is a, c, g, or t
caattcctcagcgtaacattatgcaacaagtaatggctaaaactgcaattactgtttgcatcaaccaaactaagtatagtagtgagatgaatcacagttgtttctttggatgcttattttgaataaattgacagctctatttccatttccatgagctgtgttggaaacctccttgttctcagagataatcaattttaagtcctctctgcactttatatgcctgttgctacatagaccggctgactctgaagtatagattgagctctatgtctgaggatttttttttttttttgaaacggattctcactctgtcacccgggctggagtgcagtagcgcaatctcggctcacggcaacctccacctcccggcttcatgtgattctccggcttgagactcccaagtagctgggactacnggcgcccgccaccatgtctgggtattt

SEQ ID NO: 611329 - DNA, 108 bp, Homo sapiens
acctagcagctaacgccgttgcacacgtacgcagtgcatactactgtaactacactaacactagcgcagagctgcagtagtgcggtagtgcacactgctgtcggcgac

SEQ ID NO: 611330 - DNA, 115 bp, Homo sapiens
atacgaatcgaggctgaacccctagtttagaagtccaatagctataacaagcattctttctcctggggaagaagaccactgagtcgaggaactaataactaattgaatttttttt

SEQ ID NO: 611331 - DNA, 327 bp, Homo sapiens
tctacatagtgttctgttacgtttaggccatttttcatttgtgttttcttgctattgaatagcaagagttatttatatgtctatgctgtcagtcattgtcacatatagatatgtaactgattttctcctagtctgtggttcacctttttgtttttttttggatggtgtctttggaaaagaggtttttaattttaatgaggtccagattatcagtatttttcttttctggttttggcttttggtgtctaagaaatttggcttacccagggtcatgactccgtactattccaccccaaggtaaccacggttctgcctatatcatcaaca

SEQ ID NO: 611332 - DNA, 122 bp, Homo sapiens
cgacgccgacgagaactgacggacggtgagaacgggggggacagtaaaccactgttctatgaagtctcacgaggcaacgtgctcaaggtaacacaacagcagtcctgtgagcatcgtccacg

SEQ ID NO: 611333 - DNA, 342 bp, Homo sapiens
acatattgtactgacacaacacccacagaaactcatctactcaacctcagcatcaggccaggtccagggccccgggcagatgctgaagcaggatgaagaccagtaagtctcagtgcctgtattcacaggaagctgtcagagaaggaagctaagacccacagatcctcatagaccgtgtgtgtgtgggtgcccctgagaagtctggggctcaggtgggagaggcccaagcctgggagctctggcaaggcttcctggagaggggcaccattagggactgcaagacctgagggtgggctacgaaggaagctttgcacgctggaccctctgtgccctgtacactct

SEQ ID NO: 611334 - DNA, 125 bp, Homo sapiens
tgaagaattctctctttacattcgttgctttccttagagttcctccccttgtcctcaaacagtaatctcatttcaggatacccagtattactgcgtcaaaagacttggacatttgagcatttgaa

SEQ ID NO: 611335 - DNA, 115 bp, Homo sapiens
agaggatcccatgtgcatgtatgtgatgtgacatgacctaatggaatgtatgtgacctcatgaatgacccccttcaaattcatgaacaaatggatttcctggtccaaactatgtt

SEQ ID NO: 611336 - DNA, 1502 bp, Homo sapiens
  misc_feature (378)..(378): n is a, c, g, or t
tcgtgttggtcctcagaatccccgcgtagccgctggcctcctcctaccctcgccagtgtttcttacccggtactgatgtacgacatgtgggcgtgcaatactttttctcccgcaaggaagattatttcaaggtgcgaatatgccagtatgaggtctatcaagcttgcgttcgtacagccattggagatccagacattcagagggtgtgtgcctagctgtggagaagagaatgacttccccactgatggagcccagcagctattgagaaaattgtagagtattgcatgctcacgataggtatgtgccatgagtgggctcaattgctgatgctaagacttctaattgataaagccagagtggagacacagaaccactggnttcaccttacaatgagacaatgacaagtggagagtgtgacccaagctgttgtccgaatctggtctgtatgcacgtctggcagaagaacgatgcgagactccaggtgccatgtctcggtccctgtggagctagcgattattatttggaggagttgatgcagacaggaccccagcttgtcccatatggatccatcttgggacctttgtacagtgtgatgctcgagcaattgggctctgcttcagagggtgcccagagctccttgcaagaagtttaccacaagtctatgaccttggagaggaacccccctccaggtcttccgtcaattatcttcgaaccaagtaatgggcgcgaaaaggtgcactgtccacaacaatgggccttcgcccgaggaaacctgggccacaatttccctgtgtgtccacagggacacatgtcaaagggttatcgagagctagggagacccgtgacctccggaaacctctggtgcaacacgtggccctatgaatgccccacataattttgaccccggctgggcggagacccccggggggtaggtaaacagacgtagtgacgacggcgaccacacccccaacacggacgcgactcgactcccgcccgtgccgacgctgatcctactgaccgaatatgactcgtttgcgtttatttttcttgcttggtacggtagcccagcgagcacgaggcgcccggggcgagaccggccacgggccgcgcgggacgtgggggagcgggatggaaggacacagacgcacgacgatggcgccaagggccggcagggaacagacccgaggacacgacagcacgacgcggccacggacacgcacggcggcccgagagcacggcgcggcgcggcgcggcgaggcaggcgcgtcgagagcgcggcaagagtggcacgaaggaaaggcgagcacccagccagccacctccggagagggggcgggcgacacatgagcagaggtgggagcccgagacacgcggggcgcgcgagcgggggtggaggcgcgcggacgcgacggagtgcacggagacggcgcagggaggacgcgagagcggtggggcagggggcgggtcgagactgcgggggtgagagagggcgagcgacgcac

SEQ ID NO: 611337 - DNA, 401 bp, Homo sapiens
cactgtgagtttttaattaaaagccagtgaattgtgcctggagctagcagaagatggaagaggcatgtgaaagatctcccctatagcactgatccccaatctttttggtaccagggactggtttcatggaagacagtttttccacagggggatgcaggggggtggtttccggatgaaactgttccacctcagatcttcaggcattagattctcataaggagcctgcaacctagatgcttcgcacgtgcagtccacactagggttcgtgctcctgtgagaacctaatgccgctgccactgataggacaggaggcgaagctcaggtggtaaggctggcttgcctgctgctcacctcctcctgtgcggcccagttcctaaaaggccatggaccagtaccagtcc

SEQ ID NO: 611338 - DNA, 379 bp, Homo sapiens
ccattcaaacccagggcccttgttgagcttgtgaaacccaagcccaaggcaccaaaagagcccctgaaagctgttatggatgttttccccgcttttgtaaaaaagtgctgcaaggctgccgataaggagccctgctttgccggggggggtaaaaaacttgttgctgcaagtcaagctcccttaggcttataccctcccatttaaaagcttcccagccccccatgagaataagagaaagaaaatgaagatcaaaagcttattcctctgtttttttttttggttggggtaaagccccccccctgtttaaaaaacataaatttctttaatccttttgcctcttttttttgggcttcaattaataaaaaatggaaagaattta

SEQ ID NO: 611339 - DNA, 998 bp, Homo sapiens
  misc_feature (25)..(27): n is a, c, g, or t
  misc_feature (911)..(911): n is a, c, g, or t
  misc_feature (913)..(913): n is a, c, g, or t
tcttatctgctaccttgtggcgtcnnntttgccacgacttgccaatttcagcagctgctagagaaaccattcctaggaaagtgcccggcaggacgagggtaaagaagaggaacctgtggctgaccaagaacatcgcctgaactctaagaaaaggctgtccacatccacaccctcccgtctcctagagcctgtctctccctaccctcacctccaactacactctagtagttccttgctcctcccgcctcaccgatcgtcacaaccaacaacttcccacaaaacttccatgatatcgacgctagacgaagctctggacacgccaacgtacaacaacaacccacctcctgtactcgtctacttatccccatcaactgcattagccgcctcccccgcccccttccgccctctctttccttactttcttccccatcccctacttcctccttccttttcccgcaccccctcccttcctcccttccccctttcccctactccatccccgcgtatcttattcccgatcacccactcgcgataaccggccaaccccccccactatagcggaactttttattgaaccgatatgttgatgtctgcgccgctccatctcccccccgtttcctcctctctcgatccaccgactcaccacccacctgccgcaggtataagtcccattccatttccatagctcctctttcacacctacccccgcgcacattatcctactatccatactcctccctctatccacgctccgccgccttcttgatatgccggcactcactccgtagcaccagcagtattttttacggagtcatatctcgccctgacgtgatactcctaccttatcccacaccgacaccgtctctcgtttccgcgaacctgcgcccgcagtcctattgtctatcgcgaancntcattcaccgttcctcatatcgatcactacctcacacacccctctctcacccctatccccatctcgtaactcatcatatataatg

SEQ ID NO: 611340 - DNA, 180 bp, Homo sapiens
cccggctggatgcgcaacaacctctcgctgtaggtcagcggaacggcctcctgaacctggcccaaccccttattggcgttgccccccgaaccgtccccaacggaccaagaggacaatggaccatggcagtaggacgagcgcccatagcggaggaattacttcgcagctagccctggagca

SEQ ID NO: 611341 - DNA, 303 bp, Homo sapiens
tgcgcacccaggcggtagacgacgatgatccccagggtgaacgcgatcttgcgacgcaggtcgggcgtgcgcagaacgcgcgcgagggcgctgaacacgtggatgtcctccagaacgggatgccggcgcgcgccgcgcgcacagagtcccaggttatcccacagccgccgcagagcagacggcggaggttgcgagggaatgcgaacaggggccggagcatgctccgacccctgtctgcgacttacttgacactgccgcccgcggcgacggtcttctgctcggccgagccggagaccttgtcga

SEQ ID NO: 611342 - DNA, 131 bp, Homo sapiens
gtgtgccacctggtcacacaagataaagttcattccagaaatggtgggcccggatattagaaaggacatatcagtcgacggaggcatggaagtgggccatagtatgtgaggataaagatttgtggagtgct

SEQ ID NO: 611343 - DNA, 228 bp, Homo sapiens
caacgcatgtgccgctcccgcggcaaacccaaagcgatcgtcgccctcgagcacaccctgctcactgtggtctggatcatgctgaccgacaacgtcgtctacgacgaacccggcgccgattactaccagcaccgccatcccgaacgcaccaagaaccgcgctatctacgacctacacaaactcggatacgaagtcaccatcacaccccacggagcggcacatccgttg

SEQ ID NO: 611344 - DNA, 1076 bp, Homo sapiens
  misc_feature (684)..(684): n is a, c, g, or t
gggacaactccaagaaaatgtgggaaccaactggggccctggaccaaccgtgacccggtgcgtcccggtcaaaccacacacgcccacgggcccccccccggggtccaccacgaccccacgggagggatggagagaaataattttttggggttccacgaaaggaacgttttaattgaattaaatatggtatgccaaacactttttctttttaggttaaatttgttggaaccccccccacaatgattgtgtcccctcacttctcttttttggtttgtttggtccaactctggaatttgtttgggttgaaaacgcttgggaacctctgtgttttgttatagaaggaccaccaggtttccacctcgtgtcttgggtctcacagtggggttctaaacacttttctcgaaaagtgtcgtgcttggcaaaaaggtgttctgccactcgagttatataattttcacgcccctctaaaaccgtgttttcacttcccaagagacccccctcaccacgagagtgcgaattactctcgttggagagtttccaccaaccctccacgcgcccacatactttgtggggcacagagagaaaaggtttttatagttgttgtgccacatccacgccactctatattcactcgaatatatccacggagactcgggtgtaactcttgggtttaaaaggagaggnggtttctataggagagagatgcttggtccctcctcttaagaggagcaccctctatactctattgagtgagaagtaatttgtggagagaagttggtgttttatagaaagtgagagaaatgtcctcgtgatatttccacgctgagtcactccctcgtggaaaactcttgtaatcactcttatattaaatcactccctcgcctcgtgtgctattattataattcactaatcttctaacgcctgggaaactctttctgccccacaagtgttactcgtgcccttgtgttttggctaagtgtgtgttgttgagaaaaaaaacactttctctgcctcgaggttttaatttttgtcccaagttattttaatctataccattaaaaacttttgcctatcca

SEQ ID NO: 611345 - DNA, 452 bp, Homo sapiens
ccggcccccagtttattagaaaaaaaaagtgaaggacgtgagggttatgaccagaggcagccatgttagagaacgggtcacagcgactaatgagaatgatagtggagagagggcatgggtaccttttctcgaatctccagtgcccgctggcgcagaggctctgcctccttgtacttgccccttttgccatagagcacagccaaattgttgagtgtggcagccacctatgaagacaggcctgtccccatcagacatttgggttgcaaaagacctatgggaatctgaggttccccacctcccagcagggcccaacactcactgcacaactctaagagacaaagtctactaccctggagccaggggctgaagggaggggaaattgctgaacaggatggctctgaggctaagggacagtatcgccctctaggggattttaagaaatttctggaggt

SEQ ID NO: 611346 - DNA, 110 bp, Homo sapiens
agcctctctaagaacatgataggcttacttctgctccataataaagggtgataaaaaagccagaatataacttaagactagagaactgcgtacatgatggaccatttttt

SEQ ID NO: 611347 - DNA, 171 bp, Homo sapiens
gcggaccccagcacttgggagacatggcggaaggacgctgaggcaggagttcaaaaccagtgtaggtaacagctagaccctatctctacaaaaaatttaaaaattagctgggtgtggtggtatgtgcctcaagttccagctactcaggaggctgaggtgggaggagaggaa

SEQ ID NO: 611348 - DNA, 634 bp, Homo sapiens
  misc_feature (374)..(375): n is a, c, g, or t
  misc_feature (379)..(379): n is a, c, g, or t
  misc_feature (384)..(384): n is a, c, g, or t
  misc_feature (399)..(399): n is a, c, g, or t
  misc_feature (404)..(404): n is a, c, g, or t
  misc_feature (407)..(407): n is a, c, g, or t
  misc_feature (413)..(413): n is a, c, g, or t
  misc_feature (424)..(424): n is a, c, g, or t
  misc_feature (427)..(427): n is a, c, g, or t
  misc_feature (430)..(430): n is a, c, g, or t
  misc_feature (438)..(438): n is a, c, g, or t
  misc_feature (443)..(443): n is a, c, g, or t
  misc_feature (450)..(450): n is a, c, g, or t
  misc_feature (459)..(459): n is a, c, g, or t
  misc_feature (468)..(468): n is a, c, g, or t
  misc_feature (475)..(475): n is a, c, g, or t
gtggccaaatattgttagaaacttctggtaacttagatggtctggaatacaagttacatgatttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaaganntttnatagnatcgagaagtacacnggcancantaatantcagacctgantcnggnaaccctcnagacnctgtgtnaaaggtttnggagatttnaggtaanaagtttcctgttactgagaactcaaagggttacaagttgctgccaccttatctaagagttattcaaggggatggagtagatattaataccttacaagagattgtagaaggcatgaaacaaaaaatgtggagtattgaaaatattgcttcggttctggtg

SEQ ID NO: 611349 - DNA, 159 bp, Homo sapiens
acctggcccatgttacatgagtaggtagctgcagtaatgttagcggatagctacggcaggctatagcttgaatgagtaggctgatggtttcgataatcactagtatgggagataaggggtgtaggtgtgccttgaggtacagaagtgcggctagggcat

SEQ ID NO: 611350 - DNA, 410 bp, Homo sapiens
  misc_feature (238)..(238): n is a, c, g, or t
gggggtacaggagcccagacaaagcccaggccttgtcaaggagacgccagagggccccttgccaagggttttggccccgagggacccgtgggaccgaggctgcagaagctctccctccctactcccgtgggagccacgtgctggccatgtggccagggacggcatgagcaggaggcgggacgtggggggcccttcgtggtttggtggtcaacaagcctcacagggagccgttgaaacnctatgagggggccccttcaagggcagggggggaacacgcggtggcgttaaaaaaagacccccaaaagggcgaacaccaatttttttaacaacagattttcctttggggaccacaaagtttcctttccaaaggggaacaccactacataagaaaaaaatataacaaacaaagt

SEQ ID NO: 611351 - DNA, 208 bp, Homo sapiens
ccagctagtcaaggaggctgtatagcacttagaagacgaatccaaagaagactacatcagggcatttaataattaaattcccaaaggtcaaagattaagaaatgattctaaaagcagcaagagaaaagaaacaaataacatacactgaagctctaatacatctggcagcagacttttcagtggaaaccttgcaagacaggagagtgac

SEQ ID NO: 611352 - DNA, 115 bp, Homo sapiens
gatctagaggatcccggtcatcttctacacgatgcaggcttggatgcgaattcttttcccgattgcgcctcactcatgtttgaaacctatcagggtgtgtagtgtagaaattgaa

SEQ ID NO: 611353 - DNA, 152 bp, Homo sapiens
ttagttctgtgactttggggaatgcacagttaaaatttttaatggaaagagaaaagggctgaagaggcagccatgaggatgcttcccaagggataaagttcaaattcttagcggtagcatatgtaccaacagacaaaggcattgcccaaatt

SEQ ID NO: 611354 - DNA, 755 bp, Homo sapiens
  misc_feature (4)..(5): n is a, c, g, or t
  misc_feature (9)..(9): n is a, c, g, or t
  misc_feature (14)..(14): n is a, c, g, or t
  misc_feature (23)..(23): n is a, c, g, or t
  misc_feature (27)..(27): n is a, c, g, or t
  misc_feature (66)..(66): n is a, c, g, or t
  misc_feature (94)..(94): n is a, c, g, or t
  misc_feature (114)..(114): n is a, c, g, or t
  misc_feature (127)..(128): n is a, c, g, or t
  misc_feature (150)..(151): n is a, c, g, or t
  misc_feature (154)..(154): n is a, c, g, or t
ggtnngcgncggcntgcgcgtcnctcncggctcccgcttcctttgaccgctccccccccggccggnggcccgcctcctccacggcactccgctncttccctcccttcgtccttnttctctccttttnnccttcttccttccctcctcgcnncancgccaggaccgcggcgggggacgagctcggagcagcagcagagtttattaaccacttaacctctcagaactgaacaaagacaacattgttcctggaacgccctctttttaaaaaagaaagcataacccctactgtagaactaaatgcactgtgcatgaaacttggaaaaaaaccaagttgtataagcctgtatgacccttacatctcgagatgcagtaccacctataactaacaacatgagaggaggatgcttatacccccgaaggtactaataacccattaccagttccaccattaacttaatcaagtggaactttctgtgggaggaacagcaaatataatggcaaaggaaagacaagaacaggctgcgaaaacacgatgctgctgaccaacagcggtagcagagatcactgcgagaaactgaagcaccctgacccagagcaggcctggagggtgaaatggacagaagaataccagaaaggaaaaaaaatcaacaaaacaagtctggacaaaaacgacaaagtgaaagacattagcaactaaacgcaacacgagccagacaatacgaaagtgccagagagaatggccaccccaaatgaca

SEQ ID NO: 611355 - DNA, 509 bp, Homo sapiens
cagctcatcgatcacctgcgggtagctgccttccgggtaggtgtcctgcataggcccacgctccagggctaccacgtgcagacccgcgtcagtcagctccttggccatgatcgcgccggcccagccgaagccgacgatcacggcatccactttgttcaacacagtcgccatgcttcaagccctcttgccgggaatcgatacagccggaaacgggtaaggctcgttgcgctcgacccagtccatgaagtcggcgcgggcgccggggaaaccgatctgggtccagccgaccatgcctttgttgccaccatggatcgggtcgcagaagaacccttcacgggtgttttacaccagcaagctgaagaacaccttggccggaacggtatcgaacaccagctcgcctgcctcgaccttgctgagaatacggtctcgggtagcgctatcttgcgcagcaaaaggctgcccgccgttggttttgcaccagccgtccacggcagcgatgcccaggcggt

SEQ ID NO: 611356 - DNA, 309 bp, Homo sapiens
ccacgtacagatcttaataggctgccagaatatctcctctgggcaggcgacccaggaaatggtatgagtgagtgtgtgagcccttacttgatattttacaagtttggctttggtgttcatttttgtccttgtcccgtatgttcctgttgactaacgggtcatcttttccttgtagaaggttttacaagatgtgcttttttaccatgtcactaaaggccctcgggaccaagtgatcacgtcatgactccggtgagttcacacgtggtggcctgaaaagagtggctaaagtggtatcaagactgcctggat

SEQ ID NO: 611357 - DNA, 403 bp, Homo sapiens
accagggacatacttaaacagaggccactaactataaacagtgaataggtacatgtccttgaaaaaggccatataagattcaatgaatagggtacatataccagacccggtgtcacatctaatatagtgtgtgaatccatatctttagacaatgccaactcggaataagaagctagagccatgtccttgaggaaggacatctctgtttcttaaaatattgccatataagaagacttccgtcccataattatatacaatgattgtggtggtgacactctactaaagcagaatcttctccaggataacacaaaggaaccagccatgatataaaggactgcataggccctgggaacacagaactaatatgagattaaagtacacagaccacaacttaatccactca

SEQ ID NO: 611358 - DNA, 290 bp, Homo sapiens
ctgaggtgactctaaggatcccggctacctggaccttctgcatacctggaccttctgggctcaagcgattctcgtgcctcagcctcccaagtagctgggaccacaggcgcctgaggcaggagaatggcgggaacccggaaggtggagtttgtagtgaaccgagatcatgccgctgcactccagactgggcgacaagagcgagacttcgtctcacaaaaaagaaaactgacaaagaattgggaatcagaatatatcaagaactagcacagagctatcagaaggtccaggta

SEQ ID NO: 611359 - DNA, 126 bp, Homo sapiens
gatgcagaagagtccagttgatagtggtgttggttccatggcggggtaccgtagggattcatctgttctcttcacttccctttgcatctgagatcctgctggaaaccattgcaacacggtctctca

SEQ ID NO: 611360 - DNA, 211 bp, Homo sapiens
cctaaaataaagtattaccgaaacgttaagcacatgcctgttaatgccttccaagcacactacacgatacgaatgtcttcaatgtccctatacgtgaggccctgcatccacccctgaattcccttgggacctctagggtagaacgggtcctgtaaatttctttgcatccacttaaaacgccccctatttctgtttgcttcgttctcttcta

SEQ ID NO: 611361 - DNA, 465 bp, Homo sapiens
ttgcttgtgattgctagcctcattccgtccgtctggaagatcgtagacaactgcgcttcttacctaccatattgacagagtgtggctatgaggtcctgatggatgtacatactgctttgctgtgataacaggtgaacctggttagaagtcgcttgctgtgcacctgttctatagcatactacttctccatttccagttgcaaaactttgtggactgcatggttgcacatcgatagtatcacctgaccctcgagggctctccttgcccctgtagtacccacaggccttggtccacatctttcaatttgggagccaggtaggagagaaattgtgtacatgccgcatgggaggtagagaatgtaggtgactttttatccctgccacccctcattttgtttccttctctgaagcacctgccgctgagctcagttccccaaagaggcaggtgggcaaccaagtgggagtg

SEQ ID NO: 611362 - DNA, 526 bp, Homo sapiens
  misc_feature (36)..(36): n is a, c, g, or t
  misc_feature (106)..(106): n is a, c, g, or t
  misc_feature (128)..(128): n is a, c, g, or t
  misc_feature (130)..(130): n is a, c, g, or t
  misc_feature (149)..(149): n is a, c, g, or t
  misc_feature (228)..(228): n is a, c, g, or t
  misc_feature (239)..(239): n is a, c, g, or t
  misc_feature (260)..(261): n is a, c, g, or t
  misc_feature (305)..(305): n is a, c, g, or t
  misc_feature (334)..(334): n is a, c, g, or t
  misc_feature (370)..(370): n is a, c, g, or t
  misc_feature (382)..(383): n is a, c, g, or t
  misc_feature (409)..(409): n is a, c, g, or t
  misc_feature (525)..(525): n is a, c, g, or t
atgaagcagcaaagtcactgggtctgtttggaattnagcaatttgcatttctgattggcagccgccctgggagtgtctgtatccaagaagctgacttaatcaaacnacatcagcagtaatttggaaancngcacaaacaaggataaccntcaaccataagcataaagaaaagagagaactagaatcttaatgcagaactatccaatgtaaataccaaaaggaaaccanaatggtacttngagcaggaaaataacataaanntcatttaaaaagttgtatttatagccccagaaaccggaaagaantaaaagtaaatatggaagtattataatcngaccataccaagagtcaaaaacaaagagttcctacnaaagaggaatannttcaagatgatctggtcacatcatgngcatagttaagattgtttgttttaataaagattcttttgcaaataaagaaataaaatttagtaaagttattcttctcttgatgaaaaaatcttaaaaatgcaccactggtggtttnt

SEQ ID NO: 611363 - DNA, 888 bp, Homo sapiens
actgaacgcaaatcagccacttcaattaagctaagcccttactagtagcaatgggacttaaacccacaaacacttagttaacagctaagccaccctaatcaagctggcttcaatctacttctcccgccgccgggaaaaaaggcgggagaagccccggcatggtttgaagctgcttcttcgaattagcaattcacatatgaaaatcatcctcggagctggataagaatagagggcctaacccctgatcgttgtagattctacagtccaagtgcttcactcagccattttacctcacccccagctgatgttcgccgacgcgtaagactagttctctacgaaatccactaaagagcatgggaacactatacctattattcggcgcgatgagctggagtcctaggcacaggttctagagcctccgttattcgagccgagctgggccaggcaggcagaacttctaggtaacgagcctacatctacaacgttatcgtcgcagacccatgcatttgtaataatcttcttcatagtaatacccatcataatcggaggctttggcaactgactagttcccctaataatcggtgcccccgatagtggtcgtttccccgtcataaagaacatatagctttctgactcttacctccctctctcctacttcctgtcgcatctgctatagtggagggccggagcatgaaccaggttgaccacgttcttacctccccttagcaagggaactactcccaccctggagcctccggaaaaactaaccattttttacttacaacttaacaggagtctcctcaaattaagggcatcaattcatccacattttagttaaaaccccgcaaaaccaatacaaagcccttggtgaacccaacaggagcatcc

SEQ ID NO: 611364 - DNA, 1771 bp, Homo sapiens
  misc_feature (526)..(526): n is a, c, g, or t
  misc_feature (620)..(620): n is a, c, g, or t
  misc_feature (902)..(902): n is a, c, g, or t
  misc_feature (999)..(999): n is a, c, g, or t
ctaagtagaaaaatagaattttataactacgttttacagattattccaagaaattatcatgggtttattttattctttttggaaatattattcctttatttaacacgacactaaaaaacccggtgtaaacgcctgcattatactatttcacactattagaaaaagatatcacatatttattgcaaaatattattgtaagacaccagaacacaccacctattcttaatatggcccatatggtgtcacccatcttatacactgtgtgtgggacgcaatgttattatattatcgaagtgttattggacactattggcgactattatatttatcaccatcttagaggtatcgggtggtctttgcgcgaggggaggcacagtgtgagggcctatattctgtggtgtgtgcgcctttttgtgtgcaacacaccaccaaacacctgtgtgtgtgtgctatattttcaatgtgccgcaacacgtgtgtgttataccacattttatgtcgcgccacaaagacacacatctccgangcttaatgaggcacagcgcgccgacttaatcaccgtgtgtggagaccacacgtgtgtcttttcagagaaatatccacactatctgtgaacagtngggacacacaccatattttctcgtatctctcttcagaaaagacagaaaaacacaacacagaggatatatgttctctctctttatatctctcccctgtgtgtataatagtagtgaggggataagcaactctttctttgatcaaacgccggtgtaatgaagaaatattctgcatgtgtgttcgattatacccccccgataggtggggggggagctactcccaacacagagaggggtggtcacccctcataagcagtgatcatatttatattgagacattgtgcnacccacgaagtgttggaaacacacaaacatattgttggggcgagaacacaagaaacacattctccgaggagggccattctatgttgttggggcacgncgacggagtattatactcgcaccccaattatatttgatgaatcaccaaaagtcattgcgaggcggtcgttgatcgttgctgcgcacaaactattcattctgcagaagagctcatacattataaacaaaacgtgtggcggcgaggaagaagacaaccgtggtattaaagaggcgcgcgccattattttaacaatttggtgacgacagagcgggtctttacaaaacaacgtggtgtgtgtgtattacgaccaggcaggggagaccaccacacagggattattcaactcacggggagggggtttatacaaacccacgtgttgatgcttacatcaacaccaacccagagactattcatatcataagagagatatataaaacaacgcgcatcgttgttgattcaagaacaagaattttattatcgcggggcgagcagcaaaataggttggccgccaacggcgcatcttgattggggggagcgaaattgtggttgtgttataaaaacgacaccagacacgttgagaaaagcatatcttctctcattctactgatggaagagtggtgagggcgcacacacctaaaaaaatacgagggggggggtgtatgtgagtacgagcgccagttatagtatatcattaatctacaagcaggggaagagaaagttttccagccgacccaagttatacaccagagaataatcggatgttttcgtctacagcacgagagatggattgtggctcccatccatatgcagcaccgagcagatcacatcatgt

SEQ ID NO: 611365 - DNA, 497 bp, Homo sapiens
  misc_feature (8)..(8): n is a, c, g, or t
  misc_feature (14)..(14): n is a, c, g, or t
  misc_feature (100)..(100): n is a, c, g, or t
  misc_feature (105)..(105): n is a, c, g, or t
  misc_feature (154)..(154): n is a, c, g, or t
  misc_feature (198)..(198): n is a, c, g, or t
cacagccncattanaaattcttaatgttttcaaattaacccattccccacgcagaattaatctgggtcacattgacatccagtgcaggaagttactttantgttngaatataaggtgtgtaacacagaaaaaaagcctgccactgaattccagntgacccctagtaagtgattccctttcttggagcttcagttttgncccctataaaatagagataacggccaggcgcggtgactcatgcctgtaatcccagagctttgggaggccgagtcgggcggaacacgacgtcaagagatggagaccatcctggccaacatggtgaaaccccgtgtctaccaaaatacaaaaatcagctgggcgtagtggcacacacctggagtccaactactcgggaggctgaggcaggagaatcgcttgaacccgggaggcagaggttgcagtgagccgagatcgcgccactgcactccagcatgggcgacagagcgagactctgtctc

SEQ ID NO: 611366 - DNA, 553 bp, Homo sapiens
  misc_feature (184)..(184): n is a, c, g, or t
  misc_feature (186)..(186): n is a, c, g, or t
  misc_feature (493)..(493): n is a, c, g, or t
  misc_feature (527)..(527): n is a, c, g, or t
  misc_feature (540)..(540): n is a, c, g, or t
agagctgatcatgaagtccatcatcccagtggttatggctgggatcatcgccatctacggcctggtggtggcagtacttatcgctaactccctgactgatggcatcaccctctacaggagttttcttcaactgggtgctggcctgagtgtggggctgagtggcctggctgctggctttgcattngnatcgtcggagatgctggtgttcggggcactgccagcagcctcgactgttcgtgggcatgatcctgatcctcatctttgcggaggtgcttggcctctacggtctcatccgtggccctaatcctctccacaaagtagtccttttccaccatcagtcacaggataggatgtaaagatcacccctcctcattccagaacgaacagcctgacacatgcacgggcagctgccctcaagtagttgggtcttgtaaatgttgcagtgtcctagttgcccattggttctggtcggcccccgcctttggcccctaantgcaacgtgctggttggaaatacggggccaattnatcttccaaccanggcccttgaacaa

SEQ ID NO: 611367 - DNA, 806 bp, Homo sapiens
gcagcgctacttttggtccggggtcggcaggaggccgcgggtaccgcatcacagctgacgtgaggactacgtggggccgctgccggtccgggttgctgggcggggcgccgtttctgagcggggtcgggctcgccgtctcccacctcctcgacgtccgtactcagttgacgaggtccgctacgataaatcccttttgcgggggacgaaatgaccatgtgaaacatgttgaaatcccacgcatgagtggaagtataacagctcctttagacagacgagcaaagtctgctcatgttgcagacctcagacttggccaaaaattcagatcccgtgctatagcctcaagttgccacctggtgacatgccaagttaccagatccgagctcctacgtgctgcttgtgccacagggagtggtgatggctagcatcgcccggaaagtttgcacagcccccagcagctggcagaagaagcaagacgcaaaacgagagctgagggctaatgacaaaaccggggaagctgcccgggaagtggtcggcaggaggaagacgggaatattgtcaagaagtgtctttgaaaaattccggtggtggcttgttgctttgaaaaaccaaaaaaaaggacttctcatttgagggaactcaagggccctccaaaagatcttaatgtgccataaaacgtaagaggtaaccgtgttcttggactttggcccttggttaacttctaaatcaagggcaggcagatgcagcacgccctatcttatgtgcatgttggacttggtgcgaaggaccacggtgtgacccttaaagat

SEQ ID NO: 611368 - DNA, 320 bp, Homo sapiens
  misc_feature (18)..(18): n is a, c, g, or t
  misc_feature (37)..(37): n is a, c, g, or t
  misc_feature (276)..(276): n is a, c, g, or t
  misc_feature (279)..(279): n is a, c, g, or t
gattacaggcgtgacatncatgcccggtcctattgtnagttttttgaggaacctccaaaccattctccatagtggttgtactaatttacattcccaacaacagcatacaagggttcccttttctccacatcctcgcccccattccttattgcctgtcttttggatagaagccattttaactggagtgagatgatatctcattgtggttttaatttgcatttctctgatgatcactgatgttgagccccttttcatatgcctgtttgctattttttnttnttttttttcagaaatgtctattgagttctttttcctatggg

SEQ ID NO: 611369 - DNA, 184 bp, Homo sapiens
aactctgaaccaacttctctatgatctctgaatccacatctgagtccaacttctctatcaccctctatgaatcccatttaacttctacacctgcaagtcctggtatatataggacccctccctccgagctgaagtacacctttgaccttgccacacctttcaccccccaccccgtcgggtggag

SEQ ID NO: 611370 - DNA, 101 bp, Homo sapiens
gctcacacagctggctggatatagagctgatgagtaagaaaacctggcagaacaagttcagcgttttcaggaactcttgatcttggtagtggaagcgtttt

SEQ ID NO: 611371 - DNA, 104 bp, Homo sapiens
tggcgttaacacagtgaattcattgtccctttctcttcaatgctgggacctcacctggtctggcgatgtgctgggtctcggcggtggccgggttggcttcatgt

SEQ ID NO: 611372 - DNA, 304 bp, Homo sapiens
ctagaggaccccgatgtggacatgtcgggcagcaacagcgtgtactggatttcccgatatcttttctcagttggtctttatgaattccctctcaacaacgtggactagtcttctacatggaatcattttctcgccaagcatgttatcttcagtagccaaccagacagtgctgttggttgaacgaacgtaatggcacactgagaggaaaaacaggtcttctgaacacagagaactgaagacatgcatggcagtaggccccatgagagctaccacccagtgagaccaggaaacaatgcaaacaatt

SEQ ID NO: 611373 - DNA, 262 bp, Homo sapiens
ctctatcaccctattataacgacactaatgttagtataagtaacatgaacatattctcctccgcatcatcctgcgtcagattcaaacactgaactgaccattaacagcccaatatctacaatcaaccaacaagtcattattaccctcactgtcaacccaacacaggcatgctcataaggaaaggttaaaacaagtacaaggatcgcgattaatctcagcccgcttgtatgccaaaaacgtctactcctaccccttactgata

SEQ ID NO: 611374 - DNA, 160 bp, Homo sapiens
gaggtgtaattagcagcggggcccggcccctgagctctcggcgagcgcggccggtaaacaagtgggccaggatgccgtacgagatcaagaaggtgttcgccagcctgccgcagttggagagggtgcttttgcaagattattcggcggcgaacctaaggga

SEQ ID NO: 611375 - DNA, 263 bp, Homo sapiens
tgcaacggtctcgtactgactttacgctgacgtcttcctacgggaccactccacgcttcctggtgacggtactactgaccactgggggtcttacgctctggacagagctctacgagacctctagacacagacggacacggacaaaggcttctgtctttctgactgctgactctccaccagcaccggacaattgcgcacgtgttgacacgtctcactgctggtctgtaaagccaggccacgacacgacggacactgagacctac

SEQ ID NO: 611376 - DNA, 200 bp, Homo sapiens
gccgggttgacaatgtggtttagctcttccagagagatagttgcagggttaaactccaattcatttttcgggccctcccagagttttcgtgagttctccgcagctcatacctgttggctgtgtatccctgggccacagctgggtgggggtcgccttaaaatcccaggccgtgaggagttagcgagcccttctcacactcg

SEQ ID NO: 611377 - DNA, 320 bp, Homo sapiens
gcggtcgcctactactactaaattcgcggccgcgtcgactataatctctttttgaaatctctctgaggccaggcatggtggctcacgcctgtaatcccagtgttttggaaggccgaggtgggtggatcatgaggtcaggagattgagaccatcctggctagcacggcaaaaccctgtctctactaaaaatacaaaaaattagctgggtgtggtggcgggtacttgtagtcccagctacttaggaggctgaggcaggagaattgcttgaacctggaaggcagaggttgcagtgagctgagattgtgccattgcacgtcgac

SEQ ID NO: 611378 - DNA, 1058 bp, Homo sapiens
  misc_feature (332)..(332): n is a, c, g, or t
taggtaaaatcttttttattcaaaaaaaaaaaaccccaaaaaacaaaattttcccaaccacacccgggaagggactatgggtaggggcgagggtgctctgtccactccagccctgggcccccagcccagtgtgtggtttgggcagcaaataaggggctagtggggctaatgtggcccaaaaaataaaagtggtcggcggtgtgatatggggagagaacaggggggtgcacaagccgtggtggggacgccggcagaaggggagacacgggaccaagaccaagggtctcacgacaccgtggagaaccgcccagacaggtgtggacaaggccaanttctcatataaccatcttctctgtgtgtgagacctcaaaacccacgccgggtgggaaccacctcttgcgttgtgccccccattacaggcagccggacacatacgggcggtacgtgtggctgcagggtcctgtgggcgtagcaccgcggttgcacacctttgtgacagcggggtggcgtgggtccccccccgcgcggggtgccctactgtgggatcccacaaacgatctcccatgtgtctctaaattttgccgcccaattactcgggagccagcccgcggcgaaagatccccgagacatatccacgcgggatacaaacttttcacgtgggacccccccacaaagtgttgttacgaagccccatatatccacgcgcgataaaaaacacactttttgcacccgcgggattccttgtgtggccacaactcccgagcggacaaaacccaaaactctccccaagactgagcgaccgctgtgtcaatcgtttcggcaacacaaaaccgtctatatcccccgcggggagacagcgtgggtgggcccccacaacacagggcacagggccgaaaagatcccctgtgtataagcccccccaaagaaaaatgggccccgccggtcttccattagaaaaaaagggtttcccgcaggatgccaggcacccaatagaaagacgagttatggtcatcacacacttattatcggggtggaatcatcaccaccgctggtgggcc

SEQ ID NO: 611379 - DNA, 834 bp, Homo sapiens
  misc_feature (154)..(154): n is a, c, g, or t
  misc_feature (158)..(158): n is a, c, g, or t
  misc_feature (169)..(169): n is a, c, g, or t
  misc_feature (185)..(185): n is a, c, g, or t
  misc_feature (212)..(212): n is a, c, g, or t
  misc_feature (226)..(226): n is a, c, g, or t
  misc_feature (258)..(258): n is a, c, g, or t
  misc_feature (312)..(312): n is a, c, g, or t
  misc_feature (320)..(320): n is a, c, g, or t
  misc_feature (327)..(328): n is a, c, g, or t
  misc_feature (332)..(332): n is a, c, g, or t
  misc_feature (341)..(341): n is a, c, g, or t
  misc_feature (349)..(349): n is a, c, g, or t
  misc_feature (367)..(367): n is a, c, g, or t
  misc_feature (372)..(372): n is a, c, g, or t
  misc_feature (375)..(376): n is a, c, g, or t
  misc_feature (408)..(408): n is a, c, g, or t
  misc_feature (427)..(428): n is a, c, g, or t
  misc_feature (432)..(432): n is a, c, g, or t
  misc_feature (438)..(438): n is a, c, g, or t
  misc_feature (440)..(441): n is a, c, g, or t
  misc_feature (443)..(443): n is a, c, g, or t
  misc_feature (452)..(452): n is a, c, g, or t
  misc_feature (465)..(465): n is a, c, g, or t
  misc_feature (596)..(596): n is a, c, g, or t
  misc_feature (608)..(608): n is a, c, g, or t
cttttacaattaaaaaatagcacttcttcatcttatgcctgttgagaagatattaaattttcacatgttgacagtgaaatgctatgtgggtttataagattacagaccattgttttcatgtggataattttagtgcattgtcacccggtatgtntttnttttttaactngaacatttggctggtnggttttcttttaattagataatcacanggaaaattaagcgntcatatctttaaattaggatggcaaaccaggnaaagaacgcattggagatttaagatgtcacttataaggggagaagtgttcttanaaagtcancagaaannggtnatgcctttnattggttngcaaggatgtcttggaangtgtncanngaatagaatatccaatagagataagctgactngaatcatttggagcaattnngccngtggtntnntnttgttccangcacatattggcngtgggattttctccaacagaaaggtgctttcactacggcccgttaacaagcagcaataggttttatattccaactccgagcactgcggtgagtaacatcacctcaatttttaattatccttaaagatatgnattcatatcctnaatcattaacggatcaggggtggacatagggattttacgtttaccattctctcacacattagatgaggtcctatgtgttagaggggttttaggctaatggtgagaactatcagggaacggagggctaaggtaagtgggcttacgatgtgtgttgcacgaagttcgtttgtaaaaggagcggtataattggccaaggaaagttggaaacggttggataaaagtcttg

SEQ ID NO: 611380 - DNA, 1117 bp, Homo sapiens
  misc_feature (712)..(712): n is a, c, g, or t
  misc_feature (1034)..(1034): n is a, c, g, or t
ggagcggagccggcgagctaacccgagccagccggcgggcgtccggaggcggtggcgcagggaggggcccgacgctcgcacgtggccccggcggccgccatggcggacagcggcacctgcggggggcgctggcgttggcggccccgggccccccgggccggggcagttggctggcccagtgaccacgctgtcatactttcagaagcccccccggggggccggcaggagaggggcccggggcgggggcggacgaatgacgggcccatgtgacggcgccaaagggaagggtcaccggtcaagttatgaccgcaagggagcttacggaaaggcgccttcaattctaagaggaggtgggatccgtggaagcaagctcagcggcgccctctacgaagtggccagcgacagagcgagattcccgagaatctggagatttggacgcgtggattgaagcctccgtgggaccagtgcgagaggtgaccgattgcccggggtctgccaagggtcaagggacgctgctgggtggacctgtttacaagacccacagagggccttccatttcttggcctgctgggaccaagatccgggggcattgcagaaagctgagcacaccccaagaagaagttgagggtccccgacccaggagaacgggtggctcccacaggacaatcgctgcccccaaaatctcgtaggcaacagcaaataccgggggacnctgcggacaaggcctggtgccatgagcagggctccttcgtgcgcctggcccaggggttctcttccccttgccccctcagtttttccactttggaggagtccactggtattaccgttgatgcgacttttggggttcatattggactctgcggcagcggccctttaataaaggctaggatacgcctttggtgcacaacacaataagatgagtaagagaacaaaagaagacgcggggtatttgtggggggaacagaagtattaaggagacgtggtataattttttgaccttttttaagggggaaagcggccattgggttttgttngatgttacttgattttttgatgaacaatacaagaaaaaaaataagagtgaaacaataaaaaaaagataaaataaatataaaga

SEQ ID NO: 611381 - DNA, 140 bp, Homo sapiens
accagaatgcaaccctgggagactggacgacgtctgaatactttgaggtctacatgaaggcccgtggattattgagtttctgccacccgcaagattgcaagtacgctctcactcagacaaatggttattgatcacatgac

SEQ ID NO: 611382 - DNA, 498 bp, Homo sapiens
  misc_feature (284)..(286): n is a, c, g, or t
  misc_feature (318)..(319): n is a, c, g, or t
  misc_feature (331)..(331): n is a, c, g, or t
  misc_feature (341)..(341): n is a, c, g, or t
  misc_feature (351)..(351): n is a, c, g, or t
  misc_feature (368)..(369): n is a, c, g, or t
  misc_feature (381)..(382): n is a, c, g, or t
gagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctttttgggggggggggggggggnnnaaaaaaaaaaaaaaaaaccccccttttggggnnccccaaattttncccgaagggngtttgggganactgaattctgccttgnngttctggccacnncccagagtgggagaggctgggaggttgggaggctgtggagagaagtgagcaaggtgctcttgaacctgtgctcattttgcaattttatcagtaatttgacttagagtttttacgaa

SEQ ID NO: 611383 - DNA, 468 bp, Homo sapiens
tcacagttttcgctgtgctaacttaggtctctctccagagagagctatatattaaaaggtgctgtttcttcactttattccttggcaacaatgaattatgcataaagtaaaaacattgcctctcaggaagtaaagccatcagaagatgtctcagaacagcgtgaaatctgtgggatagctttttttttttccaccggcaataaactcagggcattccagaaaaactcgacctttcattactccgagaagggcagtttggtaagcacttctcgtgtcgaggcaccttggtaaaccagctgaggggaactctgcacccagcctccggtgtttgtctgggtgtaaacggggcaccaaatggggattcaatgtggccggggtgttctccatggccaccagcatttcctaataagggcaacttcacttttttggccacggtgctacacaggtaacaaaacacatatttgtgct

SEQ ID NO: 611384 - DNA, 359 bp, Homo sapiens
gtggataccactaacgtatgtctcacgctcaggcgtgaagcaaggctgtgccaggcctggcaggctagcaggatgacagcaaacgcatctgaacgtgtagcaatcaggtcccctgtaactgtgcttggagacgtgtggaccaagggccgacgatgacgcagctatgagcttgtggcaagggaatgcggggaacgcagaacgggcacaaaccagaagtactgcagcggacgaggctgggctctcagggaagccgcctgtcacgtgccatggtggacagccaagctgcacggcgggggacggaaggagggcccttacctctctccttacttgtccattgggaccattctatctgcagccct

SEQ ID NO: 611385 - DNA, 302 bp, Homo sapiens
ccatgtccatgaagatatttgtcttcagaactaaaactgcccttaattttaatatacctctcaatcggccactggccatttggggtctaagtattcaattaagtgggcactccctggaagatggtcagctatgaagtaatagagtttgcttaatcatttgtaattcaaacatgctatattttttaaaatcaatgcgaaaacatagacttatttttaaattgtaccaatcacaagaaaataatggcaataattatcaaaacttttaaaatagatgcggtgtagattgcggtgtttgtggtacc

SEQ ID NO: 611386 - DNA, 397 bp, Homo sapiens
  misc_feature (36)..(36): n is a, c, g, or t
  misc_feature (49)..(49): n is a, c, g, or t
tgaatgaataaataaattggtggattaatgactganatggagtacaganagactgtggtcccagaagacccttaacattgagcttgctgcagactgaatgtttgcctcctctcaaaattaatatgttgaaacctaatccttaatgtgatagtattaggatgtggggcctttggaaagtgattaggttatgaaggtggagccctcgtgaatgggagtagtatccttataaaagataccccagagaggtcccttgtcccttccaacatgtgaggctacagtgaaaagatggccatctgtaaaccaggaagtgagtcctcaccagataccacatctgttgtgctttgatcttggatttccctgtccccagaactgtggtaaataaatttctgttgtttgt

SEQ ID NO: 611387 - DNA, 362 bp, Homo sapiens
ttcgcacgaggtggaacttggccccctaaaaccaaacccgtgggccgggaacttgtcctcggaagccccaactggactctcattcgccaaggaacaaccccgctgctgcgtctcgtcccggggcacaggggacgggcacgacggtggagagacccagaccagctccccgcctccatcaaccaagatggaggagctgcggctcccctgagctgggctcccaccggttggagggctgaggcctccctgggcgtccttggcccgccgtcctgtgtccgcagcccggggcgactgccctgcccaggcctctctaccgcctgccaccgtctcctggtcctcaatggttgatggagactccatggagg

SEQ ID NO: 611388 - DNA, 138 bp, Homo sapiens
tgaccaagtgtcgccccaaagtgagagcaacttttagagctacattagtgcttttgcactaacgttccgaggtaaaatggcgaaaatttcagcaattggcatgcaagaaccagtctaaaagttcatcactggtggtac

SEQ ID NO: 611389 - DNA, 286 bp, Homo sapiens
aagatgtcaagtctctacgtaatggcattttgaagtgctcccatacagagagatagcgcataattttaagacgaccctgttggacaggacgaagacatggagagggcagatctgccgtttaggcaaccttagttcgtgatctgcaaccaggaaaggagtgctgaggcacagggaaacaaggggagccaaaagggctgccggggatggtgttgtgcagggctatgggaagaaggtcctgcccatgagaggctcatctcagttgttgagcagcttccttcagggaaac

SEQ ID NO: 611390 - DNA, 762 bp, Homo sapiens
ggctctccgtgactctctgagccgggagctgccctggaagccccctggatcatggaacgagaaagcgctagaggtttatgatttgattagaactatccgtggacccatgaaaatgcccaatactttagcaagaactggaacgtggtctcggacacagtcgtgtggaatgttcacggagataactgaccgcacagaatatctggtaatctatcaggttcagcgccaacaagtacctcatttgctctttggccgactctatatcgggcgcctgtgctttccggcagctacacacactttccagaagatgtttctacccaattttacagagcaatcaacgcttgcgacactcctaccacttctctcgcaaggcacaccccaacatcaaacaagaagcgcacagcagcattcaacttacacggccgtggattagatttgacaacaatgaagcataagttgcgccacgactttgcaaatttgcggacaacagcgcccaaatcttataagcgagtgcaacactttggcttgggcaacccacaggttttgcgttggataccccttttggaaagcccccttggaacctttggcattaaagatttggttcacatcacagtggaagcccccaatacttgtggccgtggctaaaagtacgggtatgtggcactatgtagtacagtcgcataccagaaacgctatctttgacggcaacattcaatcatggtcacgaatacacctacaagtggttccaaaccatataccaagtag

SEQ ID NO: 611391 - DNA, 309 bp, Homo sapiens
taaaagaaatctatttcataccagggaggaaggctctgtcccacatatatttccacttcttcattctctcggtatagtttggtcacaattatagattagattcaaaagtctacatacctaatacagcgtgagcctagtgtagtagtgctagtgattaaattaacttatgtaacttttatggtcttgggcattaacaggtgtttcaaaaaattttcgtggtgttttacccattcaggtgatttcattcccaaattctctctagaagcattaaggtgtcctcaatatatttaaacacatatggaataattc

SEQ ID NO: 611392 - DNA, 130 bp, Homo sapiens
caatgaacatggctcagacttgctgtgggcagtgtatcagtcggggttcaccacgagaagcagaagcggtaggtgtatacagaaagagatttattatacaggaattggctcatgcaattcatgtagcgcg

SEQ ID NO: 611393 - DNA, 359 bp, Homo sapiens
  misc_feature (60)..(60): n is a, c, g, or t
agatttttagctaatgtccttcaaacatattccataataccaataactgcttatacctancatgtataagaacttacctgtgtcaggttggatgcagtggcacacggcctgtaattccagtactttgagaggctgaggcaaaaggatcacctgagccaggagtttgagaccagcctgggtaacatagggaagccccatctttacaaaaatcagctgggcatggtggtgcacacttgtagtcccagctacccgggaggctgaggtgggagcattgcttgagcccaggaggtggaggttgcagtgagtggagatcccaccaatgcactccagcctcggcaacagagtgagaccctgtctca

SEQ ID NO: 611394 - DNA, 1812 bp, Homo sapiens
  misc_feature (1010)..(1010): n is a, c, g, or t
  misc_feature (1151)..(1151): n is a, c, g, or t
cgggtttcctgcccgctgctgcgtcgccttccttccggctgccgcctgatgggtgtggggtggccccatttggcctgcggtgtggtggtttttgtggtgttcggacacaccacgggtggtcgagcgtggttggttgccttcgtgttcgggggggcccccgccttgataacggggcttgtgtcgcggtttcttccttgcgttcctttagaggaggtgtggcttgtttcggttggcgtctatgaggaggggggtcccccgatttttctcggggggagtctctctctattcaggggggtctgtctccacatgttgggcgctttcttgactaggcggtgctcgcttgatcagcgggcgtgttgcgtgtagcgccgccgacaatgtgcgctgtcgggcggcgcggcgagggagtcgtccgtattgtctctgtctgggcgcgccggcagctcggcactgttgttttgggagccgcggcccgtgtggtgcgccgctggtcttgtagatggtttgttgtggccggaagcgattagtgtgccgtcggttgggtttctcgtctagtttggaggatgcttgtcgtgtaaagagggttgctcgcggaggttctcgtcgactctgcctcgcgctcatgggggtgtttgttcccccccccccccctcctgttttgagagggggggagattgccctgcgccggtccgcgcgcgccacaatgggtttgtttatgggagagatagtgattggggcgctcctcttttatagtagcgcccctgtttgtgtgctaaacaaacaagcgggggggggggttggcgtgtgccccctctgtttctctgggggatgttggtataagacgtcaccgcggtgagttccccgctgagtgtcgcccccccgctgtcgggggtggagaagaggtgtttgtcgcccccgctcgtgctttcttttggtgaagacaggcgatgatcgtcgctcttgatgatgagcaccccatctcggcgaggacacagcagttgtgtgtgtgngggtgtgtctctcatatgcccctctccccacactgtatgaaagagtggtgtcagcagagagccgcacagagagcacagcctcggggtgtgggaaagacacactgtggggagagcacagcagtgtaaccacagagagcgtgnggagatgtttttttttgggcgccacatttggtgttttttcacacaccgcgcgggagtagttctctgtggggaattctctcgtgtgtggaatataaaagagatataaaggtggagacacacggcttgtctcctgaggtgcctccacaagaggatcttgggagatttaaaagggggttattggaaagggacgctgttgtgcgcccggtatctcatctcgtggaggtggggtacccctgggggtgcgcacatcgcacacaggggggtttatcttttggggacactctctcgtgtgtagaggttgttcactgctcaggacattctctgtctcgccactctcctctcccacccgagaatagcccagcagaggatttcctgtgaagaaagaaagactgtggggtttacactccggttagagttagagatctctaagaccacaattagtgggactgtaatattgcgtttgtttggaaccacgtggttgtgaagagaaagaggcccaaagaggacattttataataatttgcactacgtgtagggaattggtcttattctcctggaaaaaagtgaccggagagacttttgctctttaggccagaagagtttctcagaagtttcctggtgtgtgtaaattataccccgcacgtctttgccagtgtgaata

SEQ ID NO: 611395 - DNA, 992 bp, Homo sapiens
cgcggcggcaccggggcggctgcgtgcgcgctcggagccccagagggtcacgcgtgccgggcagggtcggtgtgctgcccccttgcgagagccggggccccagtgccctggcggacaccatgaaccacctgaactgtgctggccaaagcgctctatgacaatgtggccgagtccccggatgagctctccttccgcaagggtgacatcatgacggtgctggagcaggacactgcagggcctggacggcatggtggctctgctcgctgcatgggcgccagggcatcgtgcctgggaaccgcctcaagatcttggtgggcatgtatgatacagaagccagcagggcctggctccggccctccctgccaccccggcccagcctcagcctggcctccatgccccaagcgccgtccggcctccccagtaacaacgcccatgctcgccaaaacactaccagacaccagccagacagcgtctacctggtgcccactcccagcgaaggctcagccaaggccttctaccaaaggtcccgggttcccagccctacagttccagttctcccccaggccaagcaagacaattccagcttcttcgaagcagaaacaccatcagcccggatttcccaggcccggcccacaagacctgtaccaagggtgccccagggccttggaagggccttgccaaggaatatttaaccagggtgaccaccttttcttgcgcgcggattcggggcgcaattgacaattcataccaaaggtaccacgcccgtttcccaatggtacaacatgcgccaagcgttgtggggaggggcgctcatcggaaacgacccccccggggcgaaatgacgttggtttgtgtgtcgcctaacactgcgatctgtgaggggtcagggggcataatgttatacgtaggggcctgtccctaggccgtgatatccaggggaacggcagcgattagcacatatcccggataaaaccatagtttgtgccacaggg

SEQ ID NO: 611396 - DNA, 391 bp, Homo sapiens
tcgtgtggttcttcgctgttgtagctccggcgtctcggcgtagactcgcagtaggagaggcggtctcttctctctctccttccttttgtgagatttttttgatcttcagctacattttcagctttgtgagaaacctcatcatcaaaggagatggctagcaatgttaccaacaagacagatcctcggtccatgaattcccgtgtattcattgggaatctcaacactctggtggtcaagaagtctgatgtggaggccatcttttcaaagtatggcaaaattgtgggctgctctgtgcataaaggctttgctttggtccaagtatgttaatgaaagaaatgcccgagctgctgtagctggcgaggatggcagaatgattgctggccaggtttta

SEQ ID NO: 611397 - DNA, 1118 bp, Homo sapiens
  misc_feature (145)..(145): n is a, c, g, or t
  misc_feature (496)..(496): n is a, c, g, or t
  misc_feature (541)..(541): n is a, c, g, or t
  misc_feature (652)..(652): n is a, c, g, or t
  misc_feature (687)..(687): n is a, c, g, or t
  misc_feature (760)..(760): n is a, c, g, or t
cttgatttggtggtatcgatacgctttcttcgacgcggcgctgggacgagagcatttcggcgcgtgtcaactcacgctcctggcgctcatcgatatgacgctgcacggcgcggtactcttcggcgtcgcgcttggccttcttgtngcgtgtaaacttgggacggaagatggattggttgagctgagcaatcaaacgagcattgtcttcagcacgtgaggcatgggccttggccacgtcgagactgcgctccgtatcaccgatcgtgtcgctctgctcacccagtctgaccatggtgttggtggccgtttcttctgcctcacgtgcgagacgcaccgcattgcgtgagctgctgagactctcttgcttcgtactccgtagctggtatttgatatcctgaattgcctcttcatcaggatcaaactcggtgcccgcaccctgcgacgtgtatggatcgcggtacactgacgttggctgtgggagacgcgatacgggcgnggctgaacctgagccatactcggcgagcagctcggcatcggatgnctgcggcgtttccgtgctcccgctgccgtatggatcacgcggccggccagcagcgctcttcgctgatacatacggattcagctcactgctattgctcggttccgctggcgnctgctctaccggcgggatcttgggtttccgtcganacaagggcttcatgagggcggaaaaacaagacgcaccgccccccagtggaggtatctcagcttccatgggccnacaaggatccaaaccggcacggacgctcggagcgcgggtaccaacgggccctcttaaggcgccgagcacagctgcacctgctgcgtctcgtttccataaggatgaatgtacgtacaatctacttacacatgagcgattctcagcgatgcgcgtgatccccaattcatgcggaatctgagtgcgctgggtcctgtggtgccccagcagcctgtggatgcgcctactcacgaggggcctatgatgggcattatacatgcgcgtgtacgcaatgagcgcgaagaggaggagggctcagcgccaggtcttacggctggagatctggtgcgccttttgaccgaataccaccaaaaacacggag

SEQ ID NO: 611398 - DNA, 254 bp, Homo sapiens
acaagaaaaaaaccccccatttacagatatgataaatccccgaataaattttattaaaatcgcgggggctaggaggagataatgccatactcttttacactgaaacagcagcattattgcctagaactttacccattttagagttagatactaaggaaccaaactagtgggccaccatcatttccttttttccttttcctttttttttttttggcccttaaggtgccataaaaaacctggtttttttccttttg

SEQ ID NO: 611399 - DNA, 643 bp, Homo sapiens
tcctgtttacatcgtgatgggtccctgctggtttggttgctgcagtcatcaagaggagccttgtcctcttgttttccttgactggatctcgccccatcatcatgtcttctactctgtctctccatgatggctgactgctccacagtgctgttggatctgtggtggaggcattcaccctctcctctgcctcatgagacatctggaaatacttggtaatgctatccaaggcaccccgaatatctgtgttttttgtacattccagtttgttcagcaagttctttcacagtgtttgtctaggctttcggcttctttctgtagagaatcctgttctttggcttgtcttttgctttgggaagttgtgtcagataatttcacttctacttgagccatcatttttgtaacatctttaatcagtttctcttgttcctcaaagagattcccaatgtttttcagtgggtctgctgcggggttctgcgccaggatgtcttttatctcgctgactatcctctcaactgagtccagagtctcatgggaaggccggtcacacattgatcttcaggcttgggttctccaggatctgtgttcctgagggcaaccggatgtcacatccagaggaaagctgtggatgtgtgagcaggcagcc

SEQ ID NO: 611400 - DNA, 147 bp, Homo sapiens
aggatccccctcggaaatcgggtgctgggggctcagtgtgccacttccctgctccaagttctggaggcgaggaggcaatggaccctgttgaggcagggcagtgcccagctccatgtaagtccatctgtctgggtccctgagacccaa

SEQ ID NO: 611401 - DNA, 314 bp, Homo sapiens
agatacgtgtcatttacgagatgtggaagatacatcctataagataaacatataaactgtaaataatcgaaagaaggctatttacataggggttttttatgcttaaggttgataggtctcttaaaattgctacatgtgttacataatttcaacttcatattttggcttattttttacaagcatgaacaactatagaactcttcagaaacgtatctacttgtgagaaaaagaataccttagaattttcaacacgatgcggtattctacataacaaaatacacacatgctaacttttactctgacaaaatacatgt

SEQ ID NO: 611402 - DNA, 185 bp, Homo sapiens
  misc_feature (25)..(25): n is a, c, g, or t
  misc_feature (34)..(34): n is a, c, g, or t
  misc_feature (48)..(48): n is a, c, g, or t
tgctgggattacaggcgtgagccantgtgctcgncctcctttcccttntagatccctgcattccaggtgtcacggatgggaaagtagatctttggaggggctgggagctggggtatctgcaggcctgtctgctgacacacgtactgactgaactggtacatggcgggggggacaacatggcgaaa

SEQ ID NO: 611403 - DNA, 540 bp, Homo sapiens
  misc_feature (84)..(84): n is a, c, g, or t
  misc_feature (248)..(248): n is a, c, g, or t
  misc_feature (286)..(286): n is a, c, g, or t
  misc_feature (300)..(300): n is a, c, g, or t
  misc_feature (373)..(373): n is a, c, g, or t
  misc_feature (410)..(410): n is a, c, g, or t
  misc_feature (505)..(505): n is a, c, g, or t
  misc_feature (534)..(534): n is a, c, g, or t
ggaggagtgactgagccccgggctgtgcagtccgacgccgactgaggcacgagcgggtgacgctgggcctgcagcgcggacagnaaagcagaacccgcagagtcctccctgctgctgtgtggacgacacgtggggcacaggcagaagtgggccctgtgaccagctgcactggtttcgtggaaggaagctccaggactggcgggatgggctcagcctgttatcaaagtcaccaaatatttctcttctcnttcaattgatcttcttatctgggcgcatgatcctgggntcgggtgtggatcnggccgacaagagcatttcatctctgtcctgcctcctccagtcgttaggatgggggctatgtcttcatggcgtnggggcatcatatgctcatggcttcctggctgcatcgngccgtcaacgaagtccgtgctgctgggctgtatttgctttccgctcctgatctcatgccagtgacggcggggcctcttctattctggcaactgancagtggtggacgtgacgagtcattgaganacgctc

SEQ ID NO: 611404 - DNA, 475 bp, Homo sapiens
  misc_feature (84)..(84): n is a, c, g, or t
  misc_feature (248)..(248): n is a, c, g, or t
  misc_feature (292)..(292): n is a, c, g, or t
  misc_feature (300)..(300): n is a, c, g, or t
  misc_feature (338)..(338): n is a, c, g, or t
  misc_feature (344)..(344): n is a, c, g, or t
  misc_feature (354)..(354): n is a, c, g, or t
  misc_feature (363)..(363): n is a, c, g, or t
  misc_feature (366)..(366): n is a, c, g, or t
  misc_feature (378)..(378): n is a, c, g, or t
  misc_feature (403)..(403): n is a, c, g, or t
  misc_feature (424)..(424): n is a, c, g, or t
ggaggagtgactgagccccgggctgtgcagtccgacgccgactgaggcacgagcgggtgacgctgggcctgcagcgcggacagnaaagcagaacccgcagagtcctccctgctgctgtgtggacgacacgtggggcacaggcagaagtgggccctgtgaccagctgcactggtttcgtggaaggaagctccaggactggcgggatgggctcagcctgttatcaaagtcaccaaatatttctcttctcnttcaattgatcttcttgtaatatgtcccatgccgtcctgaccanctccggantctccttccagggcatcccagcctgagcctttccaganccgacnggccggggantgagggganttngttggtagggantgaagacgaactatctccaaggaanctaattgggtggtgaggagantccctgccatcccagtggtcctttgacaagcactggttctgcggccttccc

SEQ ID NO: 611405 - DNA, 400 bp, Homo sapiens
atggcatgctgcacccctgatgtaccatggtaaatgcctatcactggggtcggcgcccctactcctgtgtggatgccacctagcatgtatctggctccccacacattgcacggcaggagcggctggccagcactcgggactgggcacttgcggaccagaagacaagaaaatgatttgaggacagcttcaatcgcggtgtgaagaagaaagcaacaaaatgaccccttgaaaccattgcggtgggaaaacatctaaagaaaggggtccatgtggtacatcgtcatagctgggaacagtctaagacccaacagccaagtgatttttccattgctgcgaaagctggccaaagttacattcggtgtggcccattaggtcttccggaagttactttgttgcggta

SEQ ID NO: 611406 - DNA, 250 bp, Homo sapiens
aatcgagctcgcaccgcttcgtgagatccatgttcctttactcagtgttctgctgcttcttcagtgaccagagctgctgtcctcctcatgtgacaagtcctggggaagggcctgcaaagcactgtccccagagatcccaggcagagagtagatgacgctgtggcagtggtcaagggtgtggaatctggagtcagtctgctggcctgacgctccctggctgtgtaactttgggccggtgacttaatctctc

SEQ ID NO: 611407 - DNA, 1011 bp, Homo sapiens
cccacgcgtccgaaaacagaaaaaaagagagaaaaatataactgagaaaagagatgtttcttcttattcaaattctacgatttttggttcgatttttggtttaacaattttattttttacgttaaaaacttaatgctacatagtatacgaaaaaaaaaaaaaaaaaaaaaaaaaaaaaaaaaaaacaacaaaaaaaagaagaaacaacacaaaaaaaaaaaaacaaaaagaagaagaagagagaggggcggcgcgcgcgcgcgcagaatatatctatcttcctccggcagggcgacccccaacaccacaccccccaccctcattttatttacaaaggcgagggcgtagcccatattcacggcgtggtctgcttttattattataaccaagaggcggaggggcgcccctcgtgtaataaaaaaagacaacacagccgataggggagggagacaaacacgcaggaacgaagacgagaaatgttgtacgaggcagacgagacacccacacgaggagagggagggagaaaggagaaaacagcgggagaggaacaacacaaaacacgaacgaagaataaaaaaaaaaaaagaaacgagacgcgaacaacaaaaaaaacaaaaactaagcacagggagacacaaaaggagggcgccacacacaacaaaacagagccaaaaaagacgggcggcgggagaacaagaaagactgaaggggcggagaacgaagacaaaaccgacctaggaagaaaaaaaaaatatataccacccggggacaaaagaagaaaaacaacacaaaacacaaaaagaaagaagaaaagaaacactcagcaacacaaggaccacaaccccaacaaccagacacacaggagcaaaggaagtggggaaagtggaaggcgagcaagcgagggcggcaagaaaagccggcgggcgcggagggggaggggagcaggggcaacaggagagaaaaaaaagaagaagaccgccacaaccccggaaaacacagcaaaacacaaac

SEQ ID NO: 611408 - DNA, 782 bp, Homo sapiens
cccccctacggtggtaaagttttagtccctgggagtgccgctgttttaaattagtgggtccccggggctggggaatagccagacaaagaagcctggtttttctggtttcttggaagggtaccccccatttccacggagtattataacggattttctgtcgtgttccttatcccaatcaaggccattatgtcatccttgtacaaaggtatgtcacaggttcttttttgttacatcaggctcactgggaggctctgttcttgtaccattactacaatcaacttgtaaagccccaagatagaacgttctgggtgtgtattctcagcacccccatgttagtcgcatctcatacatgttaccggtggaaagtcaggtttcctccctagagagaagggtgaccaaggctcgctttacgcggccagtcatatcaactgtgatgaatactgattctctggccacactcaatggctagcgtatgtcatcaccgcattgcgggaggatcaagcatgtgcactgcttcagccctggcgtcccaggtcagcctggccagcacaggtaggcttcgtctcgacaacatacgttttatctctaagccgaacatggtggcacttggctatggtttgtgctacgcacggctagtatcggcgattcatctgagctcagagtgttgagtgcacagtgccccgttcttgcccatttattctagagtggggaccacagtgtgccctgctgtctaaaaaaagaaaggtgtatctttcctgctggatattgtaacgagcttcggc

SEQ ID NO: 611409 - DNA, 337 bp, Homo sapiens
gcggccgcctactactactaaattcgcggccggtcgacgcaatcagtgttgcagtgttaagattttgaagcctggcacaatggctcacacctgtaatcccagcatttttggaggctgaggcgggaggctcacttgagcccaggagttcaaactagacttgacaacatcgggagaccccatctctagaaacaattaaaaaaagaaaatagctaggtgtggtggcacatgcctaggaggctgaggtgggagggttgcttgagcccagaaggtcagggccacagtgagccatgattgtgcactgcattccagcccgggtgacagagcgagaccctgtctc

SEQ ID NO: 611410 - DNA, 319 bp, Homo sapiens
tcttaatctattataacagtaatttctatctccatattcaaattactcatatttctgtcatctccaatctaagatatttatatagattgtctccctcttctttgattcagcagccatttacagacactataaccttaacctaattctggtttttgacacttataagacagaatttaagaaatgcaagcatgttcttttctttgtcatcactgaccattttttcagttacctcatcctctatcatgatggttctttcactactgcagttctcctgtatatcaaccatcattctggtttccaggtaaatggacgaaggaga

SEQ ID NO: 611411 - DNA, 215 bp, Homo sapiens
cctgacaggatctggaagaggagctggtggctgccaacctgggcgcccggcacaggcctggcgtttcccccttcccatcaagccagggctcctcctcctgtcgtgggctcattgtgaccactggcctctctacagcacggcctgtcggtgtttcaaggcagaaccacgacccttgactcccgggtgggaggttgccaaggatgctggagctgaat

SEQ ID NO: 611412 - DNA, 347 bp, Homo sapiens
attagaggatcccgtgcgctatactactgccgagggcctgcacggctgctggacagccccaccttccacctcaccctgcactatcccacggagcacgtgcagttctggtgtgggcagccctgtccaccccatgcaggctgggtacgctgatgggtgacacttgtccatgctgctctgcctgggggtgacggcagccccagcccgtgagtatacgcttttcctgccttcagtgatgagcatggaggaagtgctgaattgtgaatctctgaggggaacttgaccctggatgggagtgaccctggggccagagctgggaccctatggcttgcagatgtggagtgattacg

SEQ ID NO: 611413 - DNA, 235 bp, Homo sapiens
tattcctagcctgccagtgggggaggtggtgaggggagggtcgggcgggcaagcccctacccgctgcgcggtgctgtcctgcaagcgtctggtgcgtgggtttggggggtcagggtggtggtcgagtctcctgtggtccgtaagcgtggggactgtggctactttcttcctgtgtgagcatggtttgggcacttggcgcaggcttaggacgtggtaccggagcttcgaattcgta

SEQ ID NO: 611414 - DNA, 930 bp, Homo sapiens
atgtggcacaaggtgccctattgactttgtctgtgtcaaacacccctcgtcgtgtctctcctagaccactctgcccgttgtttaagccccctgggtcccacacaagcgctatgtgccacgtgccttttcagcccgaggcccgcgttcgacgggagccgctgcccccatcttcgggggaatatttggggtgaccgcgcttctctgatggccgcggttcccccatgtcctgctcaggagcagggccctcttcgttcccagcaatcatggtctggcccccgccggggcgtttctctcgtcgcgcccgcccaagggcatttcaatttttgggcgcccaagacacaccaccacagttagtttcatgataccccccggccccacttccactacggttccttgggccccacacccccacccgttctctgtaagcacaatataggcatccttaataattgttgttcttatggagacggggttgtaaaccaccacaacatattatcgtccttttcgagacaaaatgtctatatatacctctccccctctttagccacccctggttggtaattaaaacccccatgtatcctctcgcactgttggttatacaaacagtatcttttttgtgcgaccccagtatttaactacaacggaactttaatttcccccgtctccgctggatgtatttccctgcatcacccactgcctcctgttgaccaattacctctgtgtgattaccctactgagtcccacgttgaatccccacaccaattaataggatgtacgcctcacctgaatccccacacctatattagtgtaaccagaccgcggctttaatattatctgagggccccctgagtgctttccgtctaacaataaaaaaattcccaggcccccccgaacccaaaaaaacccttgtggcattcccccacaaaaaca

SEQ ID NO: 611415 - DNA, 748 bp, Homo sapiens
  misc_feature (18)..(18): n is a, c, g, or t
  misc_feature (74)..(74): n is a, c, g, or t
gcctgagccagaggaagngaggaaaacaatagcaaaaaccaggacccttcggacttgccgctgaatggggattntcgtcgcgatgttgagtttacctggaatgccccggtgtattttgggaaggcagacatcccacggaaacaatgaagtggaaaagaaaacagctaaagcaaaatctagagcccagtttttgccaaaccagccccacgtgggctgggcaggctctggaagcccaagtcaggccgatgaagagcggctgaggccgtggggatctggtttaccaggagggcacatggaggatgcaagaaaaggaagagccgtattcaagtccccacttcagtgatgaggcagaaagaccctgcgcctgaccacgtgggaacagcctgcagtgagcggtgacgccgcctggcttgagctaagtgctgggctccaccattcattggctgagtgaccttagatgagaagagaatgagccatgtgtttcctgaaatcatccagtggcctcaccggagaatctgcaagagccggtaaacccagaagcttggccgtccattcctggaagcagacattgtgtcttcgtccagcaagcccctggctctcaagactcactgtggtggcaagaacatggcaccttgaccctacacagttcttccatcttttcagaagcacggtgagcacagattgctgggattacagacgtgtgccaccatgctcagcccacactcgtctttaagaaaattaacataga

SEQ ID NO: 611416 - DNA, 515 bp, Homo sapiens
  misc_feature (154)..(154): n is a, c, g, or t
  misc_feature (216)..(216): n is a, c, g, or t
  misc_feature (226)..(226): n is a, c, g, or t
  misc_feature (281)..(281): n is a, c, g, or t
  misc_feature (329)..(329): n is a, c, g, or t
  misc_feature (338)..(338): n is a, c, g, or t
  misc_feature (343)..(343): n is a, c, g, or t
  misc_feature (350)..(350): n is a, c, g, or t
  misc_feature (373)..(373): n is a, c, g, or t
  misc_feature (427)..(427): n is a, c, g, or t
  misc_feature (443)..(443): n is a, c, g, or t
  misc_feature (464)..(464): n is a, c, g, or t
  misc_feature (477)..(477): n is a, c, g, or t
tgctgcgggtcgctctacaggatctatgcgagatgctactgaaattactgatatgccgatctatgggcaggtcagtttgctacaatagagactaattatcacatgctatacggtccatgtcaaggtgctaaaagcacctagttccccaagtatngtttagttccctctcccccacaccactgatgtgttccatgttatcttcagttacaatgcaantaaaggaaancacacaactgagtcagatataccaaagaatcaagtttgcactttttatctgaganctgcaacagcactgaattctgcctgacaaattacagctctaaccccanacccacacngtttngatgtangctagctttaccatacaagtgtnaggtgctgcactgtaatttcattgtcagaaatgtgatgccagaatgcccacggnataaaagtacatacangtcaccaagttagattatatngcttgttacctanctgtatgcatctcggaacggtaccgcgctcgcattcgt

SEQ ID NO: 611417 - DNA, 174 bp, Homo sapiens
tagtgactcagaatcaacggaaacagaacccagttggttctggcagagcctggagttcctacaaagaagactcggttagatcaaccaaattttaatagaacaaacagcccaggactttcagcaagaaggttcgattacggaaaatgaaaataccagagcttgaactatagaaaa

SEQ ID NO: 611418 - DNA, 220 bp, Homo sapiens
acacctggtaataatgtgtgtctatatataaatatgatgtatatatattatattatgtatagattttgtgtacatattaatatatatatatacatatttatgtatatatatatttatatattatgtgtatatatatttatgaatatttatgtatattatgtatatatgtatatatatttatattcttccatctatattcacttaagtgggtagtcacaga

SEQ ID NO: 611419 - DNA, 848 bp, Homo sapiens
ccgagctcatcatctacgacgcccatacacagcgtacggtgattgtttgtgctcccgcaacatgacaagctggactttcctgcctcttggaagacagaggaggaaatggcagcaggagccgcagctctgcgggtctactttcagcgacacagatcctgaattccagcaaaagagctatcgccaaccagtttgaagaccgccccaccgcctgtccccaagaggaactgagtcagccatgtaaatgcagtttcttgatatcaccgtcctgtatcgttcaaccagtgagcccccacctcggccactccgacgcccttgaactacctaggacctaagcggctcatactggcggattgtgaggatgccccccgccagctcatctagtagacgcaggatccacactagattaattgctggacaaagagcgggcgcgccatgcatctgttgggccaggggggggcagcgcataacgatcgctaccacctcacctgaggacatatcctccatctgtcattacgtggcccattgagtactgctctttctgctagaggggagcggacctactcttactcaagcgcgtcaataccggttgtcccacatgtgtgcgtacctgcggtcagtacagaatctgccacgttggagcgccataatgcacccgaagccaactctatagatcgtccgctcgcgtatatagaacatgaccccatcgtcaccgccccccgacccatttagaacagatgcctacggtctatcttagagtgtagaatgacgcccgtgtctgtgagcaccgctccaggataatctatcgtctgtgacggtcaagtcggattggaggttggcgtagcgaccac

SEQ ID NO: 611420 - DNA, 347 bp, Homo sapiens
caccactcctatagatcagtggatcctcaaactgattatttaagatcaataaaatggccaagcatggtggctgtaatcccagcactttggtggacaaggcaggaggatcatttgagcccaggagtttgagccagcctgggcaacatagcgagaccctatctctacaaaaaaattaaaatgctcacacacacctgtagtctcagctacttgagagattgaggtggaaggatcgcttgagcccagaaagttgaggttgcagtaagccatgatcatgccactgcactccagcctgggcaacagagtgagaccctgtctcaaaaagaaaaaactgatctataggagtggtg

SEQ ID NO: 611421 - DNA, 204 bp, Homo sapiens
ctgggtgcatgcatgtgggagagacagagtaaccgaacggtgcgcgtgaccaggaattcctggagtacacgtcaacggggatgtgaaacaggggcccatttccgataactacctgttcacaccgtggcaaggccgctggtgccttgcgtgggaaagctgtggaacatggacgattgtgcgcgggacacgcttgtgcactgcaga

SEQ ID NO: 611422 - DNA, 234 bp, Homo sapiens
agtggggtttttctatgttggccaggctggtcttgaactcctggcctcaagttatctgccctcctctgcctcccaaagtggattacaggtatgcaccaccatacctggcctttagtgaacatcgttatgcatatagctctcttctgctacagctttccttcagataaattctcagtaatgtagtgagcaggagtccaaggatttggtgactatagggatggccaggcctcgttg

SEQ ID NO: 611423 - DNA, 473 bp, Homo sapiens
tctggctctcctgctctaagagaagctgtgtgatgtgcatctgagcagagtagccctataaatatatgattagtagtcacagccagggcctgggttcctgggtcattggaagcttaaacctcataagttacaagtcttgactcctagcagcagagattagaaggggctaacctgctttaagtcagatagggactctccttgtcatgctgtccctgtggataacaaacagggattgaccatcttgctgttgtacaggaagttgttagtggtgtgttatcccattgatgctgggacagctgttctcttatagtgataagttgagtctgttgtcctcttaaacatgaaacatacacttcttaagctgaaccacgtaaacttgaattctgtgcactgggagaaaagtgtcctgtgtttcaagataaaactgttctaaaggcttccagggtattgatggaattttttaaaataatgca

SEQ ID NO: 611424 - DNA, 176 bp, Homo sapiens
gagaccggttgccgccatgatagaacagcagaagcgtaagggcccagagttgccgctggccccagccaagcggcagcgacacgtgaaagctggggggagcggcgcctggcccaggagccgggcagcagcaggcgacgccgggagcctagctgcaagcggcacctccaagatgcccc

SEQ ID NO: 611425 - DNA, 701 bp, Homo sapiens
  misc_feature (6)..(6): n is a, c, g, or t
  misc_feature (17)..(17): n is a, c, g, or t
  misc_feature (45)..(45): n is a, c, g, or t
  misc_feature (52)..(52): n is a, c, g, or t
  misc_feature (60)..(60): n is a, c, g, or t
  misc_feature (98)..(98): n is a, c, g, or t
  misc_feature (139)..(139): n is a, c, g, or t
  misc_feature (165)..(166): n is a, c, g, or t
  misc_feature (232)..(232): n is a, c, g, or t
  misc_feature (236)..(236): n is a, c, g, or t
  misc_feature (243)..(244): n is a, c, g, or t
  misc_feature (246)..(246): n is a, c, g, or t
  misc_feature (254)..(255): n is a, c, g, or t
  misc_feature (272)..(272): n is a, c, g, or t
  misc_feature (275)..(275): n is a, c, g, or t
  misc_feature (297)..(297): n is a, c, g, or t
  misc_feature (507)..(507): n is a, c, g, or t
tggaancccctgcaagntttgaagttgccaccctttttggtgggnatctttnttcccccncccccaagttttgcatttttcggccatttaaaattttnccttttttaattaaaaagtttttaaaattgggggaattttnaaaaaaaaacctattttccagccttnnttttttccttggagatgccatgaaaacttttccccacatacatgcttaggaaaaacagttcagaanacanagggganngnctcttccnnaaggagcagctgtctantcngcggcctgttccaagggccacngtgggaggaagcctgggctgcagcgttccgaggcagcagcagcagaggggaaggaaggaagcaggccttgccttgtgtggcattccagttccctctcccagcaggggccagattccccttccttagcttcaactacaatttggcgaaagcaattctagggtaatcgggggcagtgaggggtggggggcggtgagaggtttacttccctcngcttagataacagaggtagaagaaaccctttctgtcaattgcttggcctctaaatgccacaggcaggctacttttcatggctgttcgaagcatccaagcaatccaaagtggctttgaacaacagagtaaggccaagaagggcaaaaagggaccagaactggcccaaacacctcagctctgctcgtgccgaattc

SEQ ID NO: 611426 - DNA, 983 bp, Homo sapiens
agcggcagtgagccaagatcatgccattgcactccagcctgggcagcaaaacaagactctctctctctcaaaaaaaaaaaaaaaaaaaaaaaagatttaattttaaaccccaaaaccattaaaagttcctaaaaaagaaaaccctagcccaatcccatttcgagggacatagggcattggggcacaagatttcattgatggaaagattggccaaaagcaggtggcaacatcttgcaaaatttggccaaaggggggatctagtttaacactaaaaggagcttccggcacagcgaaagaggaaaagctatctcaatcagtccagagcagggcacccttagaaagaaccggggacgaaccctttgtttggcaatgtctatagccctttctttgcccaacaggtgtcttaatgtattcccagagacatttgtaccaacgggaaccttctaagaagtaatattttacttaaaacaacagacccaaaacggcccacatgtccaagaaacgtggtggacccaaacggggattttttgacaccagggaaacatcttttctttccaaaaaagtgacccggacccagtttatattagcggggccacaacaaagccgttttgaaaaacaagaaggcttcagcactaggtcacctgtgatctctattatagagacggaaaaagttggcagatactttcaagaaagcccacaaggggaggcgcccgtggttgccgcgtgtgggctccccacagacgctgtgtatatagccccccacggcaaacttctgtgaagaaagggcccaaagtgggcagacggtgaaatctcccccgtttgaaggggctcacgggcagtttttggcaagaaacaatagcctgtgggccacaatacagtgggacaaaaacaccccccagcatctgttctcagcttcacaaaaatgtacacagtaggtgaaacgaacaacactattttctagtcacgaaggttttttggtttaa

SEQ ID NO: 611427 - DNA, 430 bp, Homo sapiens
ctttccatatgacaggattgtgaaaaggaggatgtccaaagaaggtgttgaagaggccagagtcagatggaagccgtgttctggatgtgggatgaaatggaaagactcctgggaaccattaaatcacttttttgtaaaatacagtgggttaaaaaaaggaatgcttttaaaaaaagttgttctaccgctgttgtagctattttcggtgcaggtcttgtttttgtttgttgttttaaatctactttaactcagcacatgtttaaacccacattttgaaattgtattttgttttatttttattttttgaattgtattataatacatttttctgttaagctagagtaaagccttccacgcacaaagataaccacttacagtattttcatttatgtcatatttgcagccagtaaagacactaaatccctcgcca

SEQ ID NO: 611428 - DNA, 315 bp, Homo sapiens
  misc_feature (189)..(189): n is a, c, g, or t
  misc_feature (252)..(252): n is a, c, g, or t
gatcctgaccactgttcgtccggctcaatcaaatcctaagcaaggcctccaggttcctggaagtgctgctgcagcacggggttctcaaagctgtcacttctgtatgtgaagcgaagcttctcaacgatagccttcatcttggccacctgctctggagttgcatgatttttcagtaaagggcatcttccnttttatcatacacgcaaagggtaaaaaagacccagctgggaaagcctaggaggagtcacctgnaatgttcttggtcatcccaactcccttcttcgcttgtgggccacccaaaaagccaccaaaaaa

SEQ ID NO: 611429 - DNA, 852 bp, Homo sapiens
catctacagttcttttcaaatctctttgcaagcgatgtcctctctacaagaatattgtgctctctggggtcgaccatgttcattgtcactttagtgtgatccgtcgacttgggaacagtgatgaatttgaaggagagagaactgtagagtagtacctggtgtgaacatttatcgttgtagagaatagtgggatgtgggtggaacgattgaagccagattaagaccaatattgggtgatacagaggtcatgttagagcactcgaggaatgcggggcgaatagtgcagctattgcgctttgggggaggtttagatccattggcctggggttttcccttgggatgccgtggaagtgtgctgaatccaatagggtaattgatcgaaggaaactccatacacatagggagtgtcacttgaacagggaaactacttctgggggaacccatgtgagtacacaattatttggttgcgaattttcaatcaagagttcgcaagtggtggcttctccggggggagagttccgattgattgcggatcaaaaaaaacttcgggggggatattccaagtttgggatataactacggggcgcaggctataccgtgccgaaacggggctgggaaggcgcagatggcacgaccgttaccacgtcggaataatctccgtggcaggtaccatagccccttgggtgttgtttgtgggctgacttggagcaacttggggcgcacatggggaccgttgagatgaaagtcagttatctagaaggcaacacctggtggtgcccccctgttggacacagcgttaggattacggacgtaggtcccatctatacgccaggtggcacctcttaattcccc

SEQ ID NO: 611430 - DNA, 682 bp, Homo sapiens
agcgggtggccccggagccgccggcgccgcgcggggaatagctgtgcagcacgccgagcccggactcgtgctggctcggctcggcgcgggcgggcgagaggatgctggctgggcttcccctgggctcggcccgcgctcccgcctggggagggccccgcgcgctgcccctagcagccgccgccgcctgcgggtgcaggggaggggtccggagagcctgcgctcgcctgccgcccgcgcctgccggcccccgcacggccctgcccctgatgcctcagccccagggcgggcgcgctgggcctggtgcccactggatctcccagccctcgtcgccagcctcctccttccccctgtcggccgggcgcccggcggatgctgaggggcaagccctgcgcctcatcccggtacggatccccgggcctgaccggcggggaagatacggagctaccggcccggagcccacagaggcagctgcacaggaggcaggccgcaggcaaccttgcagcggggaagcaagaccccttcagagggcgacgacacgaaagcgtactcccaccgcccccgaggcacccgcagccggggggacacgagacccagggaaggcaccggcagcgagggccggagagatccccaggaacaagggtctcacgcttgatcacgtgcttaccaggtggtactggaaaag

SEQ ID NO: 611431 - DNA, 684 bp, Homo sapiens
  misc_feature (4)..(4): n is a, c, g, or t
  misc_feature (22)..(22): n is a, c, g, or t
  misc_feature (27)..(27): n is a, c, g, or t
  misc_feature (225)..(225): n is a, c, g, or t
  misc_feature (410)..(410): n is a, c, g, or t
  misc_feature (414)..(414): n is a, c, g, or t
  misc_feature (420)..(421): n is a, c, g, or t
  misc_feature (442)..(442): n is a, c, g, or t
  misc_feature (469)..(469): n is a, c, g, or t
  misc_feature (531)..(532): n is a, c, g, or t
  misc_feature (556)..(557): n is a, c, g, or t
  misc_feature (560)..(560): n is a, c, g, or t
  misc_feature (589)..(589): n is a, c, g, or t
  misc_feature (666)..(666): n is a, c, g, or t
attngtgccgttgccaggttgnagtgnaatggcgagatctcagctcaccacaacctctgcctccctggttcaagcgttctcccgcctcagcctcccgtgtagctgggactacaggcatgcatcaccatgcccggccaattctgtatttttagtagagacggggtttctccgcgttggtcaggctggtctcgaactcccgaactcaggtgatccgcccgcctcggnctcccaaagtgctgggattacaggcgtgagccaccgcacccggccctaaattgtctttatactatcattacactgtatgattatgtaaatgttaacaagactagactgaaactgaaatgtagaaaaactaaaggcattaatcaagttatgggtgagaagctagcttgaatttgtttgcctatttngggnttcttnnaatattactgctgtatgtctngtgcgtgtaatagaagaatttttccangtcagtggagttaggaaaatttcccaccaacaagttgggtatgggacattggaagggagtcnnggttcagctaaatatttggctganntgnggggatccatggaccattgagagtggggngacctagataatccttcactctgatacaaaaggggattgcccttacccagagattggatacatctgccaagaactgntctttgcaggagaaatca

SEQ ID NO: 611432 - DNA, 467 bp, Homo sapiens
acccgtagcactgcctgcattatacaacctccttaccttatgaaacaaggctcactctgactctgctggcctggcctatctcaaaggcagtatttgtggttacaaaaaccactggattaggacacattacactagatcctgttccctgctctgctgatactattacagctatccacccgagaaaagtcacgtgctaggaccatctcggtcacggagaccttaacacagcagcactcagaggaattacagcacacacacagaaatatagtgtggagtgggaaatcaggggtctcacggccttcagagctcgagagcctcaaacagactattcacccactatatttactgacagcaagccagtgataagcattctttctatagataatagattaactaaaagtattccttacgggaaacaaagggatggtgccgaaataaagggatgggtctggctagttatcagcagc

SEQ ID NO: 611433 - DNA, 275 bp, Homo sapiens
tgtttaattaaaagtttatttttcccctttaaatctttgaaggaaagaaggtttttttgcttttttgtttgcttctgtcagaatagctcatggtgaactttgcaattacagatgatagtgacaaaaaaccccagcgtcgcaatcgtagccggaggcgtcgcttcaggggtcacgccgaaaataacacagccaggttacttgagtggacctgctgacaccatcatgtcacaagcatgaaaaaaatgcctatgtctgctttctcaatatattatact

SEQ ID NO: 611434 - DNA, 188 bp, Homo sapiens
tgcagagctcggtacccgtatcattttcttcttcctgtaggtggttcggcgggtcaacttgcacagacgagaggagctgatctcaattgcaggggcggtgcatgatggacactctctttgggagaactcagagctgcaccactagccagcaccactggtttgtaacagagattggactggcaaaagcg

SEQ ID NO: 611435 - DNA, 1013 bp, Homo sapiens
  misc_feature (6)..(6): n is a, c, g, or t
  misc_feature (61)..(62): n is a, c, g, or t
  misc_feature (66)..(66): n is a, c, g, or t
  misc_feature (69)..(70): n is a, c, g, or t
  misc_feature (74)..(74): n is a, c, g, or t
  misc_feature (93)..(93): n is a, c, g, or t
  misc_feature (99)..(99): n is a, c, g, or t
  misc_feature (106)..(106): n is a, c, g, or t
  misc_feature (117)..(117): n is a, c, g, or t
  misc_feature (123)..(123): n is a, c, g, or t
  misc_feature (129)..(129): n is a, c, g, or t
  misc_feature (139)..(139): n is a, c, g, or t
  misc_feature (144)..(145): n is a, c, g, or t
  misc_feature (147)..(147): n is a, c, g, or t
  misc_feature (153)..(153): n is a, c, g, or t
  misc_feature (168)..(168): n is a, c, g, or t
  misc_feature (174)..(174): n is a, c, g, or t
  misc_feature (178)..(178): n is a, c, g, or t
  misc_feature (186)..(186): n is a, c, g, or t
  misc_feature (196)..(197): n is a, c, g, or t
  misc_feature (199)..(199): n is a, c, g, or t
  misc_feature (204)..(204): n is a, c, g, or t
  misc_feature (215)..(215): n is a, c, g, or t
  misc_feature (219)..(219): n is a, c, g, or t
  misc_feature (223)..(223): n is a, c, g, or t
  misc_feature (230)..(232): n is a, c, g, or t
  misc_feature (235)..(236): n is a, c, g, or t
  misc_feature (245)..(245): n is a, c, g, or t
  misc_feature (247)..(247): n is a, c, g, or t
  misc_feature (252)..(252): n is a, c, g, or t
  misc_feature (263)..(263): n is a, c, g, or t
  misc_feature (265)..(265): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (284)..(284): n is a, c, g, or t
  misc_feature (286)..(288): n is a, c, g, or t
  misc_feature (293)..(293): n is a, c, g, or t
  misc_feature (299)..(300): n is a, c, g, or t
  misc_feature (306)..(306): n is a, c, g, or t
  misc_feature (311)..(311): n is a, c, g, or t
  misc_feature (313)..(313): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (340)..(340): n is a, c, g, or t
  misc_feature (357)..(358): n is a, c, g, or t
  misc_feature (370)..(370): n is a, c, g, or t
  misc_feature (377)..(377): n is a, c, g, or t
  misc_feature (394)..(394): n is a, c, g, or t
  misc_feature (397)..(397): n is a, c, g, or t
  misc_feature (403)..(403): n is a, c, g, or t
  misc_feature (405)..(405): n is a, c, g, or t
  misc_feature (411)..(411): n is a, c, g, or t
  misc_feature (414)..(414): n is a, c, g, or t
  misc_feature (417)..(418): n is a, c, g, or t
  misc_feature (423)..(425): n is a, c, g, or t
  misc_feature (433)..(433): n is a, c, g, or t
  misc_feature (453)..(453): n is a, c, g, or t
  misc_feature (468)..(468): n is a, c, g, or t
  misc_feature (947)..(947): n is a, c, g, or t
  misc_feature (994)..(994): n is a, c, g, or t
ccacangcctttggcacaatgaagtgggtaacctttaatacccttctttttctctttaacnnggcntannccangggtgtgtttcgtcgaaangcacanaaaaatnaagttgctcancggttnaaaaanttgggaaaanaaaanntnaaaacnttggtgttgattgcntttgcncagnatcttcancagtgtccanntnaagancatgtaaaaanagtnaatnaagaaannnaanntgcaaaaanangtgtngctgatgagtnanctgaaaanagtnanaaaanannncaaancctttnnggaganaaaanangcacaatngcaacnctncgtgaaaccnatggtgaaaaggctganngctgtgcaaaanaaaaacntgaaaaaaaaaaatgcntcntgcaananaaaaanaanaanncaaannncccccgantggtgagaccagaggttgangtgatgtgcactgcntttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaactctgttggaaaantccactgcattgccgagtggaaaatgatgagatgctgctgacttgcntcattagctgtgatttggt

SEQ ID NO: 611436 - DNA, 540 bp, Homo sapiens
agaaaaaaccctctttgttgtcacccagtcttaaagcgcgtgggcatgatcaaagctcttggaaccctcggccttcggggttcaacatttctcgtgccaaaccctccaagtacctggaaatcagggtgtgcccccccatgcccagtaattttggatttttaggaaagcccaaagtttcaccatgtaacccagcttgttcttaatctcttgccctcagccagtccactcgcttaagcttccaaaagtgctgggattccaggtgtaagccaccaggcccggcttgaccatcttttttgatcttcaaaccagttaagggaaagagaggcctgattagcaccccaagtccaagctaccagagaagaggagcttggccagttactcacagatagaggagcaccaggctgacagccaggagaagccaggtttccatggccaagtctgggatgagagccatcactactttccttacttatctctctcctctgagtcttcctttcagctctgtgttgctctttgctgggctatgtgcatggagctttc

SEQ ID NO: 611437 - DNA, 726 bp, Homo sapiens
gtccccctgttaatcgagccgttcaactgcctcatagggtgtttgtgggcagcgcccatgcgcttttgtggtccccttcttgcggccgaacacacaaggggaatatcatcatgcacgacccctttgccacagcggcccttttttgctacaacttcgggcactaccttggaaccctggctgatgcactggaagggcgcacagggggccccgctgccccgtatcttcccatgtcaactggttccggcgtgacgaggccgggcccttcctgtggcccaggctttggggagaatgctcgggtgctagactggatctgccgcccggttagagggggaggaccgtgcccgagagaccaccccttgggctggtgcccaaggaaggagcccttggatctcagcggcctcagagctatagacacccctcagctgttctccctcccccaggacttctgggaacccggaggttcgtgaccttcggagctacctgaaccgagccggtcaacccggatctgccccaagaggtgttggctgagcttgaggccctggagagacgtgtgccccaaatgtgacctgaggccctagtctagcacagaggacatagcaccctcatctgggaatagggaaggccccttgcagaaatatgagccatttgatattaactaacatcttccatgtgccatagaccttccccccaagactgtcccataataagagatgcttatctatttta

SEQ ID NO: 611438 - DNA, 183 bp, Homo sapiens
tacagagatgaggtctccctattttgcccaggcgggtcttgaagttctggactcaagcgatccacctgcctcagcctcccaaactgctcgatttataagcttgagccatggtgctcagccctaaatggttatatcttaattttcctttttataggcttttattgattttccaccatagaggat

SEQ ID NO: 611439 - DNA, 385 bp, Homo sapiens
  misc_feature (17)..(17): n is a, c, g, or t
  misc_feature (47)..(47): n is a, c, g, or t
  misc_feature (53)..(53): n is a, c, g, or t
  misc_feature (75)..(75): n is a, c, g, or t
  misc_feature (101)..(101): n is a, c, g, or t
  misc_feature (264)..(264): n is a, c, g, or t
  misc_feature (276)..(276): n is a, c, g, or t
  misc_feature (280)..(280): n is a, c, g, or t
  misc_feature (295)..(295): n is a, c, g, or t
cttcagccgcttaccanccttccttaaggcaaaggtgatccagtganaagcgnacaggcaagaccaagggctacnggcttcgtcagcttcaaggaccccancgactacgtgcgcgccatgcgtgagatgaatgggaagtattgtgtcgcgccccattcaaacttcgcaagagcatgtggaaggaccggaatctgacgtggtccgcaagaagcagaaggaaaagaagaagctgggcctgagatagggtctgtgccaggtacccgntcccacctggcngggngctggctcctccctnagttctctttggaaaacccccagctgtccacccatccccatgccccaaaaccagtttcaataaatttacggttcatttccaaaaaaaaaa

SEQ ID NO: 611440 - DNA, 187 bp, Homo sapiens
ctggacacggtaacgagggctcatcagcttcgaggaggagcgggcccagctgtccttcaacactggacacgctctgctgaccacccagagctgggccagtgaaggacacgctccactagaccacccagaagctgggccagaggactcaacaagttgggacagcaatgtccccctgtgcctagccagg

SEQ ID NO: 611441 - DNA, 317 bp, Homo sapiens
  misc_feature (58)..(58): n is a, c, g, or t
gggggggggctggttaccgttggggcgaagaacaccaccttcatggggacggacctanggtctagtctggaacctctctgctgactcagaagtcagacagggagaattcggctcacgtggtgagtgctggacacccggaactacaggtaccagatgtcacaggcactgacgattggaggggagaaacaggctgtgatacactaacacctaatgttcgactgaaatgaaaagatcacaccaaccttttaactgcttcctgatggttttgcttgctgggagccatctctgttggacaagaaaacataaaacataaaagc

SEQ ID NO: 611442 - DNA, 324 bp, Homo sapiens
acctgccaaagcgtagtacccaagcaaaaaactcaaaaaactaaaaaactctccaaacctccatcttctaactctactacttccacacactgattgaccaaatccaggagtcagcgagtccactgcaaatgggaagccaactaaagtgggagggaaatgatccaggggttctcctgtgcttttgagaatacgacaaaatacagtgtaactcatacatataccttacattttttttctttttctttttttgacgcccaggctggagtgcggtgacgcgatcttgactcactgcaaactccgcctcttgggtactacgctttggca

SEQ ID NO: 611443 - DNA, 147 bp, Homo sapiens
tgcaggtctggacagaggaagtaaaacgtggctttgaaaaatcaacagtaatgtctgaaaaaaatatatattcttttcactgaccgaagtgttttttcaaataaataatcagaaatgttatgctacacaatgctgcatggatcctaa

SEQ ID NO: 611444 - DNA, 256 bp, Homo sapiens
tggccttcttctccttaataaaccgggaaaaacagaagggaaagggggagaaattttaaaaccaattttgattgattgaggggggtgaaaccaaaaatttttgtttttgggattgaaaatttttcctgtgccaaataataatacccgggtttattatggagttagggtttgtgtgaaccattttaaaaccggctttggatatcttccttttgggggatttttaaatataaattttctccttggaaattttcttgga

SEQ ID NO: 611445 - DNA, 858 bp, Homo sapiens
ggaatgtgctgctgccatggtgcctggggcgcagcgaggagctgggatgcgcggtgggagcctgtgccgccctggccctgttacttctgcggtatcattcgcggcggacgcgatgacaggacgctgtacgagctggatctgtgtctcgggctgcggcggattcggttgactagtgtctcaccgtatgcactgtggctgtgccgtctgagctgggcagcgcgcggttgaagaggctgctgggggtgacaggctcttccatgagcatggacctggagtggcttgctgtatgcggacgtggtcgtggcataagtgacaacagccatccttgggtgtaggctatgatgctgggccgggccgtggcctttaacaatgcggatcctgtgcctgttccgcccgcagtctgtgccgcgtgctttcggccatgatccggtggagcaagcagatggctctcggttccaggtgtgggactatgaggagggagaggtgtaggccctgtggaatcgatacttcgagttgctgatcctccagcgaagggtggctggctcccctgacccaccacttgatttaatctcactttcttataattgttctacttcttcaagcaccaacttggttctcaaggtacctcagttacccttttagtttcgttaagaccccccatgggatgcagtaattaaaataagggtaccgaggattaatattcccttaaagaataaaaccatgcagtaagaaataaaacaaatgactagagaaggataaatgacgcagttagtcgtagaaaaaaagcaaaaagaaaaggagaaaaccggtaatgggaccaagaaagggaattgttgagggaaggtaaaacgaggagaa

SEQ ID NO: 611446 - DNA, 377 bp, Homo sapiens
gtcgacgtaaagcccaaggaggttatcccgggatccaaaggtgtcagccgaactcgatgacttgctacattgccacccaacttggaacgtgctcgtgccgtattgccaagggctcagctgtgcgccaaagcaaggcaaggcaaggcaaggcaaggataaacaaggccagctgcacccagctcagtccactcagctccaacgtaccaggccctacaaagcttcaagtgatactctgcacatgaggacagaggactgtgcgaccccaccccgccctgggtaccatctgcatggctggggtctctgtgctattgtcaaataacctgaggcagaagaaaaaagaagaaaagtgacgcggcgggagtttagtctagtagtcg

SEQ ID NO: 611447 - DNA, 340 bp, Homo sapiens
  misc_feature (70)..(70): n is a, c, g, or t
  misc_feature (170)..(170): n is a, c, g, or t
  misc_feature (175)..(175): n is a, c, g, or t
  misc_feature (212)..(212): n is a, c, g, or t
  misc_feature (240)..(240): n is a, c, g, or t
  misc_feature (271)..(271): n is a, c, g, or t
  misc_feature (286)..(286): n is a, c, g, or t
  misc_feature (288)..(288): n is a, c, g, or t
  misc_feature (290)..(290): n is a, c, g, or t
  misc_feature (294)..(294): n is a, c, g, or t
  misc_feature (302)..(302): n is a, c, g, or t
  misc_feature (336)..(336): n is a, c, g, or t
tctgccgccgccggcccccgggagcgcaacactgcaggtggttcaaactttgaaggtttgagaccaaaanggaagggagtgcctatggaccaaagccccaggggccaagataaaccagaaagcctgcaaccaagacagaataaatccaagtccgaaataaccgacatggntcgcncccccaccatcacagtgtcggacaaggctcaaatttnatccatgcagaagtttggactgcgaganacaattgtgaaatcacatctactacagaaanaagaggattacaccnananccanaacttcangttttttgcgggaacatacaatttaaatgggcantccc

SEQ ID NO: 611448 - DNA, 160 bp, Homo sapiens
tgctctagcaggatccttatcccccttcgtcatgtcagacgcagccgggtaacaccagctccgaaatcaccaccaaggacttaaaggagaagaaggaagttgtggaagaggcagaaaatggaagagacgcccttgctaacgggaatgctaatagaggaaa

SEQ ID NO: 611449 - DNA, 355 bp, Homo sapiens
  misc_feature (67)..(67): n is a, c, g, or t
  misc_feature (190)..(190): n is a, c, g, or t
  misc_feature (240)..(240): n is a, c, g, or t
  misc_feature (283)..(283): n is a, c, g, or t
  misc_feature (301)..(301): n is a, c, g, or t
  misc_feature (343)..(343): n is a, c, g, or t
  misc_feature (352)..(352): n is a, c, g, or t
tgactcagccaggcccactttcaccctgaagtcaaactcaccccttcaggaggcttagaaatgatgncttctttcccctgaaaactggtgtcagcttcgcttagctaatggcctgggcaggcaccatttcatctgccctgagagcctgggcttggcttagtgcgtggtgtgagggccccttgtcccatgnccctatggctgtttgcctcttcctagtcccagggactactcttcccttcnctgtggtacagcctctctttcctcctgggaacccccactctgntcctctcttggtacctgncctgctttctcctgtcctctgggcatccccagggagcccccnagccctggnctt

SEQ ID NO: 611450 - DNA, 124 bp, Homo sapiens
gtatcctgctggttcagaggctggtgcgtccaaaccgttccgttatccaggcttatggagcacgctatgttccaagcccatcgcgcgcaccagtggccattgacacctaccaggaggaggagga

SEQ ID NO: 611451 - DNA, 886 bp, Homo sapiens
catccattcccgattccttctggtatcctgctctgtcactttacagtggttcctttcactcgatcccagtacttccatggtgttccgggaccttcattcctcggctttagcttcgtatggcgcatgttgtgtgattgccgcagacatgcttgggatcctacggctcctttggctcgtttccgcaatcatctctcgcattatgcgatgtcaaacaacagtacctatgctgggatgtctctttggcgactatcgctgatgttccagtatctgaagcaagttctcggcccagatggtgattgatgaggagacttctgggagtatggacactagctatagtcctatgatgctacttcattcatggcttgaccatgggccatgtacagccaggcgctcgatagatgaaccctttgtggaacaccatggtcatcggtaggctatgctgatggagagagtcttcctcggttatgttggacattgtcttggtgtagtcctactgtaagccccttcgtgctggccaagtggcttagtcggtgcatacttggctcagcctctgctgcgagaagttctggagaagcagccagtgctaagctcagaaccgaggcccgcgatcttagtagaacgctgcatagcgagtgctgtactaccgagatgcccgttcttatcaaccggtttcacaatcgccactgtcaccgaaaaaggtgttgaaatagagggaccattgtctatcagagaccaatctgggatattgcccacatgatcagtggctttgtaatgagaatacagatgcattatccaagacagctgaagttgccctacgttctcaactttgcacttggctagttcaaattaccgctcttcttatgtaacaatatatctgcgttttttg

SEQ ID NO: 611452 - DNA, 331 bp, Homo sapiens
  misc_feature (153)..(153): n is a, c, g, or t
agcaacttgcaaggggggcctttccccctggtccatttggttttctttccagggtcttgcaaaattcctgacgaaataagcagttttgtgccctcccgtgcaaagccccccccagcccctcaaaaaagacgccccagcccaaaagtgcaaaantgccagtcccggcgggtttttatttttaggggccagaaccaaaccccccctttttacttccaaaactttttttcccatgtgggggggttaatttaggaatgactcgtttaaggcctattttcatgatttttttgtagcatttggggcttgacgtattattgtcctttttttcccaata

SEQ ID NO: 611453 - DNA, 455 bp, Homo sapiens
  misc_feature (151)..(151): n is a, c, g, or t
  misc_feature (201)..(201): n is a, c, g, or t
  misc_feature (361)..(361): n is a, c, g, or t
  misc_feature (453)..(453): n is a, c, g, or t
atgaccccaatacgcaaaattaaccccctaatctaattaaccactcattcatcgacctccccaccccatccaacatctccgcatgatgaaacttcgggctcactcctcggcggcctggcctggatcctccaaatcaccacagggactattnccttagccatggcacttacttcaccaggacggccttcaaccggccttttncatccaattcggcccacattcacttcgagacgttaaatttatgggctggaattcatccggcttacctttcacgccaatgggggccttcaattattctttatctggccttctttcctacacatcgggacggagggcctatatttacgggatcatttctctnacttcaggaaacctggcatcgggcatttatcctcctggcttggcaacttataggccagcctttcatagggctatgttccttcccgtggggcntc

SEQ ID NO: 611454 - DNA, 356 bp, Homo sapiens
  misc_feature (1)..(1): n is a, c, g, or t
  misc_feature (11)..(11): n is a, c, g, or t
  misc_feature (16)..(17): n is a, c, g, or t
  misc_feature (19)..(19): n is a, c, g, or t
  misc_feature (23)..(23): n is a, c, g, or t
  misc_feature (25)..(25): n is a, c, g, or t
  misc_feature (27)..(28): n is a, c, g, or t
  misc_feature (33)..(33): n is a, c, g, or t
  misc_feature (40)..(40): n is a, c, g, or t
  misc_feature (43)..(43): n is a, c, g, or t
  misc_feature (310)..(310): n is a, c, g, or t
natcttcgggnagacnnangccnangnnaaacntacaaanagngtgtccagcttctcacatcacgggatcaaacacatcaaacaagcttctatcacctctaaaggaaccctgtgtctgtctaccttgtgaatgagccgaagctagtcagctgaaggataagagaccacatggaagagaattaagtcaccctgaccaatggccagccaaaagccagatctgtggctcagccacaagccctactggccacagatgcacgtgagcccaaaaggtttgctgaaccagtccagagcagaaaaactgcccggatgncccacagaattgtaagccaaataaatggttgttgttttatgccatt

SEQ ID NO: 611455 - DNA, 1090 bp, Homo sapiens
agcggagggacagcgccgaggcaagtgagagtcggacgggcacgtgggcgaatctgtgcctcgctgaggaaaacatatgtaaacatgggccataggacatcctaatgaagccgagaggcaacatgtgtcagtcatatgcattgttctcgtgcaaagctttgtcggggaggagcataacgtaagaaagcagccacgagtgcttcatttcaaaccttctcagaggtttcacctagggaagtgctcatgagacggtgagaagaccggtgtgatgcatagagagacgaaacgtgacacattttgagacgatataggcaatgagctggacaatgggcccgtctacttgaaaggacgactcttgaaagacccctatattgcctacctagagagggagacgagcgacccatgacgaaggttacaagcggatccccaattgccaccgcaagtgacggtctcctatccgagcctttcttcctgcttctgtctcgtgagatatcggccaaagagatcaacacggagaacatcacttggacctgttcatatggtgatggttgggaaagaaaactgggaacagaatgatggaataagactgattgggggaattgacaagggaggcgtcttgatgacgaagtaaaggcgttgcgaaggctggaaggtgaacgacactacagaggacaacggcacttaattcgcgtagtctaataatccggaagacttaaaaggcggaaagaaggacctggaagtggccatgtcacacaagagacaggctggaagctccggtccaccgggccttgtagaccaacgagaggcaaccgccaacaacaagcaacggggacacgaaggggaagggcaacggcagtgaacgggaaaggcactgcacaagaagagacatgtgaaggcacctgaagcggacacggacaacgaagtgcgggcaacgcattgcacgccaggtgacacgcacagacaaacaacgactgagtgcaagagacaacaaaggagggatagtacacgccagcacgctcatgcaggcgcgacataaacgacaataaaaaccccagacaacaacacagaaagccacagcacaaaacagaaa

SEQ ID NO: 611456 - DNA, 395 bp, Homo sapiens
  misc_feature (349)..(349): n is a, c, g, or t
atcatgatgtagaatctatgtcttcactcattgaatctgagctgaccatgtgacttgctttggacaatgggccattagcaaacataatgcaagcagaggcttgaaaagaggcttaggaactgggactctgttgttgctcttaggaaccctgtgtctgtctaccttgtgaatgagccgaagctagtcagctgaaggataagagaccacatggaagagaattaagtcaccctgaccaatggccagccaaaagccagatctgtggctcagccacaagccctactggccacagatgcacgtgagcccaaaaggtttgctgaaccagtccagagcagaaaaactgcccggatgncccacagaattgtaagccaaataaatggttgttgttttatgccatt

SEQ ID NO: 611457 - DNA, 393 bp, Homo sapiens
ctgtacatctatgaactggagaatagaacaactaaatgtgggccaggcgtggtagggtcacacctgtaatcccagcactttgggaggcaaagacgggtggttcacctgcggtcaggacttcgagaacagcctgaccaacatggcaaaaccgcacatctaccaaaaatacaaaattagccaggtgtggtggcacatgcttgtaatcccagttacttgggaggctgaggcaggagaatcgcttgaacccaggaggcagaggttgtggtgagccaagtttacgccattgcactccagcctgggcgacaagagcaaaacaccacctctaaaaaaaaaagggcaagatggagtcaattaagttaaatgtctctcaccgtctcagtcaaagagacaatg

SEQ ID NO: 611458 - DNA, 139 bp, Homo sapiens
  misc_feature (76)..(76): n is a, c, g, or t
caggcccagctgaagagcatcagatctgtgggcatggtgaaacataattactgcaggaacccagacaaccggagcngaccctggtgctatgtgcaggtgggctaaagcgcttgtccaagagtgcatggtgcatgactgc

SEQ ID NO: 611459 - DNA, 950 bp, Homo sapiens
ctgcgagcacacgggcggggcgctagcgttcgccttcagccaccatggggaatgggatgaacaagatcctgcccggcctgtacatcggcgaacttcaattgatgccagagacgcggaacaattgagcaataactaggtgactacatattactagtctgtccacgatagatgccaggtcctatgttggacgggagttaagatacctgtgcatcccagcagcggattcaccgatctcgaaaaccttgacaagacatttcaaacgaaagtattaaattcattcacgagtgccggctccgcgatgagagctgccttgtacactgcctggccggggtctccaggagcgtgacactggtgatcagcatacatcatgaccgtcatctgactttggcctggaggatgccctgaacaccagtgcgtgctgggagatcctgtgccaagcccaacgtgggcttccagagacagttccaggagtttgagaagcatgaggtccatcagtatcggcagtggctgaccggaagcactatggagagagccctttgcatggatgcagaagaagccaaaaatcatgctggccgttccgggacattctgaagtgctgggccttgctcagaagactgtaactgtacctgaagtttctgaccatatgcaaagccacagagtttaggctggtgctgccaaagtagaaaagcaacatagagttaagtatccagtagcgatttgtaacacttgtttccatttgaagctgaatatatacgtagtcatcgtcatgtcgagaactagggatagtctgaaggcaagagaacaatatttgccccttaatacccaatagtgtggaggttactagtacctcgcttggatgcctgtagggatcccgggagccttgcggcactgccttgtgggtggattggggctcgtgaatgcttcctgtgaaagcctccaaggacaaggca

SEQ ID NO: 611460 - DNA, 287 bp, Homo sapiens
tacaggacccgtgaatgtgtggtgttatggtggagcttctttccttgtggatcctgtggagcttctttttcctcaatgacggcggctatcatgtaaacctattggcatttatctaaaaaagcttgattgacagcaatcagtgctgagatgaaagaagccacatacaatcatacagaaatgacatcagggcaaaaaataataggcacaaataattcaaagaacaaaaagtttataaaccgcccaacgataattaattgccagtcatttctccataacaccacacaatt

SEQ ID NO: 611461 - DNA, 393 bp, Homo sapiens
  misc_feature (59)..(59): n is a, c, g, or t
  misc_feature (157)..(157): n is a, c, g, or t
  misc_feature (163)..(163): n is a, c, g, or t
  misc_feature (197)..(197): n is a, c, g, or t
  misc_feature (355)..(355): n is a, c, g, or t
cttcccgggttcaagcgattctctcagcctcctgaatagctggggttataggtgcctgncaccacgcccagctaattttggtatttttagtagagacggggtttccccatgttggccaggcgggtcttgaactcccgacatcaggtgatccacccgnctgggnctcccaaagggttgggattacaggcgtaagccancacactcaggcgaatttctattaatttattttaggtggtttccaggagataatctatttaacaactccttttagtatggaccaaaaaagtgttgatccaaatatgtgcacatcagtcagtaataacctattccatccagttcttcagctttcctctcnttgagggatagaaagaaactcctaagggcttcaaaatg

SEQ ID NO: 611462 - DNA, 102 bp, Homo sapiens
cagaggcgcggaacttttcttcccacacctggcgggaggcctgacacacctgctggtactcgtcctcagacagacgtgccagctgcactaacgcgtcagatg

SEQ ID NO: 611463 - DNA, 322 bp, Homo sapiens
ctgggccgccaccaggaccccgccgtgggcaggccggctcggccatcggcgccagggccagtaaccatgacgacggccgttgccaagccgagagcaatagaggcgtcgccggggctgtttcaaaacctaaagcaaacaacgaaaaacgcacatcgttggggaggggaaagactagaggacggggcccctcctgaggtcagacagcctgcggccccggcggcgtgagccgacaaaatctacgtcacttggggtagaaaacaaaaacccgaaaagcccacgccgccgttgaccgcgacacgtcacttgcggcccttgggcactt

SEQ ID NO: 611464 - DNA, 208 bp, Homo sapiens
ctcttccccgtgacacgttagtcattttctccacagagcagcagaatgagctttcttatagtccccagatgtttctcccttaatcatggaataaagagaggtggcgaaattcttcctataactccttcctgtatgttaatacagatcaatctcactcctgggaaaccatgactctgctttagaggtatgactcatctgtcccagtctc

SEQ ID NO: 611465 - DNA, 165 bp, Homo sapiens
agaatatctgaagattatgaacagctccctatataatatctttcaggaggcacttagagagatgttcttgaactcacgggggtcaagtggacctccaagttacgaatttttgataaggactattgcaattgtgggcccacacatcccataaaagcaaacaaatta

SEQ ID NO: 611466 - DNA, 436 bp, Homo sapiens
acgatctgcagatcatcaatctctttttcgatccacgagacagtatattccgggaagatcggcgcggcgcgaacttcgcttgcctggttgccaatgatcaactcatcgtgtttgatccagatggtgcgattcgccaggtgatgcgccagtgccagcgcgcgacgtaccgggatcggcttatcgagatgttgttgatacatctcggtatagtgctgcgcgcgctcggtacagactggcggtttcacaatatgcaccagcgcattttgtgcgctttaatgcggtcgctgagcgtgtccagtttcagtgtggtcatggttgttatcctcgtaaggtcgggttaaccctttctggcaggcatactgctgggcaaagtcgagcagttctggcgcatcaagcggttttccggggcgcatagggcagattaggtagtgatatt

SEQ ID NO: 611467 - DNA, 754 bp, Homo sapiens
  misc_feature (487)..(488): n is a, c, g, or t
  misc_feature (490)..(491): n is a, c, g, or t
  misc_feature (494)..(494): n is a, c, g, or t
  misc_feature (501)..(502): n is a, c, g, or t
  misc_feature (504)..(505): n is a, c, g, or t
  misc_feature (509)..(509): n is a, c, g, or t
  misc_feature (511)..(511): n is a, c, g, or t
  misc_feature (514)..(514): n is a, c, g, or t
  misc_feature (518)..(518): n is a, c, g, or t
  misc_feature (546)..(546): n is a, c, g, or t
aaattaggctaggtagatgctcggtgttattctggacgaggggggcacaaacccttacataccccccacaggctgctgccaccgctgctgctgctgctagctctgctgctctgctgccagcccagtgagtgcgccttgtgctgcggtgcccagtgctgctgggcaaggtggtgcagtgcgttggttgtccagtgtggctgcgtggaggaggaggatgggggtgtcgccagccgagtgtgctgcgctgtgaagctgagtgtgcttgtctcagtgagtggagtgtgtgcagtgagttgcgtgtggtctacacccctaacttgctgccccagtgacttgcatgtgccatcctgcccaaggactgactgaggcggccttttgcgtggcgcttgcttgctcgtgcctgagtgcccgctgccttcctggccctgccgcgcctgctgtttgcagaggagaatcctaaggagagtaaaccccaagcaggcactgnncnncanaggattnnanncgcngnganccancagaggaatccaggcactctaccacgcnctcccagcccaattctgcgggtgtcaagacactgagatgggcccatgccgtagacatctggactcagtgctgcagcaactccagactgattgtctaccgaggggctcaaacactctacgtgccaattgtgaccatcgaagcttctaccggaagcggaagtgccgtcctcccaggggcagcccagagggtccctgatggtgtgtggatc

SEQ ID NO: 611468 - DNA, 487 bp, Homo sapiens
tggcgtttaagcgtttactggtttctgcttcgtttctgttgggaatcgagcttgttcccctgagagcgcgaccttgagcaggtatgaccgatgattcgtctgggtctcacaatgtgcgttagccgagggcatatggctaccggctattccgtgcacatgaacgcgtgacaattagggctgtctgctccttagtagctattcacgtagcaatcttcatcacagcaggtaagggtcacaaactcctccatgggttcccattcagagttctttattggcactgactgaatgaactacttgagggaatatcccgtgtgatgcagacatgccccagatggattctactttctttataactagggactttcaagcactaaagataaagattgtcactactaatgtagacgcctaacttcagaagcgttcacgtgtcatacatgtgaacttttcctaggaaaactgtgcaataccgcgcttttcctctagggga

SEQ ID NO: 611469 - DNA, 855 bp, Homo sapiens
  misc_feature (34)..(34): n is a, c, g, or t
  misc_feature (111)..(111): n is a, c, g, or t
  misc_feature (120)..(120): n is a, c, g, or t
  misc_feature (140)..(140): n is a, c, g, or t
  misc_feature (172)..(172): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (205)..(205): n is a, c, g, or t
  misc_feature (208)..(208): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (234)..(235): n is a, c, g, or t
  misc_feature (248)..(249): n is a, c, g, or t
  misc_feature (264)..(264): n is a, c, g, or t
  misc_feature (280)..(280): n is a, c, g, or t
  misc_feature (284)..(284): n is a, c, g, or t
  misc_feature (308)..(308): n is a, c, g, or t
  misc_feature (313)..(313): n is a, c, g, or t
  misc_feature (319)..(319): n is a, c, g, or t
  misc_feature (328)..(328): n is a, c, g, or t
  misc_feature (334)..(334): n is a, c, g, or t
  misc_feature (338)..(339): n is a, c, g, or t
  misc_feature (361)..(361): n is a, c, g, or t
  misc_feature (370)..(370): n is a, c, g, or t
  misc_feature (373)..(373): n is a, c, g, or t
  misc_feature (379)..(379): n is a, c, g, or t
  misc_feature (382)..(383): n is a, c, g, or t
  misc_feature (387)..(387): n is a, c, g, or t
  misc_feature (395)..(395): n is a, c, g, or t
  misc_feature (403)..(403): n is a, c, g, or t
  misc_feature (408)..(410): n is a, c, g, or t
  misc_feature (412)..(412): n is a, c, g, or t
  misc_feature (418)..(418): n is a, c, g, or t
  misc_feature (420)..(420): n is a, c, g, or t
  misc_feature (433)..(433): n is a, c, g, or t
  misc_feature (436)..(436): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (468)..(469): n is a, c, g, or t
  misc_feature (494)..(494): n is a, c, g, or t
  misc_feature (521)..(521): n is a, c, g, or t
  misc_feature (841)..(841): n is a, c, g, or t
tatatttttaccccatttattaagcccaaaaaanttcaagcaacttcaggttctataaattaataaggaggtacagaagcccaaccaggatgggaaaaaatgtgtttcaanaaaaaaggngacagcatggatcctcaatnatgtattgaatgaaaaaattaaaatccaatgnaanananattttcttcctgaaaatctgaatgtnatnttttagntnctntggttgttggtttnntctcccgtttgtnntggtgtgctgatgtntggtggttgttttgtnggtnaatccaagctcctaggttcccctnttttnttggcntcatttttncacctntttnntttttttgggttgtttttcctnttggttggnttnttttgnttnnttgnggttttgntatttttncttannntnttcttnantttactgttgttnttnttttttttctggagttggtgtgtncnaggngnncatggccaagatgatgtgctaagtngcttcctctgagattttatgcccaagngggagccatctggccacttgcttcttcttacatttctaatagctgctccatttccttaagggctgttgttaaatcatttacttgattgttacataaggtttgctgttctaggaatcggactctttcctctttcatctccagctttacctttaaggcctgtaactcctccatctgctttttggctgtttcgttaaaaagcttcagctcctcttgcaaagtttctaacagcaacatagagtccatgtgatcagtagtggaatcttgtcgtgatgccagggtctcactgcctaaagctggatcaaggcccttgctctccaaanttgccaacaagttg

SEQ ID NO: 611470 - DNA, 753 bp, Homo sapiens
ctactataacgcgagcgtctgacatatagttttgatgtgtatgtatttatgagaggttgctagcatggtaggtaacagaagtagagttaatgtagtgtagattaatatgtaaatgcatgtacatatatctaagttcaatacataaagtatgtaagcagaatatggtgcagaagtaatcaggacagaatgtaggagatcattaggaatggctaggatgataaatgacttacctataagcgtgctggagtgcacgttggatttatctacaacttaatgcccctatgatgacagattcttaccttgctgaactaatcttgttgctgtctaaactagcctcttgtaaagagtgttaagaagccattccttctttgtagcgtcgtactcttttgaacgctaccaggtttgtatgtgatccctctgggaacgatttcctcagagtcagagacgctattcgccaggatccatagtgttgataatacattgcggtaattccttaaaggaaaaatatcaggtgcggtttgtacaggtctgggaagctgtggatgacattatactgaatctacgtattcataattctagctgcaaagaatgaggcgtgctctcctgtattagtcaagattcataaaataggtcctgtgaacgtatcatggattgcctccgcgcgagtgtcataactccctactggtctgatacgggctcaaccctggatggcgccctacgttcctccggtggccacaatataggcagcccctt

SEQ ID NO: 611471 - DNA, 432 bp, Homo sapiens
  misc_feature (21)..(21): n is a, c, g, or t
  misc_feature (37)..(37): n is a, c, g, or t
  misc_feature (97)..(97): n is a, c, g, or t
  misc_feature (118)..(118): n is a, c, g, or t
  misc_feature (134)..(134): n is a, c, g, or t
  misc_feature (216)..(216): n is a, c, g, or t
  misc_feature (226)..(226): n is a, c, g, or t
ctcaactactcatagatgccntgctcttgtttacacnggccagtttacactgtttttccaagccaatcacagctgatatctcctggtgctatccccnaaacttatcactcttaactcnttgaggtaaataaatnaatctttgctggcaggactatgctgaatctccttaggcactcatctaatcagatatcctgagtcgtcccaattcttagaccnttttataccntgtttttctccttctgttattccatttagtttctcaattcatccaaaactgtatccaggccatcaccaatcattctatacgacaaatgtttcttctaacatccccacaatatcaccccttaccacaagacctcccttcagcttaatctctcccactctaggttcccacgctgcccctaatcccgcttgaagcagccctgagaaaca

SEQ ID NO: 611472 - DNA, 141 bp, Homo sapiens
ttttccccccccggcccggccggtttggggaaatccaggggttggccccccccaacccccccccccgtttcccccccgctttcaaaatttccggctattttttttggtttttccccgtttttaaaaaggggtttgggggga

SEQ ID NO: 611473 - DNA, 128 bp, Homo sapiens
agcggttcagaggatccagatgatggtcacggtcagcggggttatagagcgagagccgtgcctaagaaaaataataagaagaaaaaatttttaaaaagaatggtaatgcatgggcagatagttggtga

SEQ ID NO: 611474 - DNA, 828 bp, Homo sapiens
cgtggccttcaggcttccctggttcttcctcgcgttccccgaccagccgctcgctttcgcgtaaatggccacgtagctggtgcttggtgcggtcgtccctggtctttggctcaggatctctaagtcgggtccctgcttgatacacggcccatcgcacgagtagagtcggtgcccaggtcgaggccccaccgtcgagctcccgtaggggccgtgcatggcctgaagtcttcttgtctggatgtctggaggccacgcgaggtctgctgcgctgctctctgccgtcgtagtgggcgctcatgcagtgacggctctcccgtcgcggtttcatgctgcagctcagcctcggctcggatctgctcaggtccgctgtccagccggcattgttgtatccttttgcgcctcaccgcgacgccaccgctcgccgcgaactgttcgtcgaaccttgtccgcacctgtccgcgcaaccttcccagcccacgttgaggagcctactcgccctgcccagggactagacatcagccagggatggcgctggcgcagagcggctgaccccggagagaagcgttctgggcagatctgggagcatagagccagcgaaggcatgggcggctacagccaggaccagcccgcactactgactcaaggcgtgctgaaagaaacgcggggaaggttatagctcctccgggctggctctgagacgtgcggttgtggcagaggctgcaaaagcagcaacctttagaggcaaggtcatccccggggctgtgggaggtcggatacctgaggcacacaggggcctgacgggctgacttggagggccgctgagagccc

SEQ ID NO: 611475 - DNA, 2097 bp, Homo sapiens
gttttttaggaagagtgtcccgcagagacccggcgggagctgccaggagctctgggattccagcggctggaagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaaatggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611476 - DNA, 2126 bp, Homo sapiens
gccttttccagctggctgcagagaaggggccagctccctcctggggacccggagccgcggtacaggtgtggttgcttctcttggagaaagaggctgagctgacatcccccgggctgataaagaatgggctcctcctcctgggcccagcaggctcccgggaccctccctccctccttccgggcagcagggaagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611477 - DNA, 708 bp, Homo sapiens
  misc_feature (6)..(6): n is a, c, g, or t
  misc_feature (75)..(75): n is a, c, g, or t
  misc_feature (116)..(116): n is a, c, g, or t
  misc_feature (145)..(145): n is a, c, g, or t
  misc_feature (198)..(198): n is a, c, g, or t
  misc_feature (224)..(224): n is a, c, g, or t
  misc_feature (267)..(267): n is a, c, g, or t
  misc_feature (309)..(309): n is a, c, g, or t
  misc_feature (417)..(417): n is a, c, g, or t
  misc_feature (460)..(460): n is a, c, g, or t
  misc_feature (523)..(523): n is a, c, g, or t
  misc_feature (528)..(528): n is a, c, g, or t
  misc_feature (541)..(542): n is a, c, g, or t
  misc_feature (547)..(547): n is a, c, g, or t
  misc_feature (549)..(549): n is a, c, g, or t
  misc_feature (551)..(551): n is a, c, g, or t
  misc_feature (563)..(563): n is a, c, g, or t
  misc_feature (571)..(571): n is a, c, g, or t
  misc_feature (583)..(583): n is a, c, g, or t
  misc_feature (586)..(586): n is a, c, g, or t
  misc_feature (610)..(610): n is a, c, g, or t
  misc_feature (625)..(625): n is a, c, g, or t
  misc_feature (627)..(627): n is a, c, g, or t
  misc_feature (646)..(646): n is a, c, g, or t
  misc_feature (670)..(670): n is a, c, g, or t
ggggcngcgggggcatactacttggcctggactgtctcctccagcctgtacaagcgcttctcggcagctcctgcnccgtggcctggagcttccgcatctactcctccagccgaganacggcatcgcgggagcgagggagtgccantggcctctggtgctgccctcctgcgcccggtgtccaggccccggttgaccctnagctcccggctctttgggggtacgtngccatccttgagagagagaagaggaggggcccagcatcccgancccccaaccacatcctcagccgctgagggtcagggtgcgggncctgcggtgggtgggtacaggtcctcctggaacagtccgactttcgaggcactgtaatggcaatggagctcacacctccgctcagtgcagcttgttgaacctggcganctcacacttgttcaccatacaggccacgtttgggcatgttgcncatgccccgctgggactccttggaactgaacatgagagagatagtgacagagaaaggggcctngtttnttatctcaaagtnncggantnanctgtcacccttnttttttangtagacgatgtnggngccagggtcaaagaagggcagccngacaccgctgctggngnccagctcctgcagggacancggctcctccaggcgctttgtgtnccacagcgccacctgccgctcactcatgcggctgaagc

SEQ ID NO: 611478 - DNA, 654 bp, Homo sapiens
agagcacactctctcttctgaggagtagtatagagacgacgccgcggggtgttgagagacactactatagaggagagatggtgggacgaccacgacgcgggttagtactctctctccgacgataatactactgtcttctctctcgcgacgtcttctctctcgacgagagacgacgcccctcgtgtagagatataagaaatatcggcgcacacacacacctcccggcgcgccgcgcacatatatatatgatgatcccgtcccacacagagagatataaaaaagagaaaacccacactatatccttatataagagaacaccagccgctttctacacagagcgcgcgcattctttcgcacactgttttcctacagggagggcgcgcacacagagatatagagatttgtgagagatataggggagatatacagcttctatagagttcttaccacaccccgagcaccctctcctactcacacagagagttatagagaaaaaataggttatccaccacataaatcttataggttaccccggaaaaattcttgtgggtagaaaacctttttaaagggattttggaaaatttttaaaccgccttttttttttccccccaggaacccccccaccttgggtttgcttccaaaaatcctttggga

SEQ ID NO: 611479 - DNA, 2174 bp, Homo sapiens
gccttttccagctggctgcagagaaggggccagctccctcctggggacccggagccgcggtacaggtgtggttgcttctcttggagaaagaggctgagctgacatcccccgggctgataaagaatgggctcctcctcctgggcccagcaggctcccgggaccctccctccctccttccgggcagcagggaagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaaatagagatggggtggctgggcgtggtgacttcgcctgtcttcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611480 - DNA, 153 bp, Homo sapiens
tctagaggatcacccaagcagttattacatgaccacacacacacacacacacacacacacacacacacaaactgaaactaatagcaagtgtgatatatttatatgcttcttgtgcaccctgctatagttaatttaaagagagctacaacccca

SEQ ID NO: 611481 - DNA, 271 bp, Homo sapiens
aaatgaaagcaccttggtgcctgaccccctcaatcatgctggtgactttgagcactcacaggtgtgtgcagctaaccagcccagggcaggtgggttagcctggggttataccttggccctgggaataagaccaccattgggcctttggttttgttgggcttccttttgtctttaccatccacacaggtgggtaagaaatctggagttctaaaagcacttttggttgaaatacaaagctaaagtggagaagtctaaatgaaaatggctttgg

SEQ ID NO: 611482 - DNA, 1920 bp, Homo sapiens
gccttttccagctggctgcagagaaggggccagctccctcctggggacccggagccgcggtacaggtgtggttgcttctcttggagaaagaggctgagctgacatcccccgggctgataaagaatgggctcctcctcctgggcccagcaggctcccgggaccctccctccctccttccgggcagcagggaagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611483 - DNA, 419 bp, Homo sapiens
aaacgcctatatgtctcggatagaatctagttggcaccacttctcaaaaatcacttggacatatctacttcatctagttttatgcatgtatctactacgattatcatatgatctgtgtatgtcccccaggtgataatatattgtctggaatactatagctatataataagctttgaaactcaggtacacgtgatggtagccccatttattttcttaatcaagaatagtttctggttattctagttccttcgtctttctcagataaatattagcatacacttttctgtatctagcaaaaaatcttgctgtgattttgataggaattgcatcaaatctttggaagaattgccatctttactgtgtcgagtcttccaatctatgaacatggtatgtctcaccatttgtttaccacaaatagt

SEQ ID NO: 611484 - DNA, 1688 bp, Homo sapiens
gtggctcacgcctgtaatcccagcaccgcggaggttgcggttgcccggggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611485 - DNA, 1772 bp, Homo sapiens
ccacgcccagctaatttctgtatttttagtagagatgggttcttgtcaagttgccgagcctggtctcgaactcctgacctgaagtcaccgtaaaaaacctcttttcctcttctccttcctcaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611486 - DNA, 878 bp, Homo sapiens
atctctctatccagtccatttatgcagtttcttcaaagggagtctcaagtgtactctgggaaacgtgccaaacctcctttactaaaatacatcactctctctaaattcagacctggtctgtgttaggctttgacaactaattacactgtgatgaaaccaccatgcaaaattataactgagacagtgaaagagatctgacctagccaaaaaaagatggagccaggcatgatggttcacgtctataatcctagcacttgggaggctgaggcgggcaaatcacttggggccaggagttgagaccaggctggccaacatggcaaaaccccatctatactaaaaatacaaaaaaaataacccaggcttggtggtagcacttgtaatcccagcgtagtaaggaaaagcggacaagaagtgacaaaatcaactgcaaaagccgaagaacgtcgcaggggaccaaagaaccgagaatgagcccctaggcaatgcaggcatggacaccaagaactgaatatccatatcatgacaaaacaagcagggcacgacaaacagacatagcccacgacggccccactactcagaggaccacaagacggacaacgcagggacacagaacagccagtataaaaaccagggccaccagcagaaaaacacccgtaacgcaacacggcccatagaagacgaaaaagaagctagaacagggcgagaccccgggacaccccaacgaaataaacaaacagaacgcaccgcaacgaacggcagcaggccagcagcagcagcactgcaaagataacaaaaccaaccgacaacacaccccatactacccagcacacgcaccaaccaacacacgcccaccccccacgacacacccaccgccccac

SEQ ID NO: 611487 - DNA, 1746 bp, Homo sapiens
  misc_feature (1670)..(1670): n is a, c, g, or t
  misc_feature (1677)..(1677): n is a, c, g, or t
  misc_feature (1711)..(1711): n is a, c, g, or t
  misc_feature (1729)..(1729): n is a, c, g, or t
gccttttccagctggctgcagagaaggggccagctccctcctggggacccggagccgcggtacaggtgtggttgcttctcttggagaaagaggctgagctgacatcccccgggctgataaagaatgggctcctcctcctgggcccagcaggctcccgggaccctccctccctccttccgggcagcagggaagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaaatagagatggggtggctgggcgtggtgacttcgcctgtcttcccagcacttttggaggccgaggttggtngatcatnaggtcaggagctttagagcagccttaccaacatngtaaatccatctctactnaaaatacaaaacttgct

SEQ ID NO: 611488 - DNA, 146 bp, Homo sapiens
gcatagaccccagatattttgagcggggggcatatatatgtctaccgatattaggataaaactgtgtttacttagaaggttactaggacgagagtactagttctacttgctggtagagaggaacgagacggatatgtagaaaatat

SEQ ID NO: 611489 - DNA, 841 bp, Homo sapiens
agctgagattacaggcgcgtgccaccgtgcctggttaattttgtatttgtatttttatttatgttttgagatggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaaaaaaaaa

SEQ ID NO: 611490 - DNA, 1246 bp, Homo sapiens
atgaacacgtcactgctgggaagcatcggcatgctgaactcggcacctcagctgcgctgcatataaaacctaccaggtgccccactgctgcagcccgtcgtcccccggtctcccacaatgcccgtcaagctggcccggctcatctggacttacaaacgcaacgtcatcctcatggaccatgacgggaaggagcaccgccttcatggtctaatagcgtagctagcctagccgccgtgactagcgttctgagtatctactaaaattatccaagccgattgttgctactgtccttcctcagcaccagattgttcccaggggcctgacccaacccagtagccatccagtcggccacggccgggctcttgtacactctgtagcatgcttctcagtgggatagaacccgcatacgtagccaatctcgtcgattacagaggcacgcgacacatgctctgacaggatggtggccactcctgtcaaccaggtacgtatattccctgaccagaagcatggccagggcgaacaacgccacgcggcttcctgggaaaccgctcttgcttgcttgcgtgaaacagaagtcgacaagaatcaactaaacagtgtgatagcactcccagcccagatcagcatttgtcagccatctcaatcgaacctctgaagtgctgcttgaaatctggccgttctgaccactggggtgttgaggtcctgtggcagttcctccaccgactggaacactacttggccccttgcgcactcccttacaaataactggtcaacaccaaaaacgacacatggcgatcgcacacagacatcctaaacatctggactaaatgaccacggagaattcactcaacccgattcccaagcgtccaacatacaccccgttctaaacacccagtaacccacacctccaaactcactcaacaactacgtccccccacaccaaatataccctcccaaaacacactcctcccaacctctaatgcacactcgtcaattgaaccacgatcatggcaaccctccacacctcactagccatctaacactaacacaacccccatcaacaacccgaacaatcactaccaaggaacacactcagagcaacgcgcatcaaccaccaatacaaccccgacactaaacctacacacccactaaaaaaaacacatacaaaacaccacctgccaacaatactctacaacaagcacaaatcacacttccccttaaattcctctcactctcattcctaaac

SEQ ID NO: 611491 - DNA, 713 bp, Homo sapiens
  misc_feature (24)..(24): n is a, c, g, or t
  misc_feature (126)..(126): n is a, c, g, or t
  misc_feature (207)..(207): n is a, c, g, or t
  misc_feature (209)..(209): n is a, c, g, or t
  misc_feature (214)..(214): n is a, c, g, or t
  misc_feature (217)..(217): n is a, c, g, or t
  misc_feature (226)..(226): n is a, c, g, or t
  misc_feature (235)..(235): n is a, c, g, or t
  misc_feature (252)..(253): n is a, c, g, or t
  misc_feature (257)..(257): n is a, c, g, or t
  misc_feature (263)..(264): n is a, c, g, or t
  misc_feature (266)..(266): n is a, c, g, or t
  misc_feature (268)..(268): n is a, c, g, or t
  misc_feature (275)..(275): n is a, c, g, or t
  misc_feature (286)..(286): n is a, c, g, or t
  misc_feature (301)..(301): n is a, c, g, or t
  misc_feature (305)..(305): n is a, c, g, or t
  misc_feature (312)..(312): n is a, c, g, or t
  misc_feature (319)..(319): n is a, c, g, or t
  misc_feature (321)..(322): n is a, c, g, or t
  misc_feature (328)..(329): n is a, c, g, or t
  misc_feature (336)..(337): n is a, c, g, or t
  misc_feature (341)..(342): n is a, c, g, or t
  misc_feature (346)..(346): n is a, c, g, or t
  misc_feature (350)..(350): n is a, c, g, or t
  misc_feature (362)..(362): n is a, c, g, or t
  misc_feature (370)..(370): n is a, c, g, or t
  misc_feature (374)..(374): n is a, c, g, or t
  misc_feature (377)..(377): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (389)..(389): n is a, c, g, or t
  misc_feature (424)..(425): n is a, c, g, or t
  misc_feature (433)..(433): n is a, c, g, or t
  misc_feature (438)..(438): n is a, c, g, or t
  misc_feature (444)..(444): n is a, c, g, or t
  misc_feature (456)..(456): n is a, c, g, or t
  misc_feature (470)..(470): n is a, c, g, or t
  misc_feature (474)..(474): n is a, c, g, or t
  misc_feature (486)..(486): n is a, c, g, or t
  misc_feature (494)..(494): n is a, c, g, or t
  misc_feature (517)..(517): n is a, c, g, or t
  misc_feature (532)..(532): n is a, c, g, or t
  misc_feature (550)..(550): n is a, c, g, or t
gctgaaggatggtatcatcatganccagacgctgctgatcatcctcttcatcatcgtgcctatcttcctgctgctggacaaggatgacagcaaggctggcatggaggaagatcacacctacgaggncctggacattgaccagacagccacctatgaggacatagtgacgctgcggacaggggaagtgaagtggtctgtaggtgagcncncaggncangagtgaganccaggtcgncccatgacctgggtgcnngctncctgcnntnantgactgnttcggagctgnctggctcatggcccnaccnctttccnggacccncnntctggnntctgaanntggnncacnaganctgccatttgtntccagccnctgntcnccanttnttncnaaagggcctggagtagaaggacaacagggcagctnnttggaggnagttntctggngatggacgggtnccagccttctgggngtgntatgaggtgatncgtccccncacatgggatgggggaggcaganactggtccagagccngcaaatggactcggagcngagggcctcccagcagagcttgggaagggccatggacccaactgggccccagaagagccacaggaacatcattcctctcccgcaaccactcccaccccaggaggccctggcctccagtgccttcccccgtggaataaaacggtgtgtcctgagaaaccacaat

SEQ ID NO: 611492 - DNA, 109 bp, Homo sapiens
ttccttcgattgtgggctcagaggtactaacgagaaagtatttcactgtagagatgtatcattagttcatttgtacatttgattaactttttttttagacggagtctcg

SEQ ID NO: 611493 - DNA, 944 bp, Homo sapiens
  misc_feature (387)..(387): n is a, c, g, or t
ggcacccgtgaacaacaaagcaaggaagacggagctccgagcctccgggggctcctagtcaatgggccggggcgcgcagttcccatggaagactgaggagcgcgcccgtctcatcctcatccttgtcccgtccagtcttctgccttcgctattcctgacgcgaatccgtgcaggacgagccgctgcccgtgaccgtcgctcctcaagctcaccgttctcgtccttgccgcacgggattgtgctcctccgggtggtgggcacgctaacatttttgatggcctcccccccgatgttgtgccggacggtgtggtccgctttggcctttctagtttacctgatgtcgtcggtggtcttgagcagccactggtgtgttcccttttcaacgcntttaagggaaagaattgctttagggatcggggtggctcgaatgttcactggtactaacccggctgagtgttcggctccgaacatgtcttgaatttgtgaaggggttatggaaataaccctgtagaaaatactgcgttaccatatttgtgggtcctcacgtgtacccagacgttaatgtcgctcgtgggtaggcacccggagtgggaccgcaacggatagcggaaatttttgccttgccaagtaacgcctttagccccgatggatctggcaggacgccttagcgttccccagggtcagtctttgtgccacgtattttgcagggtctgtttacccggtttcctgggcatgttgttgttgccattggcccattgtggaagattcccgttttgcccggaatttcaccaaggtcacggattaggactcctctggcccagtgttcgaaccttgaacttccatcctggtgggtgcgtatcccggtaaatctgttaggagctacatttgcaggttttttccgcacgcgggtttcccagccccaggggccacatgtaagcgggttc

SEQ ID NO: 611494 - DNA, 281 bp, Homo sapiens
gcgttcacaatggtcacggatcaacaaagatacatcaataggtgtagtccgtctcattattagtagatgctattatataagctacttaacgctggataccttctttcaaatacagccattcacgttgtaaagtagggaagaagtttcttgacaagactctgcaattaaatgcttaaaatttggaggggatccttccttgattacatcaagtatgttggtacatgggtttatacaagttcctcttgagaaggcaaaaagaccaccatgtgtgagcgcgttgg

SEQ ID NO: 611495 - DNA, 949 bp, Homo sapiens
  misc_feature (948)..(948): n is a, c, g, or t
gtagcaaggactaacccctataccttcggcatagtgaatgaactagaaataacttggcaaggagagccaaagctaagacccgcgaagccagaggagcgtacctagagaacagctatagaagagcacacccgtctatgtagcaaaatagtgggaagatttatagggtagaggcgaaaaacctaccgagcctggtgatagctggtgtccaagatagaatcttaggttcaactttaaattggccgacagaagcctctaagatccccttgtaaatgtaacggttagtccatggaggagaagaggtcttggacactaggaaaaaacctgtagagagagtaaagaaatggtaacagccagtagtaggcctaagaagcagcaccaattaagaaagcgttcaagctcaagaccactactaaaagaatcccaaaatataagctgaactcctcacacgccaatgtggaccaatctatccaccctatgagaagaactaatgttgagtataagtaacatgaaaacattctcctccgcataagcctggtcagattaaaacgactgaactgacaattaaggagccaatatctacaatcaacaagaagtcattattaccctcactgtcaaccaaacaggggatgctcataaggaaggttcacaaaaagtaaaggactcggaatcttacccgctgtaacaaaaatcactctagcatcacagtataagggacgctggcagtgaacatggttaccggcggggtacctaccgggagtgcttacattgtcctaataggacgatgaaggccgagtcgcggcctattaccaggaagaccgcgcgaaggggcgtaccacaaaacctggcttttaggcagcacaccggctacacgcggcatctgggcgagccccggaggccagaaatgccagacgggccacacagagaggattgcgtaacaacaatccaaang

SEQ ID NO: 611496 - DNA, 261 bp, Homo sapiens
gggagggggtggtgccctcttcccccaaaggtttttttccggggggtgtttttgggggggggcccccctttcccttagaccaaaggggggggttggggggggaaccccggggggggccccttttgaccccggttcccccccccctttcggggggggggggttttttgggttttttcccccccccccccccccccctggttttccccccttttttttgtttttccccccccaaaattttttggtgtttttttttcccgggga

SEQ ID NO: 611497 - DNA, 542 bp, Homo sapiens
  misc_feature (438)..(438): n is a, c, g, or t
  misc_feature (448)..(448): n is a, c, g, or t
  misc_feature (454)..(455): n is a, c, g, or t
  misc_feature (470)..(470): n is a, c, g, or t
  misc_feature (509)..(509): n is a, c, g, or t
attcccgttttggtgaaaagtgggagagggcccccattctttaagtggggggaagggcccccctgtttaatttgtcccggccaggccccgtgtggtgagaagttttccaaccatccccccttgggggggttttttgttttttttattaacccaccctttcggggggggttttccaaaccggtggccaaaagggtgggtggggtggggagggtcccccattttcccccaaaggcccaaagggttaatttattttttcccctaaaccccccccccccccttttttccggggggggggggcgggttccaaaccgttttttttccttggccccttttgttttttgggtaaaagcggggttttttttaccccgccccggtaaccccccccaagggaaggggaaatttttttgggcccccctgggttttttttttggggggggncggttttaantttttnntttttaaaaccgggnctttttttggggacccccttgccccaaattttttccccnattttttggccccctttaaaaggttttttggga

SEQ ID NO: 611498 - DNA, 135 bp, Homo sapiens
tgaaggcgacctagaggatcccccccactctcctcttccgccactctcctctttccgaaaactttgcagctatagcatgaagttaatttctgtcttattttctggagtagtgtactatactggaacatagtacag

SEQ ID NO: 611499 - DNA, 4755 bp, Homo sapiens
  misc_feature (18)..(18): n is a, c, g, or t
tcataggttcgcaggganagaggtgtctgaagagctctggtagcaaaaagtgctccttccttgcttaggaacagagagggtatgggctctcttgctgtcagtctgggaggagggttcaaggaggtttggcctcctagggactggagacgccctgtcctcttcattgccttatactaactgtctgtccataggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 611500 - DNA, 1479 bp, Homo sapiens
  misc_feature (1185)..(1185): n is a, c, g, or t
  misc_feature (1479)..(1479): n is a, c, g, or t
gcccagattctggaactcagactcttagagcctttaaaatctccatccctgagagccgttctccgttggaggatccttccctccccgcgttctgaagcctctcagcagcgtcctggtaggacgcccgaaagatgagcttctccatgctctcctcccctaagaaccgagccaattgtctcctccaaaaaccgcctgtagcccaagccagcagcattccatctccatcgtctatggcccaagtccccgtgggacttgttgcaggcttgaacgcatcgcgcctaccccttggacgtcgagctagacgcccctgtgaacctcccgaccgactcaccagctagcgcatcgctacgcagcacgcgtcttggccaacgaggggtcctggtctttctgccacactgcaatgggtactgtcgagcccatggtgagggacagctaggcccgacggcttcccctagcagacgcgaacgggcccctcattccgccctgacacagtgccctgggggccccttgggctcccaccaacacgggggataccgaaagaaaaagacatggcttggacaaagaacgggggccgctcctcggaggcaagcctaagagagcgaaagtgagaccccggggggtatccccaagacagggatacgaacccccttgctccgtggttggtgtcactccccctttgctactgccttgtcttgccgccaagttaagcccgtcgcctcccggcacccgcgcttgttcccatttcgccgagaaggtactggcggtggtcaccctttcccaattaagtggccccgacggcgtcagcgtcgtcggacttgtcgccctgccattgtggatgggggcccatgtgtcgcgcccagtggggtgcaccctccctgtgcccctgtgtgttagcctccaacatcactcccccaaggacttgtgtgcccggattacacctcgtccaccgactggttgggaagcggcatgcaaccatttcgcgaatttaacctggcagcggcaatcggtgctcccccatcgggggcgtaaaaggaacggaacggaagcaccttaactcgaaccatgagcgtcgtctccccaatggcggggccaacagcacacgcgcaatggggtcatactctatccgcaagcgcttccgtcagtccacccggaactctttaattgccgcagcctcaatcggctgcntatcgcgcgacagcttccgcatttcgcggccattggcgctcttcggcccttcggcgcgctgctgatttggcacgccacaatagttgggccccccaccattggctccttggcggtggtcccttccgtatgggggccttagggtggcccagctcgagggcgtcacgcgttgattcggcgccagagcacccaaggcgtatgggcgacctcccctgtctcgagggtacggccgcttgtgcccaagcggccaaccgccccggatgaggctggcttcactgagcatcggggtgacacaan

SEQ ID NO: 611501 - DNA, 362 bp, Homo sapiens
ggacactagtgcccaggcgaacaagcaggcatctctggttatccccctcaaatagttttttgtttgtttgttttagacagagtgttgctcttgtttcccaggctaggagagcagtggcgcagtctcggctcactgcagcctccgcctcctggattcgggcgattctcctgccgcagcctcccaggtagccatcacgcccagctgattttttgtatttttggtggagatggggtttcatcgtgttggccgggctgatctcgagctcctgatctcgggtgatccgcccaccttggcctcccaaagtgttgggattgcaggcgtgagccaccatgcccggcccccctcaaatggttttatctgcc

SEQ ID NO: 611502 - DNA, 6091 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctctacccaggaaaaagaagaaaaggacagattcatttggggttcagcctcatgccccccacacccaagactttgtggctaagagaatcaggccaccttgaggttcatcaagttcatcccattaaaacctcccaaaactctggaaaaaaaaaaa

SEQ ID NO: 611503 - DNA, 4354 bp, Homo sapiens
  misc_feature (103)..(103): n is a, c, g, or t
agtcagctgaggagacagaggtgctggagggtgagtgtgtgctggaggtatcttggggatcgcccaccctggctgggctaggtggggaaagggagagggcatngccctgacgtctccccctgccctgacttcccagcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 611504 - DNA, 6664 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctggaaggggaaagagaagggatgaggcaggcggcaggagggcagcgaggtccctcccaggtgcatctcccaggcacgcacttacctggaggctcagaagcttaccaccctgccagtttctcccctactcacctgcgtccccagacaccccgcccccccccactgcagccccacagcaaagacagcccagcacacagccacgcaacgcagcgcagcagacgggcccagaggctgcactgcccagggcctgggagccaaactgacgcccagtgggagccagcggcccaccctgactggaagcgcagcagcagcagtggcaacggctccaggtggagctgcgagcacaagtgaccttggatgcgacgcgcaaggggctgagggggcgcgggtggcaggggcacagcagctgggctgagggcaagaagggggtgatacctgtgacacgggctctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 611505 - DNA, 6173 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatcctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 611506 - DNA, 95 bp, Homo sapiens
gggggctctcgggcccccggatccggggtcaacacgagccaccaccgcgggggtgccgctacccgccatcgcgtgggaagccgcacccgtctctt

SEQ ID NO: 611507 - DNA, 137 bp, Homo sapiens
ccaagtactactactccgatgccaaatgggacataaaatggaaaggcaaaactccggaactcttggtactgtatgcttagtattttaaacggagccccaaacttaagcaggttggtttttagaaacgttgggacgag

SEQ ID NO: 611508 - DNA, 1742 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcaggtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgca

SEQ ID NO: 611509 - DNA, 280 bp, Homo sapiens
ctgttttcacatattcttcttttgggccagcgtttgaaatgtgacgcctaatttttaatttattgatgtgtataagttatttaattaaagattccctatcaagatactacagtgttatctatgcaggcatatggcttatttcctactactggtagatttgcaagactttaaaaaatactagaattttaattacttacaacagatgcttgtgaaagcttaaatagttctgaattaagagctgggtgcaatggctcacaattgtaatcccaatgctttggga

SEQ ID NO: 611510 - DNA, 264 bp, Homo sapiens
actgagccccggagtctccttttaggtcgtggtttggactcagatgtcacagtgggaagcagtgtgtcctgttgaggtgcaccgttcagacgaggatcaaaacagctccttgatgttcaaacagttgttagcataaaaaaatacatgtatttgtcaaactccttggtaagagccatgtgctgttcaaaatttaatggaatgtaacaattgtaaattataaaatagtacaaactgcttgtaaattaaatgaaggagtgtgtgtta

SEQ ID NO: 611511 - DNA, 3241 bp, Homo sapiens
agcaggtctaacggtgaacacagtataagggtgtgtacgtttcttatttcaaattctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 611512 - DNA, 1374 bp, Homo sapiens
cgtgggccaacgaatgccatctgataaaaaagaatagaaatggaaagtgggactagacgcagggagtcagcaggcatgctgcggtggcggtcactccctactgccactatccccagggcaaggaaaggctccgccatttgggaacagtggtttctacgtcactggacaccggtatctgagcattagttatgagaactcgtatcccgaatgtgctttcctccctactcccctgcccacctacaagtttaataacctaaggttagctacttatctcttactatacaaataacatgtctgtaactgctgctgcactgctgctaaaccttgtacagcagcaacaacacacctaacctgccatgctgggctccctcagctcactcgcagcttcaccgtgactcctactcctcagctctgggggcggaacaatacctcaagagcgctgaacactacacgacaagccctattaatatctctctgcactcctcaatccccgagcacttcaacactcctccgcacttccacactctcgcgggcgcaacgctctctctctccccttacacccttttcacacttatgcacgcaaattccagcaggaaacttgcaaacggaacacactctatcctggtgcacgttaccctatcaagcgacattcgtcaacctacacataagctcccattgactcccctttccacggaagcgcgcaactaatgcccaccatgcgtacgcaagcctaccacaaccgctcaccgcgcgcctactgcactaaataccagacatagccgaccccaacacagctcacccgcgccagccgctgccaaacagccacgctacgccggcgaaccggcgacaactcatcgcccctacgcccgctcccctgccccacaccactcacaccccaacagcaacatatccggcccggcggcaccaacaaggtaaacaccgttgtcccattaacgcattcaactcgataatatcaccgcaacagcgacccccccaatcaggaagacgggtatcacaaaccctgtgcacacacagtgggcacacaaagaacaagagaatcggactggcatcacgaaccaaacatcctaaacaactccacctgtaggcgccaactccagcgggacacgctcaaaccaagacgaaggcaccaacacgcagggcaggctctccacgcctcacgacacacacgcgaccaccctctcaacgacgagatgagcaaaacatgccgccccacctctcacacgcgcaccatcaacacactcaatccgggcaggagagatcgacgtaacaaacaagaaatcgcacagcgcaacactacgagacagcaaaaagaccgccccaaaccagcccacgcaaccacacccactcagtcag

SEQ ID NO: 611513 - DNA, 214 bp, Homo sapiens
ccccttggcccctggtttttgggggggaatttttgccccccctttgaacaaattttggatttttttccggggcccggggcccccggggcccctttattttttttttcccttggttttggccgggggaagggggggggttaaactttggttttttttgggcccccccgggtggggcccgccccctttttttttctttgggggaaaccccccccca

SEQ ID NO: 611514 - DNA, 1511 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggttgggattgggatggcttccctgctgccctgggatttggaagaatgttgaggactgtggatgtcccattccctggtcatggggtgcggggcacccagcagtgattctaggaatagcacagagttaccaggtgttgttgagagcttggctctgtgctccgtagggtcctggcttgccccttattagtgggtgaccaagttcgcttagctccaaaattaacttaagttatgtagagggaagggaacttacacttaagggtaacaaaaaaaattcttactgttattaaatattgacttctggtgtacattacctcttggtaatatattgttagctcttggcttggtgcagtggctcacgcctataatcccaacactttgggaggccaaggcgggtggggcacttgaggtcaggggttcaaggccagcctggccaacatggcgaaaccctgtctctactcaaaatataaaaattagcctgcggcgcacacctgtaatcccagctactcgggaggttattg

SEQ ID NO: 611515 - DNA, 1084 bp, Homo sapiens
cggacgcgtgggtcgacccacgcgtccgcaaaaagaaaaaaaaaagaaagaaaagaaaaaaaaaaggattgaacacagaaagactagagtagacaagaatcacttctccattctagggttatattcaccttatctttatacactactgaaatcagttggtttcaagtattttacctggggattctggcatctacatgaaatgggcctgcagtctgcctttcttacacttttttgggtcagtttatggtgtcaagattataactccattaaatgaatgggaaagtgttgccttttttcctgtctccataagaatttgcaaaagatgggaatgatctgtcggttaaaagtttataaagctgtctggccctggtattaatgggggggaagactttaactactataattagactattcaggaattctatttattacttgagtcaatttggaaaaaaaatctaggcatttacccatttacaattgattagccataaagttagcttacggaattcgctaatttctaaacctctcctggatatgcatacttcctttaccgatactgtaggaatctgcctcacatttcttttcctggggcgtttgaccagaagtaggtcaaataatgtcgttcaaagaagcagtcttaagcttatggtcatatctcttcatccccttcatctattaaaagattcaagagatacagaatggtataggccagaagatacatcaattttacaacagatgcagaccttttacaccatacactgtatagcagcagattagccaaatttataacactaacatatcacagacatactaaaataacaccctatcacaaccacaccaaataaagaataaagaagttaccaacactattatatcagagtacgacagagggtgcagaagaagcattgtagaggaggagccatgaggcggaagtgacataacaggcggatgtactatgaagaaagagagggtactgtgtctgtaaagaagtagcggaggcactagtaagagaagataggacgagagtagagggagacgataggtgagttgaggatatacagctgagagcggtgcagatgagagg

SEQ ID NO: 611516 - DNA, 204 bp, Homo sapiens
agtggacgaggggtgaaggccgagggcccaggaggacgcagtggctggtgtggagaccctggaccccaaacccccaacagagtgggacccagcgtggtctgggtgaatgagccggcaccagctgcccccagtgtgacctccctctgggggccttgttccttctgagtgctgcatctcgcacaaatccacaggtgaattggggct

SEQ ID NO: 611517 - DNA, 1171 bp, Homo sapiens
gagcgctgctgcgcgcacggcctgaggatggaccccaagccctggaccttgccgatgcgtggcactgaggcagctggctgacgctactgtgagggaaacgaaggttgtgatgcagccccgcaggacccctggccagccctggccccagtcctctgccggagccctcgtgctggacggcagagtccagctggcatcccagctgatggcacgggctgccttgcgcacgccacctggcttgcaacctcagcgcaacccccttccagcaggccactggcacacggctgccccgcctgaccgccccaggcgtgaagccatcgtgacgcgagccgcccacggagaccaaggcaaggcagggaacgaggcttctcatacgattctagttcacgaaaaggaataaccacgcattttgcaaggaccatgacggccactgtgcgttgacatgctggtggctcggactgctggctgccaatggcgagcctgttgcatgggccaggaggacgcgcttccgcacgggccctgccggcacgggcctcgccacgagagctccatttcaccttacccaggtacaagcggggcggtgcgagtcccaggacaggtgcaccttacgccttccttgtgccccagccagcggggtcccggctgccctcctgccgtccactccacggaagccctgaggctgctcctggaggaacccgacgttgcattaagcagggacgctagcagctgctcaaccaactggagctgctcaaaccacaagcccgccagaatcgacgacgcctgcagcaccctggctgccagcgctcaccgccgccattgcacgccgagcgttaaaccttcttcccccacgtataaaccccaatcactccacactccctgcagttacacccacacttctctctgcacacccccctgccacacccattccgcccaccggcaacaccccctcttcaaccttcccccgccttcagaccacactcctctacccacagacagccccaactctttcactcgccccacccttaagcacctcgaaccaaatctccctccatcgccaactacaccaaccaccaccacaattcacccctatcacacccaagcccacaccccacaccaccccccaccccccctccacactatacacaacctatcatcacaacaccacctccaccct

SEQ ID NO: 611518 - DNA, 253 bp, Homo sapiens
gagtcacacaggaagacctttccctacaaaaaaaataaacagccaggcgtgatggcgcacagatgcagtcctagctacttgggagactaaggcagaaggaccacttgagcatgggaggtcgaggctgcagtaagccgtgataacaccactgaactccagcccgactgacagagtgagattcaaaatggcccagttccacaagaaaccaagtaatccagagctaaatttaaagagaaatgtaaaaagttcattc

SEQ ID NO: 611519 - DNA, 332 bp, Homo sapiens
gcacgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctggggggggggccgggccccaaatcccccttatggggggacttttaaaaattggggggccgtttttttacaccgcgggggggggaaaacccggggggccccccaattaaaccgcctggaaaaaaacccccttttcccgggggggggtaaaaggaaaggggcccccccggggggcctttccaaaatttggcccccccggagggggaaggggcaa

SEQ ID NO: 611520 - DNA, 318 bp, Homo sapiens
  misc_feature (41)..(41): n is a, c, g, or t
  misc_feature (127)..(127): n is a, c, g, or t
  misc_feature (132)..(132): n is a, c, g, or t
  misc_feature (181)..(181): n is a, c, g, or t
  misc_feature (247)..(247): n is a, c, g, or t
  misc_feature (292)..(292): n is a, c, g, or t
  misc_feature (300)..(300): n is a, c, g, or t
  misc_feature (310)..(310): n is a, c, g, or t
cctgcagtttggaaaatgaatagttggcatcagaacagcancaggaggctgggtgtgggtgctcacgcctgtaatcccagcactttgggaggctgaggtgggtggatcacgaggtcaggagttcaanaccancctggccagggtggcgaaaccctgtctctactaaaaatacaaaaattanctgggcgtgatggtgggtgcctgtggtctcagctactcgggaggctgaggcggataattgcttgancccaggagatgaaggttgcagtgagtttgtgccactgcactccancctgggcnacggagtganactgtctc

SEQ ID NO: 611521 - DNA, 380 bp, Homo sapiens
gtgaaagcacacccccatggtatagatggaccacattttctttagtgcactgtctttgtttacctaggttgattccatgtctttgctattgtgaatgctgctgcagtgaacacacaagtgatgtgttttttggtagaatgatttcttttcctttgggtagatgcccagtagtgggattgctgggttgaatggtggttctgtttttagttctttgagaaatctccatactgcttttcatagaggttgtactaacttacattccctccaaccatgtataagcattccctttcacagccctgccaacatctgttattttttagctttttaataacagccattctgacgggtggagatgtatctcatcggcttttatttgcatt

SEQ ID NO: 611522 - DNA, 120 bp, Homo sapiens
tatgaggaattgtcaaggctgggcagtgactcattgtgtacattcttcttcatgctctgtcagcttgcagtacatgatgcctactttctgctggtagttcagcccttgttcatccagttt

SEQ ID NO: 611523 - DNA, 169 bp, Homo sapiens
gctttatggtctccatcccctccttcggggtcttgaggactgtaaatgtcgagcccgtaaggcctcatcgatgaggatccatgggtcctgcattggtcatagtcactagtaacttcttgtccatggatctcactgtagaactctcgctcaaacagctgtggcttcggag

SEQ ID NO: 611524 - DNA, 179 bp, Homo sapiens
ctggcttggcaagtgcagagggattatgtaaagaaaggtaagtctctatccctggggaaaggaagaggctgatagaatacatgttcaattatgcaaaataggttcaggaatgagaggctcggaagacctctttttatggatgggcccaccgggagaaagcccctcttctttggtacact

SEQ ID NO: 611525 - DNA, 272 bp, Homo sapiens
gagttcggcagcgagggctgtgaggcagcgcaatgccaagacagagctgctggcgcggcgggcgaatctccctgcaccatgagcctcggccggcccgtacgataagcacagcgcgtgctgccctccatttgccccggggcctcggctgcgaagatagcggcggccggacacgaagctcgaggaaagcgctgggccgggtctctacgaacacgtgaaggaaaagcagctccgtccacaacgccgcttcggggctcctagggagtcgggcccgg

SEQ ID NO: 611526 - DNA, 260 bp, Homo sapiens
gtatctagagcgatcgctatgcggtgcctttccatatttagtgcttccttcagagctctatgtaaaggcagacatggtggtcacaaaatccctcagcatttgcttgtctgtaaaggaattttatttctctttcacttctgaagcttagctggactggatatgaaattctgggttgaaaattcttttctttaagaatgttgaatatttgggccccaactctcttttaagctgtcaggggttttctgcagaagagaattccc

SEQ ID NO: 611527 - DNA, 458 bp, Homo sapiens
agcctttggtgtctttcactcacagcagaaagaaataggtcataaattacagcactgatttgttccaatgatatcattagctcctggaaaacaaggatcatgaaaaacccatttcaaatgaacatatgagtcaataccaaccaagcatcttttggaaaagagcccttataaattcatactagaattctgactcctaagtgaatatctctggatcttcagaacatagaagacttagctccagcccatgcatcagtcccttcagaccatagagtcataaccaggcctattgaaagagctggttacatgagacagtcagagatttacctaggtgagaaaataaagattagatggtttgaagcagagttctagcccttccaaatcagacctccaacccctttcttaattctatagtttgtagttttcaaaggagaagttgtaataaagagtaagtaaactaa

SEQ ID NO: 611528 - DNA, 220 bp, Homo sapiens
  misc_feature (27)..(27): n is a, c, g, or t
  misc_feature (33)..(33): n is a, c, g, or t
  misc_feature (41)..(42): n is a, c, g, or t
  misc_feature (54)..(54): n is a, c, g, or t
  misc_feature (57)..(57): n is a, c, g, or t
tgctctagaggatctcactagccgacnggtgtntacgcatnnggacactggctnagntatctgtccaccatgtcgtccctccgcagcctctacctgcgatggtgctgccaggtgcaagacttcgggctgaagcacctcctggccctggggagtttgcgcctcctgtctctggcaggctgcccgctgctcactcaccaccgggctgtcgggctagtcgggg

SEQ ID NO: 611529 - DNA, 155 bp, Homo sapiens
  misc_feature (1)..(1): n is a, c, g, or t
ntcagaatgcctctccatcccagtatatatgaagtaatctcaatggcctggccaaactcaagtaccaattcaacctttacccagaaacatttgctctggctagcagtcttttggataggctctcactaccgcaaaggctcatccaaacaactccg

SEQ ID NO: 611530 - DNA, 957 bp, Homo sapiens
tttagcattattgatctcaggtccctgcacagtggagaatggagagaacgtctcctacttctggctcagatgttcggggtgtgcctaagtagtgggatggtggctcgatcatcatggcacgcacatatggaatcactggggagggggaagtgtaagtgccagtggaaagggaggctcgatggcacttccgttgacttagcattaagtctacgaggcatgatcgtacttctcgatgtagtaacctgcttcaaagattatccgagctgatgcgccccatgccttaatgaatcgtgctcttctctctccatctgcagcctgttctggaccgggcattcttcttcacacatggtcatcgtagggagggctgctcacttaatgacctatgcttgatccagaaagaatttgtcactgtgccacttcgtcttaaatcctggtggacaggagtatctgtcgaaagaaaattggtgaatgtacttactattcaactgacgtgtgcctccctttaatctgatccaaactgcttggcctggatgtggaccctgggatcatgtccaatgtttggttcaaagtatggtactccccctgtggtggcccattgtttctcgaggagtgattctaaagatagatgtaatggactactggaagttctggacctggctggacgggaaatggaagtcctttcttgaaagctggtcagatggtgttggttagaggaaggtgccaacgttagtgtgcaataatgaagaataatgtcgtgcaaaggtcttgaaacttgaaggtccatattgtgggcttgtcttagatgccccatgattattaaaggaggcttggtgctaagtggagatttggactgcgatgggagtttaggggaccgattgaaattgccaggcaatatgggttagtgggccctgttcttgagtaaaaaggaattggatgcggtatgggttagggttaatg

SEQ ID NO: 611531 - DNA, 296 bp, Homo sapiens
atatgatcttggctgggtacacgtatgcccatgccccattatccctctgtgtgtctaaatttcctcttcttaaagggacaccaggcggggcgcaggggctcacgccggtaatcccagcacttggggaggccgaggcgggcggatcatgaggtcaggagttcgagaccatccgggccaacatagtgaaacccggtctctactcaaaatacaaaaattagcggggcgtggtggcaggcgcctgtagttgcagctattggggaggctgaggcaggaggatcgtttgaacccaggaagtg

SEQ ID NO: 611532 - DNA, 350 bp, Homo sapiens
cttacacttaatggttcagcagagatacacacaggaagccccatgggcctcatcctaccccagttactgtcaattctagcactcactggtgatcagcaggaacacaaatcataatgattatttctcaatgagtccttctctccaagcggcccttgaactctgtgacggcaggaactgtgccccattcaccttcggctctaatccttgcctggagaacaagtgaacgctgcacgtgactggaagggggcgctctccacgccacgcaccctgctcgctttgccactaagctgacaatcctccagtctccaccgctctctactccttacctgactacgctccggaaaaatcct

SEQ ID NO: 611533 - DNA, 199 bp, Homo sapiens
aatactggtaaacatatgtctgatgacaggtataacttgcatattgcacagccaatccacagcagcataatagaagctaaagtgtgaccagcacctatgactgcacaggccagagtggccataacaaccataagtacagggaatgcagtcccatcaccgttggacagcatctatattgccatgggagtcagggtgccca

SEQ ID NO: 611534 - DNA, 418 bp, Homo sapiens
  misc_feature (13)..(13): n is a, c, g, or t
  misc_feature (29)..(29): n is a, c, g, or t
  misc_feature (47)..(47): n is a, c, g, or t
  misc_feature (94)..(94): n is a, c, g, or t
  misc_feature (333)..(334): n is a, c, g, or t
gggaggggggggnggggggggggaggggngtgggggggggggggggngcggggggaggggagggggggaggtgggggggggggggggggggggngggggggaggtggggggggggggagggggggaggggggggggtggggggggggggggggcgggagggggggggggggggggggggggagagaggggggggggagatgggggtgggggcaggatggggggggggggggcggggggggggggggggtgggagggggggggtaatgtggtgacgtgcagtggcggagcgcgcgatagaaggagaggtaagaagggaggggggggttgaaggnnggggacccaccccattcctccccacactcatggcccttaccagggtactcctacctatctccccttttatagtaataatgttat

SEQ ID NO: 611535 - DNA, 289 bp, Homo sapiens
agcatcagtgtgatgagtgacctcacagtggaatggagtgagaagcatatgacctcataaactgaaggctatcttcagatcatagtactcatatattctacgtgcattaatcctcatataaccccaagaggtacaattagtataacttatccttcgtcgtaggtgacacagttgagacacagacgagtcaaaaaactcttccaggatcaaccagtaaaaggcagaccttggattcgaaccaggcaacctggctcaaatatcagttttaattactacactctgtactttc

SEQ ID NO: 611536 - DNA, 475 bp, Homo sapiens
atagggttcctggaaggcccctgtgtggtggaggtttttcaaaccatcccccctggggtggctttgctgtttgttaatagaaccaacacgttcgggtgggggtcttccaacccgtggacaaaaaggctgttggggctggcagggtccccaagttggccccgaaaggtcagaggggtaaatgaattttttccctaaacccggccccccccttttttatcagggggggaagaagggtttcaaaactgtttgtttcaattggccctttaagtttggggggaaaaggcgggttaatgataacaagggtttgtaaacccttcagaaggaagggggaatgttttgggggcccctttggttttttttttggggggggggggttttagggttttggtttttaaaatcgggatttttttaggggaacaacttggcccaaaatttgttccagaattttggggccccttaaaaaggtttaatggga

SEQ ID NO: 611537 - DNA, 135 bp, Homo sapiens
cgggttgggttctagggatgtgatacgacctactcaggtaccgagcatgaattgatcatcatgatcttcagagtttgtggctaaacaccataatcttgaagattcggagtgcttcttttattaaagtcccaaata

SEQ ID NO: 611538 - DNA, 336 bp, Homo sapiens
aaaaggggggggccccccctttttaaacaggtggggtttttaaaaccccccccctttttaaaagtccagggttgggcccccccaaggttttttttttcctgggaaaatttcccccccccccccccgaatgtttgcccaaattgggggtttttttttttaatttttttgcccggccaatgaaagcttttttttaaaggccgggttttttttttttttttgggacccccccccccgtattttggtggccgcttttttttttaaaaaaaaaggtttttttccccttcctaaagggtttttttttcccccccccttaaaataaacccccccttggggtta

SEQ ID NO: 611539 - DNA, 862 bp, Homo sapiens
tgcggccgctgtcttccgcggggaccccgtgtgtcggcaatacctcgctcaagggggccaagtgttcatgccccccatattggcccctgttttataggggaaacttcttttggcacgctgtgcgcggttactccacaggggtactattagcaatagtgagttgccccccccataggcgaggaaccttgtgcgccccaccccagttaaccccgggcgtcattaaggggatattacctcgacgctgtgcgcacaagataatctgcggccctcctaggcaccttcgggaatatattgaggaagcagtgaagcacgcggcagatcggaagcgcagtgggacggttcccctcaacaaatgttttaggggaaacatgtttctgccagagcagctggccccacaacctaaccctctggggccccaccgcgtgtacgcacacctcgggttagaaattatcttggaaaggactttaaaagcgtcccacaaagtcccttttgtggcaaattaaatcatcaagcactccccccctccattttggcgttatgccccccactgaatgtcagttcttcttaaggcacaataaacaccaataccttcttacgagtcggtcatctaatcttcagtcctctttttcccaacaataccccccccggcaactatttcaagacaagaggagaacaaaaaaacccctgcagtttaacataaatcgaaccctctccctcaatcagaacggtgtctcgcatgagtaaaaaaaatgatccatacaataaggtaataccctctttcggcggaaaccccttcccttattttgggtggcgaggcaaattcaaaaaaaactggtattttcctgcccgacataaaaacaat

SEQ ID NO: 611540 - DNA, 360 bp, Homo sapiens
tgttataacccttcgattattgcgtcaataataacgatgagagacacatgcacatatctgacatccataagcaattcagagaggaacatatcagtgtgtgacttgatggtctagatacatctccatgcacctgtttccatccatatccatctcctaggtctctatccatatcatccatttcttcctctttactgtaccgagcataatcttttcttaatgttctcattaaaatcattgaaactaagcccaccaagaagatcaccatcatgaaggagttgaaaattgaaaaccaatgaatccgatgttgaaaaaaggacggatcaagatatttgtcaaatcgatcttcaaatttcacatctg

SEQ ID NO: 611541 - DNA, 677 bp, Homo sapiens
aagctttctacatcatcgatatgtagctgaagcatgtaagagaggggaacgtgccgctattgctgtgtccttggagatcgtgggcatgaatacgtgtttggatgctcgtgccataaaacgtggcgcggagtgaatgcgaggcgatctggacatatttgcagatggagttctgagagccaattactgaaatctgatcaatcaggttgttcaagtatggcagcgataaatctcgttacgacttcgagcatgaaatctaatgttgataaaaaaatcgaatgttgattaaatcactcaaggacaaaggatgtgtcaaaagagaggaattcatgaaggaacgtgtagaggatggataatggaaagcgagaaatctttagggaggaaaacgctacagtgattctacacagagggagaggagaatatttacccaagattaagactccacgaataaaatacttgtgggtaatgaggtgccattggaggaaatcgctaaagggagccattgagtgcaaaaggaaatacacgatgaaaaaacaaagaaaaagatttaaaggaaagtgaagaaaaaatcagagaagggatttcagattaaagaaaggactttgagaagatgaagataaagctttgataccgaaagatataacatgagctaatcagaaacaaattcgagtctaattgtg

SEQ ID NO: 611542 - DNA, 769 bp, Homo sapiens
  misc_feature (37)..(37): n is a, c, g, or t
  misc_feature (41)..(41): n is a, c, g, or t
  misc_feature (57)..(57): n is a, c, g, or t
  misc_feature (115)..(115): n is a, c, g, or t
  misc_feature (148)..(148): n is a, c, g, or t
  misc_feature (360)..(360): n is a, c, g, or t
  misc_feature (400)..(400): n is a, c, g, or t
  misc_feature (416)..(416): n is a, c, g, or t
  misc_feature (469)..(469): n is a, c, g, or t
  misc_feature (490)..(491): n is a, c, g, or t
  misc_feature (556)..(556): n is a, c, g, or t
  misc_feature (603)..(603): n is a, c, g, or t
  misc_feature (666)..(666): n is a, c, g, or t
  misc_feature (685)..(685): n is a, c, g, or t
  misc_feature (703)..(703): n is a, c, g, or t
  misc_feature (760)..(760): n is a, c, g, or t
ttacctatgtcaagggcgtgaaactctaatcaaactnatcnctctttgggcacattntactaagccttccatgcgcttcctgcccccacactttagacctatatgcgaggcctantcggtaatacaatctaccaatgaccttggtcanaagagaaatacaaagttttctttggggggggggccaccccaccctttcagcactccgaccccatataggctttggaaacaacaacagaccggatgacgaggaaaaaaaaaggccccaccatagaagaaaattcgataacgagccgaggtccctgggagtggaagaatcgcattattggccccttgacaacagaggtcaccacgcctcactancaggctatatttcccttttaagtcggtgttggctagaatncaatattccaacaagnagagaaatgcggcctttggaacaaaaaaacgtgctattatgtcgtgtggaaancactaggaggcgcccggcctnnctagctagacgctgggacctctccggctattccttgtctaatgttccagaaacgctcccgcaacntagagcccagccggagctacgctctaaaagacatctaaagagccggncagtctcaagacgcgctattaatcggcgtattatctctcatggggcgaggaatagcggatatnattcaagatgggtctttcntaggagagccgaggcagnaacgctttagtatttatagaggcgctttgatccctgtttcaaccccatctccacagntcatcagag

SEQ ID NO: 611543 - DNA, 153 bp, Homo sapiens
ccgaaaggaaagaagggccaggggaaaaaagggtggctccggcccagcctgtcgtaggaggcggaggcttagaagttggtgatccctctttgagaaggcctagattttgcattggcaggcatcagcccaaagagcctaccgcttggtgaatgg

SEQ ID NO: 611544 - DNA, 381 bp, Homo sapiens
actcgtgctggtgctctctgggagagacgggggtcaggcggcttctttgtccctcgggtgctccacatcgatatcaacttcaatgcccagagggctaagagcagctgccacactctccccaactgttcttcagtgaaattcacactcgtgatcctcctgatggaccagaatgctgattcttgcctgtgggtgccagtgtcgggcctccccgtgcactgaggaggactgtgggctccatgtttcctgtgtggaccccatttcccagtcctggccaccctgaatgtgtcctgtgtattcacccttcctggatgccatgcgtgcttgtgctgagaatgccctcatgacatggtgccctgaatgggtgccatgtggcaccccatg

SEQ ID NO: 611545 - DNA, 209 bp, Homo sapiens
  misc_feature (26)..(26): n is a, c, g, or t
  misc_feature (51)..(51): n is a, c, g, or t
  misc_feature (55)..(55): n is a, c, g, or t
  misc_feature (74)..(74): n is a, c, g, or t
  misc_feature (78)..(78): n is a, c, g, or t
  misc_feature (93)..(93): n is a, c, g, or t
  misc_feature (98)..(100): n is a, c, g, or t
  misc_feature (110)..(110): n is a, c, g, or t
  misc_feature (115)..(115): n is a, c, g, or t
  misc_feature (143)..(143): n is a, c, g, or t
  misc_feature (157)..(158): n is a, c, g, or t
  misc_feature (160)..(160): n is a, c, g, or t
  misc_feature (166)..(166): n is a, c, g, or t
  misc_feature (187)..(187): n is a, c, g, or t
ataatccatgctgttggtcataagtnaactgtattaagaacagtaaaatanatanccaccaatagtactaattntgcnttaaaaaaatttctnatttnnntcacataaanacaanttatcctaaaggttaatagttgatcganacagaataatagannancttctntctcttaatttccattaaaanagcaaatagcattgacacattt

SEQ ID NO: 611546 - DNA, 624 bp, Homo sapiens
ccttaatgacacgacagcgagatcgaccggaaatctgggccctgcgtgctgtcgacaagcgctacagaccagcttccgctacggccagatgaactcgccgttcgaatatgaaaaggtgcgctacgtgtacaccgaggcgcgcaagttgcagatcgccgagtaataccccctgtaggcgctggcttgccagcgcctacatcccccgccgacaccacttccgccacgtaaaccgcaattgcagcacggccgccctggccatatcccggtcctgaccagccggcaccgaaggctgctcaagggcttcaagcatcgcaacgctggccgcatccatcagtgactcattcgccacgctcggtccactctcctccagcgccgtctccaacccccgcaaatagcgaacgcgttcaatcgccaacgcgccccggctgcccgccaggcaggcacgcaattccagcaactcatcccccaggtccagcccgagcaatccatagtcccaatgggcacggcgatcagcaggcaaggttacgctgtagcgcgacaagcgaatcagccggtccgacatgcacccgccaaaccagctttcagccagctccaagggaggggacgtccatagcgccaggtcgc

SEQ ID NO: 611547 - DNA, 339 bp, Homo sapiens
  misc_feature (149)..(149): n is a, c, g, or t
  misc_feature (184)..(184): n is a, c, g, or t
  misc_feature (290)..(290): n is a, c, g, or t
aaaaaacattagaatgcaaagtaaaattgagttaaatccccagatattctgaatattgccattattccaacatcatctcatataatagtaaaaaatagcatatactttcattttacattaaaattgactttaatttaattatatatttnatattctgataggtgagcaatagaatacacatgtncaagtcattgttttggtttagtcattcagactaattctaatttccgcagtaaatcttacacaaggaaagaaaatgtttctcagaagtcaggcctaagaagttgggnaaaaaattgtttaggggtggccgggttgcgggtggctcacacctgtaat

SEQ ID NO: 611548 - DNA, 157 bp, Homo sapiens
tccctcggtctactgtctgcagaccatggtggagaggacagcttatgggagcacgaagaaagagcgaagtgcaaaggaagaaggagcttaatgcaggaacagattctgcagtagggggggtctcaataacaagttattttccactgaacaaaaaaat

SEQ ID NO: 611549 - DNA, 528 bp, Homo sapiens
  misc_feature (199)..(199): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (207)..(207): n is a, c, g, or t
  misc_feature (213)..(214): n is a, c, g, or t
  misc_feature (216)..(217): n is a, c, g, or t
  misc_feature (228)..(228): n is a, c, g, or t
tcatcgagctcggtaccgcacgagttcggagtttgggggtgtttgggaggaggagagagagagagagattgattttaagaggctatttggcatcaagagaagttcatgtggcagaagtatttcaacccggacatcaaatgaaaaacaaatgcaagagtacataattaacttttaggaaaagaaaaagtatgtatgtatncntngngngtgtgnntnngtgtgcacgtntgtgtatagacaggtgtagatacacagatctgtgtgtgtgtgtgtgtgtgtgcacgtgtacatatggaaaaggccaaggctccaccaggagctctggacaacgacgtgaaggggagcaatgctgagacaggactggaggctggaagactagtttttacacctccactttgccactcaactgcctcatctggaacaagtcatttcaacttggttttctatttctaagaatggagacctcacgggactggtgtgaggtttgagcaacaaacgagatctgaaagtgttttggaaatgtgtgta

SEQ ID NO: 611550 - DNA, 155 bp, Homo sapiens
aagctggagctcgcgcggaggtgcttcagcaaggccactttgaggatgatgacccgatggcttcttaggctgagcgcccagcatcaccattgcccagccaattccggccgaatttcaccaagatccaccagagtccaggagttggacggggacac

SEQ ID NO: 611551 - DNA, 335 bp, Homo sapiens
gagcaacagttgacccagacaactccagagggctgtcgaacatagacggtaacaggtatgaaagtggggactatattattggaacgtacactcaacaaaatgtgtgaatcgattagaaacaatggatattacgagatggggaggaaagataaaggagggataaagtttgtatgcggcattttggtgtgagcaacaacgtggaaggtggtgtcctttacttgagaaggagtaggcatcacttaaccaaggtttgacgtaacaacaaaactgactcacttatactgtttgtgtgggactttctactcagactcactactaccctataagtcaggaac

SEQ ID NO: 611552 - DNA, 212 bp, Homo sapiens
acgatctacaggatccccttaaatctatttgtagagactgagtctgtttgtgcctaggtttgtatccagactcctggcctcaagtgatcatcctgtcttggcctcccaaagtgctcgattataggtgtgagccgtggatgcccagcacgacaaccagtaactttccgcaggaccttgtgccctttgtcgtctgctgaggtaccgacgctcga

SEQ ID NO: 611553 - DNA, 347 bp, Homo sapiens
ttttaaaaaaaccaaaaggaccaaaaaatcttccggagggaaaatgtgtaattttggtccaggtttccggttggatattccccttccacgtggtcccacggttccttttttccccggagttttccatggtgggccagccttccccctccctttttggagttttggccggccccggggcttgaagtttgttcttacttaactctctttggggatgtttgtctcctccccttttgcgtcctgcttggggttttacttctcccggggccgggtttggctgtgtcttaactgcctttccgcgttgttaaattttgctgttccaattttaggattaaatgttggaaagtcca

SEQ ID NO: 611554 - DNA, 139 bp, Homo sapiens
ctgcgttaccctaagccaaggcctcgttgcggtccttcttactcacaacaaaatgtaccagaattctaggtcgtgccctattttacaatttgtcaaactgaggcactgagcaactgtgacgacaaggtagagccgagga

SEQ ID NO: 611555 - DNA, 223 bp, Homo sapiens
gtcttgtgatatcgtgacattcttaagatgaagctggatgctgcaacagctgccctctgggtttaggtgttgtaccttcacggtaatccatgcctgaatctgcgagtatacaaatttttaggtgcctcatatcgaccagttccggatggttatttcgtacttatagccttgtgaactccatgttatactattctcttgcagcttggcagaggttagccacgga

SEQ ID NO: 611556 - DNA, 166 bp, Homo sapiens
caagatcagatcacaaatcacttggaagggttgattgtaaataggccacatccttgagggtcttcttattaccttcatatgagctgattaaaaacccagcgtaaaagttctgggaaccatgaatttggcacactggtgccccagaaaatcgaacaagtaataccag

SEQ ID NO: 611557 - DNA, 154 bp, Homo sapiens
caccggcccaggtcggaacggagcattgtcaaaactcccgtgtctgatcagtagtgggatactaagttcggacatcaatatggtgacctcccgtggagcgtgggtgaccacctaggttgccctaatggtgggttgagaacataagagggtacca

SEQ ID NO: 611558 - DNA, 356 bp, Homo sapiens
  misc_feature (36)..(36): n is a, c, g, or t
  misc_feature (58)..(58): n is a, c, g, or t
aatattattcatcaaaagaaatgaagtgatacatgntataacataattgaccttgaanaacatgaagagtgaaagaagccagtcacaaagaaccatatattctatgattccatttataggaaatgcctagcataggtagacctatagagacagaaagtagattagtggttgccttgggctggatgcagacagtgactactaaagggtatgttcctacttcttagggtgataaaaatatttgaaattgattattttgatagttgtacaactctgaatatccataaaaccattgaattgtacactttaaatgagtgatttgtatggtatatgaattatatctcaataaagctgttacc

SEQ ID NO: 611559 - DNA, 502 bp, Homo sapiens
  misc_feature (345)..(345): n is a, c, g, or t
tatttcggatttaaacggcttcattaaaagaattggccctctagggcaagaatttgggacgagggtcaccccctttcgtccccacactcaggacaaggatgccctggccggaacaacccaagcagcgcctagatggctttggtcacggttcagcggtcaccctacccccagcaccacctccagcccctgcgcctcgagagcaagactgggattcttggttcagggagccagatttccagtgattgtaaggaagaatttgtaacagtggagtgcactgccttgcaaaatagtgagtgcacattgctggaaatattcaagcaaaggctggagaacattttgcctggnaggtggtataagaatttcctgcagtgggggacttctaagactatttctaatctaagattttgtgatttgagaatacttgtacttcaaagctggtaaaacattttagggtcatctgaagacaagtatcataggaataaatcttccatataatttaaaa

SEQ ID NO: 611560 - DNA, 297 bp, Homo sapiens
ggagccaggagcagtccccgctgccactgctactgccgtactgctgccggcgcgtctgccctctcggtctgccagtgtacctgccggcgcctcggtcgaccgccgcgtccactctaccgctgcgtccagcgactcctgtttcctgtgtacctgacggacgccccatgccgcacccgctaaaacgccttgctactagcgctaacttagccactatccaacccgagtgcccaccccattgtggcacaccctggcagcccataccaaactaactccttccccacttctttcacccctcct

SEQ ID NO: 611561 - DNA, 583 bp, Homo sapiens
  misc_feature (333)..(333): n is a, c, g, or t
agaaggcgcccattcattcccctgagcttggatgccgttggagaatccgcaattcattccaaacatcgggacccaggtacaatcgcacttcgacttgaacggtgagcaagcaagggccgctcaatcgcgcggtcctgtctgggaggctgcattgacagaacccttatccaaagtatcgccgggaagctctgaaggacaggttggcttgggcttgtccgtggagtgaaagacccgcgacacggagacagaaggtgcatcagccaagggccctgttcaatgtcgcaagttgcagtgcagcattccttcacgcacctgtccacaaccccacactancttctcaatggcgcatcagtgcgcttctactgacctgctaccactggcctccatgcatgctgcctgcgtctaactaccgcgtggacgtgtcacacttctaccctacgccagtacgcgcgctgacacgcaccgaggcacctcctctggatgaaccagctctgcaccggctgcatgaagacccccttccttggtgacatggccacatccgctgaggcaccgattatttactgccagagccctcagcccgctt

SEQ ID NO: 611562 - DNA, 232 bp, Homo sapiens
ctctgtgatgcaaggtgtcgacgaagagggtgtcagtttaagttaccggacgatttcagtaatctttgttcacgaggccagatcagctacgcgtgaaagcagcagtgactcagaatgtagcttcatgtgtgatcttggcacacatccgtgttcaaaaatacactattgtttctcgttggtcttgtcagttgttcctgttcggaacacatgcgttaatgattcttgtgacatc

SEQ ID NO: 611563 - DNA, 157 bp, Homo sapiens
ccagtcgcgcgagcgaaggcttggtgcgttcaagattcaacttcacccgtaacccaccgccattgccgaaggaggcatttctgctgaggtgtaatggacgttgatacttctttacaagaggtctgagctgccttaccagatggcctagcagtggaat

SEQ ID NO: 611564 - DNA, 137 bp, Homo sapiens
ggttgtacaacagataccttctattttacaacatgggtagtaattgactataactggagatttattatattctaatactacccatgtgtacaacagataccttctattttagttgctaataaagggctacacaactc

SEQ ID NO: 611565 - DNA, 173 bp, Homo sapiens
gagataaccatagacattatcaatcacctggacgactcacctgccttaccctgcctccttgtcttgtatgcaataaatatcagcacacccagctatttggggccactaccggtctccacgtcttggtggtagtggtcccccgggcccagctgttttctctttaaaaaaaaaaa

SEQ ID NO: 611566 - DNA, 343 bp, Homo sapiens
ttcacctcctttcctaataatttcctccacattctttgccagacaccacaggaatattgcaactgccagtgcatggggtgccacaatattccaggattgaccgaagcacacaaaggttagttggaatattgctattcacagtctcatctatatataatgggtgcttttccagttctgagaagtactcattgactacatttccatatatctttcactggcttgtgcttcttttgccacaggtctttcagcaaacacatgtactaaaaggaaaaagaggagtgtctgggacacagcttacacagtgatatttatctcatccactctatctgtgagtggcctttcc

SEQ ID NO: 611567 - DNA, 98 bp, Homo sapiens
  misc_feature (26)..(26): n is a, c, g, or t
  misc_feature (47)..(47): n is a, c, g, or t
  misc_feature (97)..(97): n is a, c, g, or t
cctggggcggttttgtgccccaggcntattacttggcagcatggcantacctgcagtaccccttacaatattaaagcaaagtttttattctaaaacng

SEQ ID NO: 611568 - DNA, 1076 bp, Homo sapiens
  misc_feature (423)..(423): n is a, c, g, or t
gcccgggcgcgcccgggacctcattgcggactcggtttccctttgcgtggaggctcgcagctgccaccgcttcccacgcggagcatggggctgcctcgaccagggcaggggacgcgtgggagctagtgcaagagcctgaacgcctgtgctggaagaatgcgccgtgtcgacgcgacgcatcaatcagagtcctgaggccagcttagtggggctcatcctgccgcgggctgtggccgaggtatgaatctccaaggtgctcgaaagctagagtaaggcagatcgtccgtggcaaatgaaccagatgcggctttccatggcaagtgtaggcatgacacttgacgttccaatcatggtcccctacgtgtgcaggcgtccaccgtgtcctatgcgaagcaggcgtaccggctgtagggggcatacagnagacctctgctgatgggcagcgtcctgtgaccggcgattgacgttgcccctgctcgtagcctgttggttccattggggaggactccggctctgcttgatgccagctgactgtcgcattgcctgtgggaaggctacgcatgggttggggcagcaggaatcaagccggtccgagcggactcgaccccgccttggggtaccggggctgagtggctgcagccttgagggtggagtttccaacgctagggtccgctggttccttggccccacacgtgggcctcccaatgtacagacacgcatgacaggatctttggcgcgcccaaagatgcgctcgggcgagttcctggcgtccccgtgttggcccccttcaggcgcgggcccgttcggcccatcccgctttggccgggtcccttgggccctccttgggccggggccccgggtgcggtaaggccccccttctggtgcccggacgtccccatcgatgacccccctttgccctggaccttgcgtttgggggacccatttggtgtgggccaacgttggaaccacgtggttcgcagggcgctcctttggggttgggcctgggcattgggttggttccccccattccaatttaacggggggcccaagcccccagttaccacaagaaccccaag

SEQ ID NO: 611569 - DNA, 307 bp, Homo sapiens
cccacgttggggacgaggccccaagttgagaactaagtaagtgaacaattgttgtactgaacactagttcgatgactcgcttgatcataaacaacctgtggtgtaatattgtttttcccaaaaaacgtagcacccttcagcaggactctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 611570 - DNA, 242 bp, Homo sapiens
ggatttgctggtgcagtacaactaggcttaatagggacatgaggttaggagctcaagaccagccggctaagatggtgaaaccctgtctctactaaaaatacaaagattagctgggtatggtggcaggcacctgtaatcccagctactcaggaggcagagaactgcttgaacctgggaggcagatgttgcggtaccacactgaagcctgttgacagaaccacgctctgtctcaaaacaaaaaa

SEQ ID NO: 611571 - DNA, 882 bp, Homo sapiens
actccagctacttgggaagctgaggcaggagactccctttaaccccagagggggaggttgcagtgagctgagatggggccactgcactccagactggtcaacaggagcgaaactctgtctaaaaaaaaaaaaaaagttaaatttaaaaaagggaaaaattaatagaatatcgtgcaataaatttcccatttctaatttaagttgtgacaacaataattgttgctgagccaattcagattattgaaagggcttctttcaggcactcaggtgtggaggggtccttaaggccaaacggttaagaagttcccctttccagccaggcgcggttggttcacgccacccagcacttgggaattacaatcccagcactttagaaaggctgaagtgggggggactcatctgaggtcagaggttcaagaccagccggggcacactggtgaaaccccgtttcctactacaaatcacaaaatttagctgggcgtgttgtttgcgtgcctgtagtcacagttacacggcaggctgaggtgggaaggatcatttgaaccccagaggtcaacgactgccgctgagctgaggatcacaccatgtactcccaggcctgggtgaccaacgtgggactctatctcaaaagacatagggcccagttgcacgttctactacagcacgaaaaacccctgttgggacctggatggatggcgtggcattatataaactgtggcggaatgccacctacaaaatggggctcgggcaataacagtcgttccagcataaggaggcacaacccggaaccttgactgcaggcaggaccgcgatctattcagcaagcttaaagtcatcacgggtgaaaccagtgcgccaccgcacggtagggcaacaaagtga

SEQ ID NO: 611572 - DNA, 388 bp, Homo sapiens
cggcggcgagaattcggtcacagatactactcctctcggccagatagtgactcctctccgccagatactactcctcctctccacgagatgctcctcgtctccgcgaggatgctcctccgctcggagagatgctccatcgtctccgccagatgctcctccggtcctcgagatgctcctcctatccaccggatgctcctcatctccgccggatgctcctcgtcaccgccggatgctcctcgtctccgccgatgctcctcctctccgccggatgctcctcctctccaccagatactactcctcctctccaccagatactactcctctctgcagatactactcctctccgccagatactactcctcctctccgccagatgctcctcgctcgc

SEQ ID NO: 611573 - DNA, 1350 bp, Homo sapiens
tactctctctacaaggtttttctcctagtgtccaaaaagcgtcccctctttgggacataaagggaaaaagttctatgaggggagtagataagagaagtgaacaacgtacaagagcacggcgggataacggatgagctagccagtcgagatgagaaatcgattagcatgacaaaatacagagtatgagccctaagagagagcgcgtagtacagtcacacacggtgcagaatcatacacaagcgcacaagtgcggggacacgaaacggcataacagcgaccgcgagtggcgacaacgcagagcgaaaagggaggcacggcagtgtgacgaacaaaacagacggcgaaagacaacagtaataacagcagcggaaacaatgaagcagagcagaaaaaaacagagcaacaaggcacggtcaaacaagaacgaagagaaacgagggggcaagcgactgccaaagaaggagcaggagccgaagaaaagaggccagaaaaaagaaaaaacggacgcggagggggcgacaagcacaaacaagagaggacgacagagcacaagaagagaaaagaaaaaagaaggcgaaaaacaaagagaacacaagaaaacacagccagaacaaagggccacagagaaagagacaacacaaggaaagagcacaaccgtcaaacaagagagaggtgacgagagacgagggagagaaggggggcgcgaaaggagagaagaagaggggaaaagaagaagaaagagagagaaaacagaaagagcgcgaggaaggagaaaaacagaagcggagctacaggacaagaagggagagaggggacaggaggacacgcatataaaagagaaaaaaaaagagagagaacgcaacgaaggcagcacagccaagagagcaaagaaaacaaaccaagacacgaacaagaacgagagagcgaagaacatgacggaaggaaacgagagcagcaagagaagcacagcgaagaagaggcaggcgacagagcacgcgcaacgaaggagggcgagacaaacgagcggaggagatcgcagtgagcagacagcagacaagcgacgagaagaggagacgcacgaaaaacgacagcaggtaagagacagccgtagagtagcagaagaaaaccaaaggagaacgaataaagaagaacagaaaaaccagacaaccaacaagaagaagagacaagatagacacaacacaaagaacgagaggacaggcaagacgcgcaacacggaacgagaacgagaaagaacgcacgagcgagaaccaccgaaaagcagcaaacaagcacgcactagccaggaaaccacagagcatccagcaacccaaacgcgagagccagaccaca

SEQ ID NO: 611574 - DNA, 137 bp, Homo sapiens
agacatccccgcgcgttgttgtttcgagatttgtgcgactgtggcaggttatggttggtttcgatggggcctttcagggccacgcggtcccggcggatggccatgatggcattgcgaatgtcctcttcaccggccat

SEQ ID NO: 611575 - DNA, 120 bp, Homo sapiens
  misc_feature (119)..(119): n is a, c, g, or t
agacacaggctcaagatggtcccaggacaacaagagaaagacatgcagcctctttcttgcttttatgatatagtattagcactcactattaacacagcccagtgttaacacagcccaang

SEQ ID NO: 611576 - DNA, 736 bp, Homo sapiens
tccattttatggcgtttttttttccgcctcttatatggagattagagccattcgctgctgccctttctatagcgtcctcagtgcgcatgtggctgattgtcttgcgggcgtcgcacataccgactcggaggttctctgcgacgacgagagtagtgttagcgttcttgttgataaaagaaacatcgaatctccaggtacgctatcacgatttggaaggtggccactgcctctgggagcgacgctctccgataatgcagaaggacaacgcgctttaacatctggtaagtatactcgtacactctatatgtagctgagccacatcctagacacgctctgacgcgggagatatgagcacactgaagtagcggcccgtgtcttgcgagtgctcgccctctcagcgagaaagagtctatgcgcagacacacctgtctgagatatgaggatctcgcccagctgcgagacaccttccacgcactgtagaaccagcgccctcgtccctccggatggaagtataaagcgccgcttctctccaccctctgtgggccacacggcacttgcacccaccacacacacacacacacacacacacacacagacacacagacacatacgcatacacgtgcacacatgacacacggatacacacacacacacacacacacaccactgcatatctgagcgcgcccctcgcactggtctcacctgcaccttactcaggagtatatgtgataccgga

SEQ ID NO: 611577 - DNA, 259 bp, Homo sapiens
ggcgtgatgtctcacagaaagttctccgctccccaggacatgggtccctcggctttcctgccctcggaaggcgccagcagccaggccatcgttgggaaggttgaaagagccttccctaaggaatgaaccccctaccacgcccggtttccaccctcaaagaccttccctggggataaaaaggcctggcaatgaactaaaaatcgtgccggggaagtcgaaaaggccgggaatccaagggtgaaacacagaaggagggtgg

SEQ ID NO: 611578 - DNA, 525 bp, Homo sapiens
  misc_feature (213)..(213): n is a, c, g, or t
  misc_feature (217)..(217): n is a, c, g, or t
cggcgcgtgctgcgaagataacttgccacgaacgcgatatctcgtgtcatagggagacgacaggaagaatgatgagacacgtgcatatccctgtgtgagtatgtatagagagcgcagacgtcgtgatatgtgcaccacgcgttgcgacagcgctcgtgctcgtgagtttgtgctctcgagagcgcacgagctctgtagagaatagtcgacaanaaanagaagagggagcacactaatagtagagtggtgtgtgtgtcttatacacagagagtgtatacttgtggcggcgacacgagatattatactcgtagagctcgtgtcgtgtgttgtagaaggggaatatcatctgagagagacacagagaaacacgcgaagaggcgccgagatcgcgcgcatattgtgcacaggtctacacgtgctgtgtggctcaagagaatatagtgtttgtgaagtgtaagagttccacacacacctctctgcgttaagacactgtgttaataggaggtgctacacactacacttgtg

SEQ ID NO: 611579 - DNA, 785 bp, Homo sapiens
ttttcgtttttgtttctgtgggagaggagcgaggaggagaggtaaggagctagtaaacagagacgaaaactcaccagctcagtggggtaatggggtggtaccattcccgcattgtttctctaaaagaggcctttgttgttccaggcttggtgataagtgccctcttttttgccagcaatgttcagatgttgagtgcccctcgtggtggtgtcgagcgccggttccggtcctgttgcgccaaaattattttggggccgcctggtttaaaactaaagcggcttgggttaaagaaaaaggccacgtttgaatttatatggtgcccccgcctcggaatgggatcacccggttaaccccctgtaagaaagatgtgttgacctccgtttgttaaggtccgaaactttcaccaaaatgggggggccccatcttaaaaaccttccggagaatgggtttaaaattagaattatataacccgggtaatttggaaaaaatttaaaatctcggggggaaatgcggtcacccgtctttatggacgccgcccgaggtcaccccgtgttttggggtcaatgggtcactgttgcgctccttttaagcgcccaggggtgtaagaataaaataaagggacgccacattctaataattttgtgcccctaactattgcccactctttagtaataaatttcccgtattttataaatggtttttttaaccttttgtaaagcacttttatgtgtggtttatatttgttaatatattaaaagatttttccaccacccctctccaaaaaa

SEQ ID NO: 611580 - DNA, 378 bp, Homo sapiens
  misc_feature (252)..(252): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (273)..(274): n is a, c, g, or t
  misc_feature (293)..(293): n is a, c, g, or t
  misc_feature (298)..(298): n is a, c, g, or t
  misc_feature (317)..(317): n is a, c, g, or t
  misc_feature (329)..(329): n is a, c, g, or t
  misc_feature (333)..(333): n is a, c, g, or t
  misc_feature (338)..(338): n is a, c, g, or t
  misc_feature (341)..(341): n is a, c, g, or t
  misc_feature (352)..(352): n is a, c, g, or t
  misc_feature (359)..(359): n is a, c, g, or t
  misc_feature (365)..(365): n is a, c, g, or t
  misc_feature (376)..(377): n is a, c, g, or t
cactaaacaaaacaaccaataaagtcaccagcagtattactatcacaccaacagccacacctcttcctcgacaatcacaaattacagtaagtaatatatataactgaccacggtcaccctcatccagtccatactgatattttttgcaaggaactcaatccttttttaatcatccctccatatcccccaagacttgactgaacttgttactttgggaaggtttgtgcatgaactatacaagggtatctgaancnaantnttgcctgcataggnnatatcgggggtgcacttcnctgtntatactttgcatttcacanacttgtatgggnaaanatttnggntggcacttgtntaaatanaacttnatgtatttcannt

SEQ ID NO: 611581 - DNA, 548 bp, Homo sapiens
  misc_feature (26)..(26): n is a, c, g, or t
  misc_feature (80)..(82): n is a, c, g, or t
  misc_feature (86)..(86): n is a, c, g, or t
  misc_feature (95)..(95): n is a, c, g, or t
  misc_feature (100)..(100): n is a, c, g, or t
  misc_feature (102)..(102): n is a, c, g, or t
  misc_feature (105)..(105): n is a, c, g, or t
  misc_feature (114)..(114): n is a, c, g, or t
  misc_feature (134)..(134): n is a, c, g, or t
  misc_feature (137)..(137): n is a, c, g, or t
  misc_feature (142)..(142): n is a, c, g, or t
  misc_feature (148)..(148): n is a, c, g, or t
  misc_feature (151)..(151): n is a, c, g, or t
  misc_feature (158)..(158): n is a, c, g, or t
  misc_feature (161)..(166): n is a, c, g, or t
  misc_feature (168)..(168): n is a, c, g, or t
  misc_feature (170)..(171): n is a, c, g, or t
  misc_feature (181)..(181): n is a, c, g, or t
  misc_feature (241)..(241): n is a, c, g, or t
  misc_feature (255)..(255): n is a, c, g, or t
  misc_feature (268)..(268): n is a, c, g, or t
  misc_feature (289)..(289): n is a, c, g, or t
  misc_feature (292)..(292): n is a, c, g, or t
  misc_feature (299)..(299): n is a, c, g, or t
  misc_feature (315)..(316): n is a, c, g, or t
  misc_feature (425)..(425): n is a, c, g, or t
  misc_feature (453)..(453): n is a, c, g, or t
  misc_feature (546)..(546): n is a, c, g, or t
tttttatctaaataagattctaatangaatggaggctatggacgccaccttccacctgggctgaggacgttctcttctcnnncttnagctccccngagtncntcntggctcggncttgggtcaagctcttggcnccnatgtnctggcntgngtgtggnctnnnnnncntnntttcctttcnccctttttttctttcggggcgtggggtgcgctgcggctcgcggggggtttggcgggttcnggtttgctggggcngtccccccgctgnggttgttggtgttttgggtgnggntttgctnttttgccgggcgcggnngcgcgggggggctggttcggggccgttcccctccttcgggcggcttttggggctttttttgctggcttctctctgggccgcgtcggttttcttggggcctttggccttntttgtgcctcttcgggcgcttttttctngggggccgctgccctcggttccgcggccctgtggtttgcccggggtcgcggctttcgcgctgcttttgttttttggtgggcgcttggctgcgntg

SEQ ID NO: 611582 - DNA, 946 bp, Homo sapiens
aaggaggatttgattaaacgatcagtgaagacctgagagactcggggatgagtaacgacgctctggtgagagtgattcgttgtggagagcaactatttgtaaactggcggtcgcaaaatttgtcggcgtccgggcaatcattgcaccgctggcgcccctcgctcgtcggggaaaagattgctcattgttggggcaggccgcgttagagataggaggtgtcacccgagggatgtaaaaaaggaatgtgcgccggtgtcccgtctgggagcgccacgcgcgccagtgttctgtggggaagaccgggaagcgttcctaacttagtcggagataggggacaaaattgtccccctttggattttcgacccctgttgggttgttcgtaaaaaaaactacagcgtgtttaggggaaccaccaagaacaaagtggggccacacaccgaaacacaccggggccggtgggattagtgccaatgtgaaacccgctcgcccgattaacatagggagaatcataagtacctcggcgacactcatggcgtcgagcagcgcgcactgtgccccaaaataacccctggttccccgctggtttgttgggccccctgactgccctctaagacctattcggggggatattcgccgatgacggagatgtttgggccctagacaaaatgactggttatgcccgcgaggacctctcccccctatatgtccacacattttaagaagagcgatcttgagaagaagaacaagtggggatagtactcacggatacaaaatataaaaaaaatatctgtgggagaatgccaaaacacataaaaggtttgccagcgatgagtcgtttgttaggatggctctgctgaattcgagtccggggaggtttagtgttacaaacatatgtattttacaccagggaaaaaaaattttcaaaaaaagttcggaccacaaaaca

SEQ ID NO: 611583 - DNA, 468 bp, Homo sapiens
tgagagccattagcaggaagaaggatttgtgctgagtggtcatacctgcagaaggtccatgagtggttagcacgtgtcccccaaagttcatgtgctggaaatataatccccagtgcagcagtgttgagaggtggagcccttaagaggtgatggggtccagaggactctactctcatgaatggattagtgtcattatcaggagagtgggtttgtaataaaaacaagctcagacttctacttaagtgaaacggtgacccttccaccctttgccctgggatgaacacagcgatgaaggccgttgtcacatgccggcccctcaagcttggacttttccagcctccagaactttaaaaaataaatttctgcttattatacatcatccagtctcaggtactctgttatagcagcacaatagcgctgaagacaatccatgtacctcaaagcctgttcctggaattatcaaaagcc

SEQ ID NO: 611584 - DNA, 444 bp, Homo sapiens
cctggctgggttaaaccggagccagttctccaatcaacaggggctgtaggaacatgcacacaaaattgagatcctgatggaagccacggaaggcaaccgtggcgtcttcagcgccatagtgtccgatgaggcgcttaccccatgggtaccgctgtgcccagcgactgatgtcgtagacgcgccgcgcgatgaccatccaattgtcaccgggctggtcgtgcgcgcggatttgctcccagcagaaggtgggcagcggcgcccccgaatgcgcggatccctcccgcggtcccggctccccgacgccgcccatgctgcacgcacgagtcatggggatcccaggcggtggccgaggtccgagcaagaccccgagggaagcgaagagcgctcccgggcaccgcctccgccgccgcccgctgcaccggccccgccctaccgccgcggccg

SEQ ID NO: 611585 - DNA, 190 bp, Homo sapiens
gtgcagagagaatggccagcaggaggcggggaccggggcaaggtggcagccaccaagcaggcccaacgtgttcttccaacgtcttttccatattgacaagccagatacaagagttcaaagaagccttcaactctatcgaccagaatcttgatgcatcatctgcaagcaaacctcaggagactactccact

SEQ ID NO: 611586 - DNA, 138 bp, Homo sapiens
ccgcgtacgggcatagctgtcctgagtacctcgtgatcctgaatagtcaagaataagctcctcggaatcctggctcactcatttacaccaagccacccaactatctataaacctagccatggacatccccttatagag

SEQ ID NO: 611587 - DNA, 248 bp, Homo sapiens
  misc_feature (37)..(37): n is a, c, g, or t
  misc_feature (76)..(76): n is a, c, g, or t
  misc_feature (133)..(133): n is a, c, g, or t
  misc_feature (163)..(163): n is a, c, g, or t
  misc_feature (212)..(212): n is a, c, g, or t
  misc_feature (232)..(232): n is a, c, g, or t
ccaggaagcccagggaaggctgtgcagggacgtgctncatctacccatgtgtgatgctgacaccagcgggcctggnagttcgtggaaaggaggggagccttaccaagactcctgcaaaaacccttgggacctnctccacgtggttgccgtctactggcccctncttcaggctgtgcttacctgtgacagcagctcgtccccaccccatgggncctcatgaataaatggcttncttgccggcctttcca

SEQ ID NO: 611588 - DNA, 447 bp, Homo sapiens
cctctgtatactggaagcttcatctctctcaaataatgggcttctgagatcgcatagagtgaaatggaagtcataggacgaagtggtggcatttagttgctatataatgataatgttgttgtgacttttctaaggaagaacaaataattctcccatgtactactagaatatggaaatgattcctttctattcacggcaatttatgtcgaatgtattgataaggaattttttgagagagatgaaggcttccagtattacagttctttgactactctactagctgatgactttaatgctattttgtcgcccaacgaaagggtgctcagctaatttcaattacatctacctgaactcgaaggtagagctcaattatatcgacccttacggagagattaattagattacgtgttgtgtgcgactccccattgtaaaccataacaccacaca

SEQ ID NO: 611589 - DNA, 345 bp, Homo sapiens
  misc_feature (101)..(101): n is a, c, g, or t
  misc_feature (241)..(241): n is a, c, g, or t
  misc_feature (293)..(293): n is a, c, g, or t
  misc_feature (325)..(325): n is a, c, g, or t
actcaggggacacaaaggttctctgaaaactaaggaaaataggtagggtgtggtggctcatgcctgtaatccttgtattttgggatgccaaggcgggcggntcacctgaggtcaggagtttgaaccatcctaggcaacaccgtgagaccccgtctctaccaaaataacaaatattagccagggacagtggcgcacgtctgtggtgccagctactcaggaggctgtggcaggaggatttttnagcctgggaggcagaggttgcagtgagctgagatcgttgcccctgaactttnagcctgggtgacacagtgagacaactcctggnctcaagcaatcttccaactt

SEQ ID NO: 611590 - DNA, 159 bp, Homo sapiens
aggattgtcaatgatgggtgaagcatattgcgtttaaacaaatccccgaaaaatacattggtatatggacatcactgagatccaagagtgaccacatccctgctcatctcacctatgggaagctgctagctctaacagatgagtaaccgacttccttgg

SEQ ID NO: 611591 - DNA, 743 bp, Homo sapiens
cgccccggcgcgcggacctgcagccatggcagtcacgctgcccaggcagcccgcaggaagggagcgcgtctctgtcctgtttgactgtggagcgggagcctacactgccgagctcgccaggtcttagcctcctctacttatggtcccagaatgcccctccccatcctctgctgtgtgaagttgccctggcttgtggaacccttggaggtcgcttcctgcgaggggtggatccgggaggaagatagcaggactggagcagagaaaattgacccatgaggtggccgccttcctgtcagaagctacgtagagtagcagctgcgagatcgggctgctggtgggcggatctgattactgtgaagatcgctgagcagctgggtgacgggtgatgaagtcattgagaagtttgattatgtgtttgccgagaacgggacggggcagtcatctgcatcggacggacgtgctctccgaatgcgagaaccatccaggaaccacactggggggatgtgagctgtcgtgcagcgacattgaattcacactttctgccattcagctaacaatgcgtgcctgactacaggactggcccaacgaaggcagctggaaacccttcatcgaagttcctggcaattggcatggcttgaacaatctcggcccaagtcgaggccgagattcgtgtcaccctgggcaggaacagggatccgagttccgtccgaaactgggacacgagatgagaacatcggggccaa

SEQ ID NO: 611592 - DNA, 351 bp, Homo sapiens
  misc_feature (42)..(42): n is a, c, g, or t
  misc_feature (186)..(186): n is a, c, g, or t
  misc_feature (288)..(288): n is a, c, g, or t
gctcgacgcccgagcacggtcgtacttgcccggatgtgcgtngtaggccgtcttgatgtcttcgccgaccagcttcttgatcgaggcgacgacgtcgaatgatcttcgccctggaagtcgaagggctccttggcggcgtgttcggccaggtcgatgatggcgtcgatcaccggctgcatgcgacgntgggcgaacatcagcgccttcagcatggtctcttccgacagctccttggcttcggattcgaccatcatcagggcgtcctgggtgccggcgaccaccaggtcnaggtccgaggtcgggatcaggtcgatggccgggttcaggaccatttcaccgtcgatcatgtcg

SEQ ID NO: 611593 - DNA, 321 bp, Homo sapiens
ccagtgaatcgagctcggtacctatgtatagcacattcatcagggtaactattgtttcacaacaataaatgcgctgggtttatcgaatgtgacatagcctttttcgtcgtatccattcagggtaacggcattccggccggaccattcccggtcactcaacagacggtagttccagcacatatccttcgctgtttccagagcatgggtcaaccggaacaagtcgttctgctcggacaactctccggtacaggaatgccagaggtaattcaggttactggccagcctcgcgttgacgcctcgctggcgggcctgtttcagcag

SEQ ID NO: 611594 - DNA, 886 bp, Homo sapiens
agtacatggagctccatagagacagcgccggggcagagtgaagagcgcggtacgggcacatggtggcgactctgtgcctggctgaggaaaaataagcgtaacacatgggcaagaggagatcctaaggaagccgaggaggcagaagtgtcatcatatgcattgtttgtgcaaacttgtcgggaggagcataagaagaagcggccagtatgctatcagtgcaagcttctcagtagtttttctaagtagagtgctcagagaggtgggaaggatgtatgtctgatatgagagaagaggaaaatatgaagatatggcgaaaggcggacaagggtccgttatcgaaagagaagagtgaatagacctatatccgctcccaacaggggagacaacaagagagaagttcaaggatcccaatgcagccatagaggcctccttcaggccttctgtccgtcttctgctctgagtatcggcccgaaatagatcgaaaggagagacatcctggaccggtccataggtgatgtggcgaagaaacgtgggagagatgtggaataactagtgttgtagatgacaagcagacttatgaatagagggtggcgaagctgaaggagaagatcacgaaagaggatattgctgcatatcgagctgagaggaagagccgtgactgcagctagaacaagggaggtgtccaaggcgtgaaacagggccatgacaagccgctgaaagaccacgaggcaacaatcgcagaaccgggccagatgcacgggaatcaacaggggacagtggggcgacccggatgccggagcctgccaagcgcgtccacagaggggacgactcagcgggccgacacatctgcgcagcatgaaacagagggaaccaaggtaccgagaac

SEQ ID NO: 611595 - DNA, 1396 bp, Homo sapiens
  misc_feature (675)..(675): n is a, c, g, or t
gcgcactctttgtctggcgataatttagagagacactctttaatcatgtgggggcgaccattagtgttgttgtgaacacgtggaaccccacatgtggggagaagagattatttttcccactggttgttagttcgtggggttgaatacagacacgaacacacagacagtgccaaaacgggttttgtgggacaccagatagaccgttctccgtgttgtgatagagacgggaaacaacgtgggccacacggtgttttctcgggttatttccaggggttcaagatgaccaccaaagagcttgtgattttgtggccccctatcgaaaacaaccgttaaagtttttccagtgagccccccactttggtgtttgccaagatcacaacgagccgatgggcaataatacacccgggaattatttgggggggaacaccccaccattggagggcggaatatgttgtgtttcccccgcccccctttgcctttggtcggcctcgtataaaaggccacgcacgagaaactgataggccggcgaattgcccccctgggagaaagcaacccccccaagcaattcatcaaaccccacgggctcttgttgccgggggggcacacaggcactgggggagagcccacaaattgcacagataaaggcgccacagaaaaggggccaacccggaaagngcacacagagatctttgttcccccgggctctgggagagggaacacagccgttttccacaccgcacattgtcctcgccctctggggcgttccacaggccccctctcaccttgaagcgccctctcacaggggggagggcccccccccacaagagtgtgctctgttctctgtgtctcaagagacacagagctctgtgtccccacacccccacagggtgggcttatactggcccactattgtcacgggaatattgtgtgccttctgtggccttgtggcacacgccacactggagatcacccccacggtctccacagccaagaacacatggccccccccataagctcacgcaaagcctccctcttgtgctaatgtggaggctcaccacgccttcacacacagtggacacacccgctggttcttgggttgcctcggggttgaatcctcccctccctggcgctggtgggctcgttcttctggagaaagcactccctctgtccgcctgccacacgggcacagccccacgcccgccgtccgttccacggcgtcacacccaccacagctaagtgagatgcacagaacagtgaacgctgggggaaagggggcctgagagcccccgtggctgggttttgagacacactgtatacggttttttcgagcttaggcccctttggagggagaatccaataaataacccaaccccccactacccaaaaaaaataaaaa

SEQ ID NO: 611596 - DNA, 3502 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcaccggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagtgaggctgcagttggtccctcatcctccctcatgagcaagccggggaggaagcttgcagaagtgcccccttgtgtgcaacccacttccccttattattatagtgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaagaaagaatctcatttgcaaaatagcgaacatggtctgtgactcctctggcctgtttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttctcgc

SEQ ID NO: 611597 - DNA, 984 bp, Homo sapiens
  misc_feature (801)..(801): n is a, c, g, or t
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcaccgttgtcaagacacgatggtcatctttccctgcctctgcctgggggatgctctaaaaacaaagaggggctccgagaagaaatcgaagtcagggagagagccagcagcgcagccttccaggtgggcccccggcagagtgcagctctgctctcagctctggaggctccttgcctagactgccgactccccattgaggatcacgcagccagcaacctgnccagggggtcagcaaagagcaaaaaatgagggggaaagaacaaaaggaaagcaaatgccaaagctgaggagaaaggaaaagagaaatccaaacacgggaaaggaaattaaagaaagaaagttgacatgatgttacagaagaaaagggagaagggagaaaaaaatagagaaaagaaggaattat

SEQ ID NO: 611598 - DNA, 174 bp, Homo sapiens
ctcaaaagaatgaaaagaaaatagatgagaataagccagacgggtctcacccagctgcgttattcctacttcttttagccagcagagtgggataaagccgtctaagcttcaggaaagcctagtacactgcacatcttttttttggagatggagtctcactcggtcgcccaagct

SEQ ID NO: 611599 - DNA, 1193 bp, Homo sapiens
agaactgcaagtggagcaccaccaggccccttccttggactatcccgtcctgggcaacccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcaagggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataaaaa

SEQ ID NO: 611600 - DNA, 969 bp, Homo sapiens
tatcaaaaagtgaaagagtgagtttggaagcaactaattcataagaatgcaaaacatgttctttattccaacagaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcaagggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataaaaa

SEQ ID NO: 611601 - DNA, 396 bp, Homo sapiens
gtttctttctgaagatgtcaccacgatcaggacaagtgtaacctttaagctaaatgaaggcaagtgtagtttgaaaaatgctgagctgtttcccgagggtctgcgaccagcactactaggtatggaatcagatggttggtgtagggagcttgcctgcatgtgggaaggggcctgcagccagccgagctggaggtccatgggggccaggggctgtccagccgatccaagcacactgcagatggaactgaaccatccccaacttacagggactcagtcccaagaggaagaagagcataacctagcatgctgtatagttctggggtcacacttgcggggcttgcatatgcatggtatagttggcgagctatagggatcctctagttcgactggaacacc

SEQ ID NO: 611602 - DNA, 224 bp, Homo sapiens
aggctcaccgccgtgcggggactccacataaagtcgggacagatattcacaccagtgtgccctctgaatgtatgcacctgaaatgtgaatctgttcatagttttggaatttgctcgtatactttcagacttgctctactcacacctgatgtcaacttaaagccaaagtgtaggcccctggctgccgttggctctcccggatgaggtagctcccctcagccacaa

SEQ ID NO: 611603 - DNA, 201 bp, Homo sapiens
tttttttttttccccaaatggaaaaaaaaaccctggtggggtcccgaaggcttcccaaaccaactgttgggttttttatgtccctgtgggccagtcccccccccggggggaaactgtttgcggggcccatatgtatccctttaaagctaaaggaaacaggggccccccccccttatcctaataaaacccgtgttttcggga

SEQ ID NO: 611604 - DNA, 2229 bp, Homo sapiens
gtttctttctgaagatgtcaccacgatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcatgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcaagggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataaaaa

SEQ ID NO: 611605 - DNA, 1314 bp, Homo sapiens
gtttctttctgaagatgtcaccacgatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcatgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcaagggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataaaaa

SEQ ID NO: 611606 - DNA, 272 bp, Homo sapiens
ggaatctgcactcaactgcccacctgtctgtcagctatctttgactaggtatcttgagcttggttctgtgctctttccttgtgtactgacgaccagggccagctgatctagagcgctaattagaggctagagcgactgaaatggctgacaggagatgacactggggtccttccatctctgttgcccactctcttctgtcttcccatgggacgcgccactgggatccctctgccctgacctcctgaatacaagctgactgtcattgactgtga

SEQ ID NO: 611607 - DNA, 325 bp, Homo sapiens
ggggggggggggggggggggccccccccccgggtgggaaaaaaaaaaaaaagggggccccctttttttccttttaaagggggggttttttttttttgcccccaaacctttttgtccccccccggtttttttgggtttttttttgcccccccccccgttttgggccgggggggttggggggtttttttttaaaggggccctttttttaaccccgttttaaaaaaggcccccctttgggggttttccccccccttgggggggggcgggattggggggtttttttttttttttcccctttttttttttttacccccggttttgtgtga

SEQ ID NO: 611608 - DNA, 1559 bp, Homo sapiens
  misc_feature (1368)..(1369): n is a, c, g, or t
  misc_feature (1375)..(1375): n is a, c, g, or t
  misc_feature (1408)..(1408): n is a, c, g, or t
  misc_feature (1451)..(1451): n is a, c, g, or t
  misc_feature (1460)..(1460): n is a, c, g, or t
  misc_feature (1472)..(1472): n is a, c, g, or t
  misc_feature (1479)..(1480): n is a, c, g, or t
  misc_feature (1495)..(1495): n is a, c, g, or t
  misc_feature (1498)..(1498): n is a, c, g, or t
  misc_feature (1508)..(1508): n is a, c, g, or t
  misc_feature (1518)..(1518): n is a, c, g, or t
  misc_feature (1525)..(1525): n is a, c, g, or t
  misc_feature (1529)..(1529): n is a, c, g, or t
  misc_feature (1534)..(1534): n is a, c, g, or t
  misc_feature (1539)..(1539): n is a, c, g, or t
  misc_feature (1543)..(1543): n is a, c, g, or t
  misc_feature (1550)..(1550): n is a, c, g, or t
gtttctttctgaagatgtcaccacgatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcatgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgatgcctgaaataatgtcaaacaaacacccaagannaggagntagtatctctggggtggacccaaatgcctccanatggtctgtgagagagacagagagctcattaacccaaagcacnacgggaacntctctatcggantcaggannaagcaaagacactgngantccaataaanaggggggccnactccgnaaanaacanaacanaagnggggcgncaaaaaccc

SEQ ID NO: 611609 - DNA, 1561 bp, Homo sapiens
gtttctttctgaagatgtcaccacgatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcatgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgataagcacagcctgcagcacatggaaagagcgtctctgctttgaacagagccaacttcggagccagctggcaaactgctgacaagcacacatgctcagaaaggcaggcaagatgaggggaaaagacattgctgactcacaagtgccaaattttaacaggcatttggggacactgacaataggaggaaaagatgttttataaaatatattaaaagtgagcataaaaaa

SEQ ID NO: 611610 - DNA, 365 bp, Homo sapiens
cttgtccccccccccaaaaaaaaaagagagagactgcattcaaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaa

SEQ ID NO: 611611 - DNA, 1535 bp, Homo sapiens
gtttctttctgaagatgtcaccacgatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcatgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgatcagagagaagaagaaaagcaaagaagcctcagagaagtaaccggtaaggtaggaggaaaaccaaagagcatggtgtcctggaagctcagtgaagaactggatcaaggaggaggagtgaccagccaggtcaaagctactgatgcatcaaggaggatgaagaccaagaactggccgttgggatttaacacatgagtcattg

SEQ ID NO: 611612 - DNA, 419 bp, Homo sapiens
gggtaatgagcagttagtcgagcaaactgcatatcgtcatttggcagtcagtaatggaaacaaagccatcctcattcagtgaaatatactcctgaccaattgaacgatttacgtccgcaagaaacactggctgctttaaacactttaggtatttcagctttttctgaacggatgggtttaaatctaatggatggtcaaattcatttacagacggatcaattgaatcaggcgcttagccaaatagttcagcccgaagatattttaatttgtagctatgcacttgatggccatccagatcatgaggctgtcgggaaaacagtacaagcttttgccgaagctcggaacttactatgtttgcatgtattgatctgggcatggcattgggcagagccttttgacacgcgaattaactagtccaa

SEQ ID NO: 611613 - DNA, 834 bp, Homo sapiens
ggcaggactggaagttcctggccagccacttccctaaccgcactgaccagcaatgccagtacaggtggctgagagtttgaatccagaccttgtcaaggggccatggaccaaagaggaagaccaaaaagtcatcgagctggttaagaagtatggcacaaagcagtggacactgatgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatggtggccgggagggccgagaccaggtcgtggagagaagatctcatcgtgagaaaatctcatacacatcaaagggaagggtggacacaggaggcttctttgaggcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaaccagtgaagggaggaacttgcagcaggcaccacatcgaaggaacaggagcccatcggtacagatcttggacgcagggcgaacaccagagcctggaggaattcccgaagcgtgagggacaggaaagctccccaccagaaaagaggctgcttaaaagtgggtggtggggcagtaacctcctcatcccgtgggggttctagctctcggaagcctgggattgacgagcggacctgaagtggggtgaccgagca

SEQ ID NO: 611614 - DNA, 396 bp, Homo sapiens
tatacagtgatagtgagagggcccagcatggacagcagcgatagtgagagggacagcatggacagcagtgatagtgagagggaacagtatggtcagcagtgatagtgagagggcacagcatggacagcagtgatagtgagagggcccagcatgggcagcagtgatagtgagagggcccagcatgggcagcagtgatagtgagagggcccagcataggcagcagtgatagtgagagggcccaacatgggcagcagtgatagtgagagggcccagcatgggcagcagtgatagtgagagggcacagcatggacagcagtgatagtgagagggcccagcatgggcagcagtgatagtgagagggctcagcatggacagcagtgatagtgaggtcgacgc

SEQ ID NO: 611615 - DNA, 287 bp, Homo sapiens
ttaggcggggagcatagcctgctgaggaagagggccagtctatgtggtgcacaacagctatgtggaggacagagtccacaaatgaccctagacaggcagcagggtcccgggccatccgctcctcctgagtcgcgtggtcatgggaagaagggaggtaggtcccgagtcggcgaccccgttaccttccaccgctcttacctgaagagctccccagatttgttctttaagtgggtacaggaggtgtacagagcatacagataagcaaggatacagcgctctggaaggaa

SEQ ID NO: 611616 - DNA, 268 bp, Homo sapiens
attacgcggtgggtaacaaccagtagcaattagatatctcataccaatagatgatatagcgtctacgtgaacctaatacatctattatatttatatctatatacgatctatatacataatcagacagactatatattcgactgaacagtaaatgatacaccttagtcatccacctctctcctaggaggctgccccgtaactggttttgccaatggcatatcgagatcacaaaaacatagctggtaaagtgggtacgagctcgatcgta

SEQ ID NO: 611617 - DNA, 374 bp, Homo sapiens
cgtacactttaaatccaaaagctaggaaggcttcacgcttagtgcaggaaggccatttctaacagccaagacaggctgaaagcacaggcctcttacaccatacagccaagatgttaatgcaaaggaacagttcttgccggaaattacaagtgctactccagtgaacacatgaacgataagaaagcacgacagccttattgctgatccggagaacgtttcaattatctggatagaagatcaaaccagccacaacattccccttaagccaaagactaaccaaggcaagaccctagctctcttcaattctatgagggctgagaagtgcagaagaaaaactggaagcagcaaagtaggaacatccactctgcgaaagg

SEQ ID NO: 611618 - DNA, 588 bp, Homo sapiens
  misc_feature (12)..(12): n is a, c, g, or t
  misc_feature (15)..(15): n is a, c, g, or t
  misc_feature (49)..(49): n is a, c, g, or t
  misc_feature (54)..(54): n is a, c, g, or t
  misc_feature (60)..(60): n is a, c, g, or t
  misc_feature (100)..(100): n is a, c, g, or t
  misc_feature (102)..(102): n is a, c, g, or t
agaatttttttnaanccttgggaaggtcaaaggttcaaattaacccaantattngtcccnttggcattcaaacttgggtaaaaaaaaccgggcccctttntnccaaataaaaaaagtttttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggtattcagctctttttcttgggtcaaaaaatttatctttagcaggaaatactggttgcagcttgttggttgtggtggtacaacttctaacctgagatactagctgtcgaatcacaagttttaccgtttttgttttgtgaaatttgcttatgtttcctatcttggcatcagtgcctgatccagagaagaatatactcaaatgtttgtggactgtatgaatgcatgtcggtcaaatgttatcaggattgtggggccattttaatacaaaataaaccttaaaattcaaaaaaaa

SEQ ID NO: 611619 - DNA, 1043 bp, Homo sapiens
  misc_feature (322)..(322): n is a, c, g, or t
tatttactatcagcatccgtcaggcactatttacttcattcagtccttagaacgataggtctcttagcaagtcccccttaaggcaagatcactggcgctccaattacctcacgcttgcctctgcgcatttcttcaaacgcgtataaccataatatacgtcactagttctggtgttagccctgaagactgttactcgtaacaaaaatgaaagaattgagtagtatcttgagcgtcagccattgtatcgtatcacatctgaggcgtggcatgcccgtacacctcgattcattcccgtgtatcgctcccgaggctgtcaagtacnttcaattcccttttttttgttttttttgggaaacgtgggttcctcgccctctgtgttgcgcccgaggcctgtggagctgtgcagttgtgggcggggttctcccggaatctcagctgtggcgaaaccctctcgcgaacctctcacgcggggtttttcaaagccactttctctgcgtgtgcacttcaggccctttcccgccagtatagggcgtggggatgtatacaccagggcgcgcgtatgtggacacaacacaaaacacccgcgggacatataaatattgcggtggataatttttcacagtcttagcaagacacgcggcgggttttcccaccccaagttgtttggtggccataagcgcccgggtcttctctcagagaaactctctctgttgagacccctccagaagtgttgatctccccgcccgttgcacttttggcgccctccccaaagacaagtgtcggctgttgggcagcaaataccaacgtaggggggccattgtggaacgtccacaagcgccggaacacccaatgttgggagcgcacttccatcatgggcggaacttattaaacaacgtggccccaaaacacttaaacatttgtcgtccggtgggtctccataagctcgggcacatttcaaaacgatggtatggaggaaaattttttcccgaagaggctccctctcccctctatttattttaaaaaccaaatttggggagaactca

SEQ ID NO: 611620 - DNA, 590 bp, Homo sapiens
ttaagcgatgtcagaaatctagattgtaatgtgaaggaaactttcacacatttgccactataaattttgttctttaacaaaatgctctgtggggaaatgaaacttgtcagtgagccagcttctacctgtttatgacttctcataaccttagcacctcagaaacttagcagtattgctggctaacagaatttttaatccgtgttccaatacctactaacaatcatgtctttatagaaagggacttttttgatcttgaaatttatgaattcggggcattgtaatcatagaatttactagagtgcccaatgcattaggagctgtttttgtgatttccttccacctgtattttgtgtttgccatcttagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctg

SEQ ID NO: 611621 - DNA, 416 bp, Homo sapiens
acgacccagtcgcggaagcgagcgaccttgcgggcatgcctgcggttttccgcataggcgagccaataggcagtgccctcatcggccacatgggtgaagggacgcacgaggcgaccgctcgcgagctcggaactccagagcatccgggtcatcagcgcaagtccatgccccgccattgccgcctggccttcgcttgcctgcgagtccatgcgaatcccgccgcgcctggcatcgtccatgtcctccaccccggcactccggaaccatatcggccaccatcgatcctgcgggctgatcctccgcatgtcccgcgcctcgcggacgtccagcggcaaggggcgcccctcgagtagcgccgggctgcacatcggcgtgaaggacaccatggccagatgctcggccttcaggcccggcca

SEQ ID NO: 611622 - DNA, 517 bp, Homo sapiens
ttaagcgatgtcagaaatctagattgtaatgtgaaggaaactttcacacatttgccactataaattttgttctttaacaaaatgctctgtggggaaatgaaacttgtcagtgagccagcttctacctgtttatgacttctcataaccttagcacctcagaaacttagcagtattgctggctaacagaatttttaatccgtgttccaatacctactaacaatcatgtctttatagaaagggacttttttgatcttgaaatttatgaattcggggcattgtaatcatagaatttactagagtgcccaatgcattaggagctgtttttgtgatttccttccacctgtattttgtgtttgccatcttagcgctggtcagactacgtggagcgatacatgaattcagatactacctcgcctgagcttcgtgaacatctagcacagaaaccagtatttctccccaggtgagtgagccatgtcatctgtcagcagtccatactgtgcatgattgaggaatggag

SEQ ID NO: 611623 - DNA, 176 bp, Homo sapiens
  misc_feature (40)..(40): n is a, c, g, or t
ctgattagaggatcccgtgcagatacaacagtcagaggcnagaaagctgttgctgaaaaggtggtctatgttgggtctgatccctgccgtcctgctgactattcctgactttcatctttggccacgtcaggaggcagatgaagattatatttgtgaccgttctacccaattgactt

SEQ ID NO: 611624 - DNA, 581 bp, Homo sapiens
gcggcggagtcggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtaagctggagccaaccaagggactagaatgagggaagagaaatagtggttttaggcaattataaaactttttttaatactgtgttagatattaaaaattgttgagtatgtgtaaggt

SEQ ID NO: 611625 - DNA, 3853 bp, Homo sapiens
gcggcggagtcggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagcacgctgggccgggggccgggcgggagcctggtggcgggtaacgccggactcgagggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagccctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctg

SEQ ID NO: 611626 - DNA, 667 bp, Homo sapiens
  misc_feature (1)..(1): n is a, c, g, or t
  misc_feature (23)..(23): n is a, c, g, or t
  misc_feature (86)..(86): n is a, c, g, or t
  misc_feature (165)..(165): n is a, c, g, or t
  misc_feature (182)..(182): n is a, c, g, or t
  misc_feature (202)..(202): n is a, c, g, or t
  misc_feature (208)..(208): n is a, c, g, or t
  misc_feature (211)..(211): n is a, c, g, or t
  misc_feature (518)..(518): n is a, c, g, or t
ntgctcctctggactccccaagncaggtggcctccacccacgttctcccgtcctggggtgaggcttcctgtggcccagcccgcccnattcacctgtggatttgtgcgagatgcagcctcagaaggaacaaggccccagagggaggtcacctgggggcagctggtnccgggtcttcacccagnccacgctgggtcccctctgnaagggnaangccttttcgggtctcccaccagccactgcttcctccttggcctcggccttccacccctcgtcttccctccctcggggccctgatgcgtgcgcccccgcccggcctcggctctttactccattcacagccgtgcacgcgctcaatgccaccagggtgcgagatgccagctctggagttctcggttgttgtaggaggttgggtgttttcaaatggtaaagatgttttgagcaaataaatttgcttgatacagagatagggaggctgaggcgggtggattgtgaggtcaggagtttaagaccagcctggncaagatggtgaaaccccgtctctactaaaaatacaaaaattagcctggcatggtgacgggcacctgtaatcccagctactcaggctgaggcagagaattgcttgaacccaggtggcggatgttgcaataagccgaaatcgtgcaactac

SEQ ID NO: 611627 - DNA, 176 bp, Homo sapiens
tgtcaggtattctgcaggtgctaagcctggaccctaaccagctcttcatgctgcagccgcggagccaagaggtgtcctcccccacgaggctgccccagccctgttccatgcggcacctcgtgtcccactacctggacatcgccagcgtgcatcgccgcttccattcttcgagactc

SEQ ID NO: 611628 - DNA, 507 bp, Homo sapiens
ggccacatcattaaaaagtccaggaagtaaagtgacttcaggcatggctgcatccaggtgctcacatgaacacattaagaatctgctctgctttcccttgggttagcttccttctcaggcactctccccacatggttatacaccttctgcagtccatatttgcatctcactaccttatcatccctagcacaaagagcactgttttcctaatagttccaataagtgttcaaggcatgactcctgacctgccttaggttatctgccaactcctgagccagggagtggaaacattctcacccagaccacaggaaatgaaggtaagggaatgaggggtttcccacaaagagatgccagaaagacaaaaaaagtatgtccactatagtcttattacaagagtcatcagtagtcatcaccctcttccttcagctaaatcacatgaaaggtacagtttctgaagtggaacttaaagtttgaaagtgtaaaagatatctgtaatgttggtcagtg

SEQ ID NO: 611629 - DNA, 3564 bp, Homo sapiens
tctagaggatcgaattcgcggccgcgtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagccctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctg

SEQ ID NO: 611630 - DNA, 326 bp, Homo sapiens
  misc_feature (177)..(177): n is a, c, g, or t
caatttcaaaactcattattggtttactcagggattcaatttattcctggttcagtcttaggaggttgggtgttttcaaatggtaaagatgttttgagcaaataaatttgcttgatacagagatagggaggctgaggcgggtggattgtgaggtcaggagtttaagaccagcctggncaagatggtgaaaccccgtctctactaaaaatacaaaaattagcctggcatggtgacgggcacctgtaatcccagctactcaggctgaggcagagaattgcttgaacccaggtggcggatgttgcaataagccgaaatcgtgcaactac

SEQ ID NO: 611631 - DNA, 682 bp, Homo sapiens
gatttagatgctctacccaaaggtttggtcctgtaagagttccttgggaatgagaaaggattcgccaagatgttctggaaaagggttgtagacgaagcaagagtctttcggtttcgtgtggtctgtaaactcgtcagatcgctaagttttgcatcttagttgtgaaggattccaagaggacgaagagaagccaaattagcagagttgtaaaactcacagaggcaggttagcatgggaactaatcacctttcttttctagaaagattgtaaacactggccgggcgctgagaaatcctgtcctgtaatcccagggttattcgggaggctaggtgcgtgggctggactcacgctgagtatcaccatggccaatgtggtgaaaccccgtctctactaaaatacaaaaattagccaggtgtggtggtgggcacttgtaattccagctactcgggaggctgaggcaggagaatcgcttgaacccgggaggcagaggttgcagtgagctgagatcgtgccactgcatctccagcctgggcaacaagagtgagactccatcacaaaaaaacagaatcttataggacgaaaacacgttgtgggggacatgggcccttagaaaagtttttataaaaaccatttcgttggggccgcgcggggcccacataagggtatggagaacaatggggca

SEQ ID NO: 611632 - DNA, 2399 bp, Homo sapiens
tctagaggatcgaattcgcggccgcgtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggtacatgagcaaatgtgcccttagtgctttagtgtacttcactaccggttcagtgtctcattaaataaggctctcattttcaacctggttgtcccatgagacctctctttctccccaaccctggttgttggaattcaggtgcagaatggaacttcttttgggggtcctgtgtaaccaacattagagaacaaatcttgtaagttcatggtggaaggctctgtgtgtatgtttgggggagtattttaaaatacaaaaa

SEQ ID NO: 611633 - DNA, 3788 bp, Homo sapiens
gcggcggagtcggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagccctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctg

SEQ ID NO: 611634 - DNA, 227 bp, Homo sapiens
tagacatcagatagaaagtgagacatggtgtcctacggcattggactttccaaccctgacagacccgcaagacaaaacaacatggattctatgaccagacctctagtagaaatcccagtaacactcagccctgtacactgtgaataccactgcacagcatcagcaggctgctgtgccacacagtcctcaccaagaccacagactctgtcttccacaagacacgattc

SEQ ID NO: 611635 - DNA, 3040 bp, Homo sapiens
tgtactggacgaggtgcggcgcaagctctacgggatgcccactgacttcggttctgtgtcaaggtgaagacctggccaggcctggcccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtgcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaagaagaaacccaaactgctcaatctgaaggattcttctatggcagatgccagcaaacatggtggtggaacagaatcgttattttttgataaggtccgaaaggctcttcggagtgcagaagcctacgaaaatttcctacgctgtcttgttatttttaaccaggaggtgatctctcgtgctgagcttgtgcaactagtctctcctttcctggggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggttttaaatgatacctgggtttccttcccttcgtggtctgaggactctacctttgtgagttccaagaagactcaatatgaagaacatatttatcgttgtgaagatgaacgctttgagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagccctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctg

SEQ ID NO: 611636 - DNA, 103 bp, Homo sapiens
tcaagcttctaacgatgtacggggacatgtaaggagctgagttcttaaagactgaagacaggctattctctggagaaaaataaaatggaaattgtacttaaaa

SEQ ID NO: 611637 - DNA, 161 bp, Homo sapiens
  misc_feature (40)..(40): n is a, c, g, or t
  misc_feature (43)..(43): n is a, c, g, or t
gtgtgtttgggggtcccaggcctgtgtaatgtttttcccnggnggggggggccccccaccccattcttttccccaaaaggggtgggatgggcccccatgaactgcaacagcatgttgaggtgtccatgttgtttgcctttgtaaaaaaaaacagcctttga

SEQ ID NO: 611638 - DNA, 1375 bp, Homo sapiens
cagtcccaggtcctaagtttttgattagaaaaatatagacactgtggttgataatgggatgtatggctgatgtggtcttgtagacatgttgtcgctgtagacatctcacagaatacttttgtgtctctgtcccatcagaggcaagagcaggctacggaggagaatgctggtgtacctgttggcccacacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagccctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaaccagtatttctccccaggaatctacggcggatccggaagtgtcaacgtggtcgagagcagcaggaaaaggaagggaaggaaggaaacagcaagaagaccatggagaatgtggatagtctggataagctggagtgtagattcaagctg

SEQ ID NO: 611639 - DNA, 236 bp, Homo sapiens
cacatgatagaagtctgtaaatacatatggtgacaacgcccactacccctcctgagatcaccatcagatggctagcagaccactgagaacgtgggcagtgtccaaatatcctgtactgtaaaggactaaaaggcgtaagctctgacgacatgacaaggacggaaacattccatgatgtctccatgccaggcatctgatccccactacgaccatcccagacacagtccccagttccc

SEQ ID NO: 611640 - DNA, 273 bp, Homo sapiens
agctcgccggcgggcccgtccatgaatgaataggacccaccttccaccctgactggaacctgtcctctccggtcctctcctacgtgttcacaaacaccgagtcactgaccctcaaaaaaaaaaaaaaaaaaaaaactctgtcggagtgagacagtgggtccgacctcacaacaccacactagtgtcgagtgacgtcggaacttgaggacccgagttcgataggagggtggagtcggaggacacatcgaccctgatatctgcggattaatacct

SEQ ID NO: 611641 - DNA, 108 bp, Homo sapiens
actctacccaagagtgatataacaggtccgatctcacgtcaccgataagtgtctacgcttgtatcatgtgacgtcagaggttgaggatcggagttcatcaggaggaca

SEQ ID NO: 611642 - DNA, 937 bp, Homo sapiens
  misc_feature (398)..(398): n is a, c, g, or t
cctagaagccaatagatgggaacggcacaataagatctcatatcctgattgtcctcatagcacacgtatattcgggcaagtccaccactactggccatctgatctataatagtgcgtgtgtgcatcgacaaaagaagccatgtgaaacaatttgagaaggacgctgtgtgagcatggcgaaagggctccttcaagtatgcctggctcttggataaactgtaaagactgacgcgtaaacggtggtatcagccatctgcaatatcctccgttggtgggaagagtatcttggagatcgcagcaaggtagcatagtgtagagcatatcgatttggagtggccgccaggcacgagcacgagacgtattatcaataacaccatgagttacaaggcacatctcangagttgaactgttgactgctcaactgtagttgtacgtcgtgctgagtggttgcgctgacattttggcatagtctgggtatcctcgcaatagcaatgaggtctagcacgccgagaaggctatgacccagttcgtggtcgttacacgacatgggcctgtgaaaccatacataactcgtcggggtgtgtaactattaatggcaattcccacctgtgaagccagcctgtacagtgccagtaatgagcatagtgtaggcaaagttgcgttcaaggtaagctcaggacgaacgttagcattaacgaacaattgggctacaaaccccagacaacagtacgcactttggtgcgcaatattcctaggtatggaactggttgaacaacattgctaggatgccatagtgtctaactatgcctatggattcaacgcggatggcgaaagtcgaccccgtaaggatggcaaatgccaggtgtgaaccacagctgcttgatggctctggacttgcatactaacaacaattcgttcaattgacaagcacttgtgc

SEQ ID NO: 611643 - DNA, 583 bp, Homo sapiens
  misc_feature (141)..(141): n is a, c, g, or t
  misc_feature (185)..(185): n is a, c, g, or t
tccgattacaaaacaggcccctctaaagggatttaaagcaccgccaggcccttgtgattttaaacctggggctcgtagtgtctcgtggcagaccagttttggtgtgtgattatataactgtgtgtgtgaaggttattaggnggctatagagccatatatgtgtggggtatatctctatatatctncccgagtgtgtgtggcgtctccttatagcctatatgtgtggtgtgtgttctcagaattattgttatacaacgccccctttctcgatagctcatttttggtgctcacacgggatttttttacaactcaggtgagtttaagcttaatgggggagggggtgactctaaaacactctttacgccggctctctatggactggggtaaactcgtgtgcaccgcggtggctggcacgaatttgcaccacaccctggggttagttatagcttaagtttaaacttccgttatatggctaaagaggttaacccactgctgttccccgtgggggtgtggctaaggctaaagcgtttggagctgctattgctgcgtgcttgaatgcttgcccctttggaccggggggatt

SEQ ID NO: 611644 - DNA, 118 bp, Homo sapiens
cccgcggccgacgagaggccacgccgggccggggttggacgacaccaagatgacccccaagctggacttaccaacttgaccagaaacctccttcctctggttcaccaacccatgcaag

SEQ ID NO: 611645 - DNA, 238 bp, Homo sapiens
ggtgcgacggggcatgcctgtaatcccagcacttcgggaggctgaggtgggcgggtcatgaggtcaggagatgaagactgtgttggcccacagagtagagaccactcacacaatgggagaaaatatttgcaaactacgcatctgacaaaggactagtatccagaatctacaaggactcaacaaatcagcaataaaaaccccaaataatcccattaaaaagtgggcaaagggtcgacgc

SEQ ID NO: 611646 - DNA, 941 bp, Homo sapiens
gctctgctccctgccagaccggccagctgtgtgcaacccagcggggcttgcagcagagctggatggggccacccgttcttcctcatttcccacccctggtgtgggatttggggggctcctgggcagagtgcgaagctccggaccgagtacagtggatccccagtgactgctcgggggggtccgctgcgttggaggatgccgacaggcacagtcagtgttccctgtgccttggagctctccttccctctccatgggccaagactggggcgacgccgtggtacactaaggcgtggggacggctgtgcagacatgctagccagagggatggggcaccaggcgtgtgctgcttggatgctgctgtccggagcgtgcaaggctggaaaacaagtaacttccattgctgggatcccgagaatgaccttccaatgtcaccccggctgtccccacttattgagtacggtcaggaagtgacggaccctgtgacgaacgatcggcatggggttcggcctggcccgcgggaggctgtgtggacgtgctgttgacagacgggacggagtggccctggtgacaaacgacaagttcgttggaattgagttaaggtggttccggtggaaaagcggagtggaaggctgagttcccccttcatcactctcagagcgcgcttaccggaagaacatcgccccggcccctgggggggccaggactgcgtgatggggcccccttgaaagacttcactggcctcattggaggagaaggacctggcttcctggagaagctgtgtgatggtcctttgacgtggtgcgcaagggagagtggacgcggcctcaggaagacagtggatgtgatgtgactgctgaacgcgatgtctaagcggcagaacattgaataatatgccggaggacatgccataccctatagacacagaactatcggataggggg

SEQ ID NO: 611647 - DNA, 924 bp, Homo sapiens
  misc_feature (77)..(77): n is a, c, g, or t
  misc_feature (95)..(95): n is a, c, g, or t
  misc_feature (149)..(149): n is a, c, g, or t
  misc_feature (160)..(160): n is a, c, g, or t
  misc_feature (210)..(210): n is a, c, g, or t
  misc_feature (217)..(217): n is a, c, g, or t
  misc_feature (244)..(244): n is a, c, g, or t
  misc_feature (312)..(312): n is a, c, g, or t
  misc_feature (315)..(315): n is a, c, g, or t
  misc_feature (334)..(334): n is a, c, g, or t
  misc_feature (340)..(341): n is a, c, g, or t
  misc_feature (357)..(357): n is a, c, g, or t
  misc_feature (359)..(360): n is a, c, g, or t
gaaagttattaagaggagaaggggagacttacaatgatgattcaaatgaaggaaactaaaaagtaactgaagcaagncagaggaaaaagcagtantcacttgagcacatcccaaaagaataacatttcaaatgtaactagaaaaaagtntgctgaagttngcaatacagaaataattattaagatagctttaaagccctgctcagctttngaatgtngggaattgacccagaggtggctgtaanctaagatggttccttcagtaatgaccattttttctttttcaagatgatgattattccccaccttctanganacaaagaccaacgagccancacagnnaccagtcccagaaccngnnaatgctggggaaacggaaaatgagggagtacaactctggacctcacaatccagtggaggagacgcaattcatctgcctctgtacctctgggcacgcctcatgccaagtgcatctgtggaaagagggccatgcacctgggactacaaatagtaggagaaagcttgacaggctcaggtctgacaggacagaacatctacagtaagtcatactgagtacaaggtgggagacaaggacagaaactaccgaaggctcctcaagagaaagaagaccgaaacatgacacagaaaaggtgaacacagacaacaacgaaaaaaagaatgcccgacacaaaatactagaaataacatactacagcaacataaactattaacccatacaaaaaaggctcctagacattacaaggaatatagaaacgaataaatatgagccagaaatccaagaataaactttgaaaacacgatatattggaacaaacctcataggtaaaatcaggaaatgcttaccagtataccgaggacatagcatacggccaatgatagaaaaagagcgaggaaatctaaaaac

SEQ ID NO: 611648 - DNA, 873 bp, Homo sapiens
  misc_feature (348)..(348): n is a, c, g, or t
  misc_feature (361)..(361): n is a, c, g, or t
  misc_feature (403)..(403): n is a, c, g, or t
  misc_feature (431)..(431): n is a, c, g, or t
  misc_feature (435)..(435): n is a, c, g, or t
  misc_feature (439)..(439): n is a, c, g, or t
  misc_feature (446)..(446): n is a, c, g, or t
  misc_feature (484)..(484): n is a, c, g, or t
  misc_feature (500)..(500): n is a, c, g, or t
  misc_feature (503)..(503): n is a, c, g, or t
  misc_feature (508)..(508): n is a, c, g, or t
gctggccaagtgtcgttcgccaagtacagacttctggaggactgtggactgagtgcatagcacagctcagtcctgagcagcaggccgccattcaggagctcctgaactctgcgtgaagggccttaagtgtcacccaccagaaaactaattccaaataaagcgcttaccctttccttgaggtttcttgggtgtgtgtttgtgagcaaaagagatcggtagtgtggtgtgtaggccatccttctggagagccacaagcaggaagagcagcgctgtgttgcagaatggagtttccatggatttctaccagaccactgaaggagttcctggaagccctgcggtagctagcantgaagactatttnctatggtataacccgcccacctgaaggggaaagggaaatcanattatttttctcgtagacataaggaaanttangganaaacagntttaagaacagttactcagcgtagatgtgtgtcacacnaaattgtctgattccngtntcatngtgaactcgcgcagtgtcgagtctttctgtagggtacgaacagaagcctcctacccagcaaaccagtagacccacaaacgttgaccacacaccactgatgacagacaacaagcatgaagatggcctactttgactgtcactttggttctttttcccagaaggcttaatacagtgactcagtccgggaagctttccagccttccagccccttgaatgtgaacgtgtcattggcatgtctggcagctagtcctctcattcactcctcaaataaacaacattgaataccaaacagcaggcttgtgtcacaaactcagtactgtctggccttggattccatcccatgtccccaatatcacgcactgatc

SEQ ID NO: 611649 - DNA, 194 bp, Homo sapiens
taggcagatcacctgaggtcaggagtttaggaccagcctggccaatatggtgaaacccggtctctactaaaaatacaaagattggctgggtgtggtggcgggcgcctgtaatcccagctgctcgggaggctgagtgtggcaggagccagggggcacatgcaagcctgcgcagcccacccagacaaagggaaaca

SEQ ID NO: 611650 - DNA, 644 bp, Homo sapiens
  misc_feature (485)..(485): n is a, c, g, or t
  misc_feature (644)..(644): n is a, c, g, or t
gtactaggaaactgatgggcacttaagtaaattgacttgaagatggccaaccggatcaagacaatgacttgctgaaagcactgtgcgactgacgtatgataggaacagccgttactgttctgatattgcatctatatatactatatctgagcctgattgctatatgcacagtgatggtctcgtatgatgtgcattatccagccaatctttctattatctggctacacaatgcggatgaggatcaatcactctctaggttcactagactctccagctacatgtgcccttcctgacactgcggtgaagccactgcctcgattcaatgtgagcagcagagatgactgccgcatcgcattattgaatatatctggggaatagcctagctttccatagaataacctgtaattacagattggctatggtctaagtggtcaagaggtactgtggaatatgtatgatggttatgatgcgcatgtgctctgtantaggctacatggactgctatatcggagtaattggagcaattcagcctacacaggcgacatggatatgacagttcctatgagaggaccttgagacttgagagtcattaatggatatactatgagataggacgaaggatgtgactgtcttttgggcccctn

SEQ ID NO: 611651 - DNA, 211 bp, Homo sapiens
caagcagggcattttcaggtctgttggtcgtcaggccagcatggcagctggttatacattcatgcctcatcagggcatcagtcacaaggcacggggtcaggctcatggtgttttggtccagggagagttgcagcacatgcagtgtgcaggcggtcattcatcacccatcagccggccttcagatatttcaagcagtcactggcggccacag

SEQ ID NO: 611652 - DNA, 110 bp, Homo sapiens
ggcggcccagccccggggtgggaagctgcgccgctgccccggaggccagctcagaacggacgtgccgtcttccaacgcctcctgccccttgcccattaataatcggattt

SEQ ID NO: 611653 - DNA, 500 bp, Homo sapiens
cgtgcgccaaactctcgtactactgcgtctttatcagtgtgggctactccccaaacaccacacacgcacgagatacccttatcgccgcgcggctgcgcttgaatggtgttgtagtcgggaacgcacgttaggcgcgcggtgccgagtagtggtgcgtctcgcatcgtcctaccactcgcccacacgatcaaataacataaccgcagtgtctcgtcgcttacctcgtattcagatcgtagcgctgcctgtgtagtataattaatatgaagagtggttttgtaatagtatgtcaagcggtattctctcatactgggtattgcggtcgaatgcatggagataaagggtagagcctcgcttcctactcaccacactccaacagctcggcccgcaccactgagcgtctttgtcatccccacctctttctttctcttcaccactcccctgttctaactagttacctcccacaaccgtgactctcacgaaatttatcgccgaccggc

SEQ ID NO: 611654 - DNA, 423 bp, Homo sapiens
atgaaggattactcaaaaggacacctagataattaagcagtaattcgcccattgctccctcccccagccctggcaaccacccatctgctttctgtctctacggatcttcctattccagatatttcatatgctgtaaatggaatcatataatgtgtgccctttcgtgactggcttctctcatttattcaaggttcgtccaagttgtagcatatagcaatacttcattcctttttatggctgaatcatatttcattatacagacacatcacattttatcccttcatcagctgataagacatttgggatatttccactttttagctattgtaaaaagtgttgctatgaacacatgtgtataagttgcttaataattttttttgagacggagtctctgtccccccggcttgaggtaatccgtgaggg

SEQ ID NO: 611655 - DNA, 363 bp, Homo sapiens
aggccagcgagttcccaattttgatctgcacgggttccaagggcatactggcccgtccttagaaaaccagaatcaagatccgccccgtgcgtatccacgtcagcttcatcgaccgcgtcggcatcacccaggaagtcctggccttgctcggtgggcgcaatctcaatctggatgcggtggagatggtgccgcccaatgtctatatcgatgcgccgaccctcagcgccgaagtgctcgaagaactgcgcgacgcgtagttcagcgtgcacggcgtgcaagcggtaaaggtcgtcgacatccttccgggccagcgtcgccacttgcaactcgacgccctgctggcggccatggcgtccgtagcgg

SEQ ID NO: 611656 - DNA, 178 bp, Homo sapiens
  misc_feature (36)..(36): n is a, c, g, or t
  misc_feature (45)..(45): n is a, c, g, or t
  misc_feature (57)..(57): n is a, c, g, or t
  misc_feature (79)..(79): n is a, c, g, or t
cattgggcttttttccaagccatcatctttctcttntccttcttntgatggattatntgaatgcttaggagatgaaagntcaattccatgctcctctttcaggttgggctctttgttttctttctttacccgaggcttccgcttctttaatttggcctcttccccacctgtctcagcc

SEQ ID NO: 611657 - DNA, 693 bp, Homo sapiens
  misc_feature (509)..(509): n is a, c, g, or t
gctcgacattcagaaaatgacgctttgatgttagctttgaagcagggtattcccagcatcacatttagtcagaaatatggaaggtatatgttaacatgatttacatatcctactctggtggagtctaaaggtaaataacagaaataagcaaggagccatgcagcaaggcaaattcacctttgtttgttgacacaaacagtgaagcttattttgggaataatgactgcatatgttcaggaaaattgggctcatgagtctactgtcagaacatttttcagaaaagagaaaaatgaatgtactgctgggagacagcagggaggggttcttttattatatacacaatctcttcttatgagaacaaataccaacaatctattattgttcccttaattaataaatcattactgtgggctgggcagagtggttcatgccaggaatcccaccactttgggaggcccaggcaggaggatcgcttgagtccaggaggagtttgagatcagcctggggancagagagagatcccatctcaacaaaaataaataaaaattaggtaggcatggtggcgtgtgcctgtagtcctagctgcttggaaagctgaggcaggaggattgcttgagccaaggaatttgagcttatggtgaggtatgatctcactgctgtattccagcctgcatgataaagtgaaacaatctc

SEQ ID NO: 611658 - DNA, 271 bp, Homo sapiens
acatactggccaggtcgtgggtctccaactcctgaccttgtgatctacccaccttgggctcccgaagtgctaggattacaggcatgagccattgcgccagcaaagggtagcttctttagaaaacagaggcgagtgggtctttgtgtgacttcaagacagattcggtgtggtgtggaaaccacagaaatctgggccgtgccttctccctggctttggaggaagccccataacacaggggctctacggcctgagggcacagatttggcagtcg

SEQ ID NO: 611659 - DNA, 151 bp, Homo sapiens
ctagtcgtgcatgattgtaggctccccaaagtccaataaagctctttctttgttaaatgccccgtcttgggtatatctttatcagcagcgtgaaaacggactaatacactgggcatggtggtgcacgcctgtaattccagcgacagcgagg

SEQ ID NO: 611660 - DNA, 227 bp, Homo sapiens
tttttcaaaaaaaaaaaaaaaaaaaaaggaataatggcctttggaagtcagcctggtgccctacagtggcaaagccttatgcagggtgggccctgtaccccagcatcaacaacatttcctaaatggtacctgtaattctcccctcccccattttggtagtcagcataaaaaacctggattttaaaaaatccctcctttggctgcatccttcccccattactttttca

SEQ ID NO: 611661 - DNA, 446 bp, Homo sapiens
ttactcttcccctgcagggacggagatctcacaggcttaccctgggacagtcctcgtgatctccaaacactctgggccttacatagagaaggagaggtagacgcagtcaatatagctttatggaaatacatactaatttgtctgtttggctttttcagctctctaaaaatgttttggtacagtaccatttcttccactgttggctttagttttagtatctgtgttataataggggtccatgtcagaagaagtcacagcagtcttgaataactggaagacttctgccagattgcctaatgtcagtttgttttctggcactgcttcttctacttctttctcatcatctggcacttgtttggaagcattcatctcctgctaagctttgtttcctaattaaaatcttctgccactgccatagctactgctgttgcatgaacacagggtac

SEQ ID NO: 611662 - DNA, 1154 bp, Homo sapiens
  misc_feature (1154)..(1154): n is a, c, g, or t
ccgctctcacccgggacccccagttccagaagctgcaggagtggtaccgcgagcaccggtccgagactgaacctgcgccgactcttcgatgccaacaaggaccgcttcaaccgacgttcagaccttgtacacctcgaatcacctaactcttgggcatatcctggtggattactccgaagaacctggtgacggaggacgtgatgcggatgctggtggactttggccaagtccaggggcgtggaggccgcccgggagcgggatgttcaatggtgagaagatcaactgacaccgagggtcgagccgtgctgcgacgtggctctgcggaaccggtcaaacacacccatcctggtagacggcaaggatgtgatgccagaggtcaacaaggttctggactaagatgacagtctttgctgccagcgtgtccggaggcggtgactggacaggggtacacaggcaagagcatcacggacgtcatcaacattggcgattggcggctccgacctgggaccccatcatggtgactgaagcccgttaagccatactcgttcaggaggtccccgggtctggtatgtctccaagattgatggaactcacattggcaaaacccgtggcccagcgtggaaccccggagtctcccgtgtgcatcatgcctccaagaactgtactacccagggagaccatcacgagtgctgagacggggaaggaggggtttgtccaagacgggcaaggatccttactggcagggcgcaagccctttgtttgccccgtctactaacacaaccacagtgacggagctctggcggactatgacgctcaaaaaatgtcgcaataccggacaggagggggaggacgcaacaacaaagggggcaacgaatcataggacccggacacggaggtgaacacacaccgagacagggctccaggcggcacagagagtgccacagaacgtacaaccacgtgcttaaaacacccccacgaagctactcgcggcaagtacaaacacatggggtgagaccacggtgtaagcaagcaccacggaggaatacgagccggacggcaaacactacccacgacaagcatgcgatcgagtagccacaccaagacatccacggacgcccacgctaccgcccgcggtcgtgacgcgacagacgagn

SEQ ID NO: 611663 - DNA, 585 bp, Homo sapiens
cagctgtataacaaaaccaatttttttttcctcatgggctataataaaacaacattaatgtaacgtcatttcacttaaagttgcagtttccaggaacttatgacaacattaaatgaggacttgctgtatgctgaaattaagaacgcctttcatcgaaaggtactgcaaagagtgaaaagacacaccaccaactgggaaaatgtcactgcaacacagaactgaccaagaattcatgtccagaatatataaagaccatcaccaacaagtcaataaggaaagaaaacaccaaaataagccaaaatgaacaaaggaagaaacacgaaaagatgcttcacttcatcagttatcacaaaagtgcaaattaaagccacaaggagatactactttttacccccagagtggcagacaatatcaagagttcttgagatgtgttacagcaattaaagaatggcaataaaactaaagatatatatatgtaattgtcttcaaaaagagttccttcttaggctgcgcgcggtggctcaagcctgtaatcccagcacttcgggaggctgacgcgggtggatcatgaggacagccgacacc

SEQ ID NO: 611664 - DNA, 193 bp, Homo sapiens
  misc_feature (93)..(93): n is a, c, g, or t
  misc_feature (109)..(109): n is a, c, g, or t
  misc_feature (141)..(141): n is a, c, g, or t
  misc_feature (168)..(168): n is a, c, g, or t
tctgtgaggacctggaaaggaatgaccggctctcaggagcgaccctaccttcatgtcgcccgagctgagagacatccctgttgaaggggagtncggaggaggggaagcnggcagaagcgaggagtagagatggaggacctngagaggaattacggctcggccaagagnttagtttcatgttttccaccctcaa

SEQ ID NO: 611665 - DNA, 296 bp, Homo sapiens
atagtttatctcagtgctacagaagagggctaatttggctcagatgagataacagctgcaggagccaccacagcctggcttacaggccagataccagactcactagccgagtacctcaggcaggtatacaacctctttcaaacccaagtatctccactgtaaactagagactaaaataagacctaccacatagtgcagttataagaatacactttaataacacttagcctggcacccagcacataggaagtgttcagtaaatggaatctatagtagctacccacaggggatcctct

SEQ ID NO: 611666 - DNA, 691 bp, Homo sapiens
agcggctccgtgagccgctcgagtgtcgcgctgcaccaggcttcctcctcggcgttcccacgcctatatgggcggattcttggcgccggaggaagaggccagggtcacccttctcgtctcatcgtcgaggtaggacctagactgtaggaagatgtgcggctcagcaagataaactgaggcggctgtgatacagctcgcgcgaaagcagagataatgacctgagaaactgggcttcttttaaaaatggaagccagattgtgaacagtgccggttctagaatatggcaaaagcagctgtcgcttgtaagaaatgccaaagcagctcttgagcacaggcaagaacgatgcctgcctggagggaagctgtggcccatgaagaatagatagggctctttattgcgatgctgcacagagcttatgagcaagctggaatgatgttgaaggagatgcagaaactaccagaggccgttcagctaaattgagaagggccagcatggatgtatctacgaaaaacggtagccgcagaaagagataggcatggcgttaggagcgagctggaaagcttattgaaaaagtgagtccagagaaggcgtgtacagattatatcagaacgagagactatgtgtgttgtgaaaatgaagaacgcttactgatggggcatgttgaatgatctagtgaaaagcctgctagac

SEQ ID NO: 611667 - DNA, 398 bp, Homo sapiens
  misc_feature (21)..(21): n is a, c, g, or t
  misc_feature (50)..(50): n is a, c, g, or t
  misc_feature (61)..(61): n is a, c, g, or t
  misc_feature (88)..(88): n is a, c, g, or t
  misc_feature (105)..(105): n is a, c, g, or t
  misc_feature (114)..(115): n is a, c, g, or t
  misc_feature (118)..(118): n is a, c, g, or t
  misc_feature (128)..(128): n is a, c, g, or t
  misc_feature (139)..(139): n is a, c, g, or t
  misc_feature (144)..(145): n is a, c, g, or t
  misc_feature (148)..(148): n is a, c, g, or t
  misc_feature (155)..(155): n is a, c, g, or t
  misc_feature (157)..(157): n is a, c, g, or t
  misc_feature (174)..(174): n is a, c, g, or t
  misc_feature (191)..(191): n is a, c, g, or t
  misc_feature (225)..(225): n is a, c, g, or t
  misc_feature (229)..(229): n is a, c, g, or t
  misc_feature (234)..(234): n is a, c, g, or t
aggggctttgatcaacaaggnctaaatccaacaactttaaatgccatcgngcaagcacctncaaatcttaccatgaatccttccaatnatggtaccccacaaacncacaaatcnnatnctgtgggaanaaattatgaanagcannctnattatgnancaacaaaacgggcaaanccaagctacagtacaangtctagtcctgggcccagtaggaaaaccactccnagcnctganaggcaaaattcaaaagcccctaaacttactctggactctcagacacatgacagcctattgcagaatgtacagttgccgagaaatgtatagttcaggaccacatgtctgaccaatacccctgttcctgtgagctgtcctaacaacagtgggctgaatcctcagaa

SEQ ID NO: 611668 - DNA, 324 bp, Homo sapiens
atccatccatcctctatccatccatcctctatccatcttctatcctctttctctatatccatccatcctctatccattcatcctctatctatccatcctcttatccatcctctctatcctctctctctatccatccccgccaagacctttaccgtcttctctttctctatttatgttacccttattttaccaggtaagttaactgagaactcattctcatttactgcagcgacctgtggaacagttacaggggagatgaatgagacaattgtaaactggggataattaagggtcgacgcggccgcgaatttagtagtagtaggc

SEQ ID NO: 611669 - DNA, 233 bp, Homo sapiens
agtttgacgcagtggcctccggttcacagtgcaccatgtcactgtgctatcctacgaaatcattagttatctaagatgtgtatattccatggagtgacatgccaccccgaagtggctcactttcacatagaggatgcatgtcctcatgatttagcatgctgactccagcctactggcttgagcaacttactaaacggcacttcacttccagttacaacaccctgttacatact

SEQ ID NO: 611670 - DNA, 504 bp, Homo sapiens
cccggacgcatgggcagtgcaaggtgtactgggaggtgggcggaccccacaggctccgcagcccctccaccccagacctgcctgctgcctcggaactgtgacacccccatcttcgacttcagagtcttcttccaagagctggtggaattccgggcacggcagcgccgtgagctccccacgactataccaatctacctggtgacttcgggcaggacctgtcagctgggaggcccacggagaagagcctggtccatggtgaagctggaaccctggctgtgccagagatgcacactagagggcacgcagacgatgagggatgtgtctatccactgagatagcagacagaccatcagacctcatgccgtgtccagcgccaacagcgctctatgacgacatcagaaatgcatgtccttatggagctcgaagcagacccgccatagaacccaggtctaagtgagaagctccagcaagactggagacagaaccaccatagaagcatggccg

SEQ ID NO: 611671 - DNA, 87 bp, Homo sapiens
ctccgtgcagcggactcaggctccaatcgtgtggctacaacatagggtttttatacaatgacaaataaagtgaattaagcgtgaaca

SEQ ID NO: 611672 - DNA, 235 bp, Homo sapiens
gattatgaatagtgctgctatgaatatccatataaatgctttcagttctcttgggtctgtatacctaggagtggaattcctggatcatatagtaactccatgtggtacctttttgaggaactgccaaattgttttccgttgaggctgcatcattttagaaataccttaagattgggctgggtgctgtggctcacgcctgtagtcccagcactttgggaggccgaggcgggtggat

SEQ ID NO: 611673 - DNA, 145 bp, Homo sapiens
  misc_feature (69)..(69): n is a, c, g, or t
gaggagtggaggcccgcagagctccccaagcccagcagctcagactcacccagtgttgaccaccatgancggggatgctcagtgcgctggctgggttgcctgctggcagtgcgaaggaagccatactctagtagagtactccact

SEQ ID NO: 611674 - DNA, 82 bp, Homo sapiens
gcacgagaatgcaagtagtttcctcgcgtgacctcaccatgattcacatacgtgccactgtttgaaatctggtctgtttgca

SEQ ID NO: 611675 - DNA, 208 bp, Homo sapiens
tagcttggccacgaatagcctgccaggaaaagcgctccctctacctggtggggtgaaagaagcctcatctgctacatgtgccctgggacctgtggcgcttcgagagattcgtcgttatcagaagtcgacctgagctgctcatcctggaagctgcccttccagtaggttggttgagggagatctgcgcatggatttcaataacctgacc

SEQ ID NO: 611676 - DNA, 1085 bp, Homo sapiens
  misc_feature (1)..(1): n is a, c, g, or t
  misc_feature (529)..(529): n is a, c, g, or t
ngtctccctcttatctacacaactaacttggggggggaggaaagatggttcaatagtatagttggccgacaccaacccctttggggataacaaaccaattgactgctgtatcccctgcgacgaccgacaaactgtgccaggagttgccaggggacctagactggttgccgccgtatcatatttgactgaccacctctatagccggctctgtcatggagcgtgaacgctttgttgttccctttcataatgttggtaagaaaaattgtgtggcctgaatcgcaccccttgtacaccgcttgggtggttctcgagttgtcgaacaaaggcacttgaggtggcactgccgtgctctaccttgccgcgggtgccaccgtgggcgcatgctgggacacagtttgtctccgcggctttcccccgagtggcccccatcctccgattgtggagccggtgtcccgaggatcctcgtggttgctggggagccccatgttcggccccttgtacgtggcgcctcaacacccgatgttgtgangtgccgcccaggtgtctggcacttccggatagacattctccccagtgaagattatcccagagggcgtgcgccctcgtagtctgccctggattgggcacacaaccctggcgtctatcgaccacttgcgaggcctgttccctaaggggcccccaccacaggaactgagcgaggctttccgggctttggggagatcttgacagccccagacctttttacaggcgtgtgcagccagagataaccaaggtgttggacccacttaccatgctcttgcccatcagactctggccaggtgattcattctgggggcagcatttcccccccgtagagtacacgggctcctaatgaggtgggaaaaccaccggcaggcagcgtatcagccccaggccagctttttgcatggtatggtcagtcttttgccctccaacacgtacagcctaccagctacccctgcccgttctagacaacttgggtacatttggggacctaggcagttaggcttgactttgaggagaggctttgaagtttatgatcccctggattaagtactccctgggga

SEQ ID NO: 611677 - DNA, 201 bp, Homo sapiens
aaaaagcctaatttggtggttttttttttatatcaattagcgttaaaaatcgcatcaactatttaatacatgaggatcttacatataaaaatttaaccttgagattcaagcgctatgtgcttttataaaggaaacatttttgagagacgtctgagctcacttttacatgggggtgcctagggccgtaaagtgtgagagata

SEQ ID NO: 611678 - DNA, 1067 bp, Homo sapiens
  misc_feature (193)..(193): n is a, c, g, or t
tgggcccccctttcccctcacaaattccggggcccccaaaacggatttttttaaaaaattgcaaaaaacgggttctatttccatattttttaccgggctgggagaccacagggagggctctcaggtgctccagaacaagcaggggcgcacagcggggtgcctcaccttctctgtgtgagagaacgcttgagancttgtgcgtgtgaggcgatgtggggggttgccccacctgtgtaggagcgacacacacgcgagatgtctcccacgctgtgtgtagagggcggggtgtgctctctccatatatatactgctgtgcggggacacctctctgtgagagcagcgtgtgtctctcctctcacacacacaagcgtgtgctgcgttgtgtgttgttgaccaccacagagattctctccgtgtgtctgtgtgttgcgccccttctcacaagggatactctgtgtggccccgcagtactatttgagaaggcggagaatttgtcgcacgggcgacacactgtagagaagaggaggtctcgtccaaaatatgtggcgggcggagtagaaaaaccccggggtctcacaacctgtggagggcgaagacagagaaggagtgccccctctgatgaggaggcgcgcaacacaaaaagtgtagttcgccccccgcgggagagaaaaacatcctcacgccgcagcagaggggaaaacatctcctgccaagagggacgacgaagcacacacaccacgacgacgaggacaccacccacgaagaaagcacccgttgcgggtggcacagaaccacccggagagaagacaactgtgctcgccgccgcccgagtgggttcccctaagcagcacaccaagcggcggtggtcttctcaccctacacgcggcggaggggaagaaacacccgcccgaacagcaggtggggtgcagcctacaccaaccgacgcaggcgagttggcgggggaacgaccgagcacgggcccctgcacacacatcacccgcgtctgagaaagagcacggggcagacaacacctgaggaggagagacgaacaattgttctccccgccc

SEQ ID NO: 611679 - DNA, 453 bp, Homo sapiens
  misc_feature (30)..(30): n is a, c, g, or t
ataatgaatcgtttgcgaagtgcacatcantatcagacagataatggaattaacccagaagaccatctcccacacaaacaaggcaaatatcacgtaaccttaacagtaaatctcaccgtcgctggaaagtctgcatcagatgggattcaactcatggcaccctcttcaaccatccagaagctgtcgggtcattcctagttttcggtgtcggaggagtagttgttccaaatcaaaatgtatttgtcacatacacatggttagcagatgttaatgcgagtgtagcgaaatgcttgtgcttctagttctgacaatgcagtaataaccaacaagtaatctaacctaacaatttcacaacaactaccttatacacacaagtgtaaaggaatgaataagaacatgtacattaaaaatatatatatgaatgagtgatggtacagaatggcatgtcgacgc

SEQ ID NO: 611680 - DNA, 202 bp, Homo sapiens
gatcaggaacatttcccatcaacccaacaagcctggttcgcttagccagggtacacaggtatcaccctcaaagactggctccgtctgtccttccctgtgcgcaggccacagaccaggatgcagaggagcccaacaacctggtggactattccatcacccatgcagagccggccaacgtgttcgacatcgatgcacacacggg

SEQ ID NO: 611681 - DNA, 1127 bp, Homo sapiens
gcgcactcaagatcaagatgtctcgcctgcaccgaaggccctgtaagtaaggtgctggctctagtactacgggccggccacgtgctttctggatggtgcattatctgaccggcggtttgatcgagcccgaacacgccgggccgggttgtcttgtgacgatgtctcttgacgggcgtcgtgagggtggacggccgtgacgtcacagataggctgcgtgatccgtgggtcgtccctagcgtaccaagtaacttacacacctgtcctaagatgaagctcgagatctcctattagatggatcgctgctgtgaatgctgttacgactgtgtgatgcgaaggaggagcacagggggacatgccgcgcctgcatggtaggtgtgtctctgtgaatgttccactcaaatgggggctactaacaggcactccttatcaagtcggtcttctcgtgtcctgcatcgttctggcggcttcccgctccgtgaatcgatctctggggttccgggccggctcaaccgagggtggattgaattttgtgcgccatccagtattccgagacgttctgcaatgtatccttttgtctttcatcgctcggcatgggtcctccgtcgggagctaacgcgtacggctcgacgtccgaccggtcgtgggctcctcgggtctcctcttggtgtggcgggcactgtaggtctgcacgagggtcttagaggcattgcacatgggcacaactgcgggttctgtcattcaggtgacatttcctaggcctcgggagcgaatgacggcggtgggcctgtatattgcgacgactttcaagggctggtctaaccgtccggcaagtggatgacttaacagttttacttcgaaaaaaggaaggaggaactaatagttatttacagtgatcattatcgtagtatggttgcaagactagaccgtcgttaataattgggggggaacatcgcccttgggacagagtaccattgtttgggacgggtctacgagccctcaatcgggatcctcccgtcgggttccacttacatatcgttgcccattatcagaaatggtccaagatggccttctgaaggggttcacacaccctagggacgcgagacctagcactctcgtgatgatcccag

SEQ ID NO: 611682 - DNA, 820 bp, Homo sapiens
tcccaaatctgcccctcccaccagccctttatggaccggttggacaacattcccgcgccctcgggcccttccaatgtgcgcccaaatacccaactcctgcgcccatgggtcgccccagctggggtcatacactcgcaagagccgatcagacggtccccccgggagggcttccctcccccgcttcttagtcggtgccttcgaatagtatgcatcctcgccccccacggtctgcccctcggcggtggatcacgttcctttccacacgacgcctaacctccctcacgttcactgacaacccttctgaaagctcaggtgcaaacaccccaactgggaggcaaggattccccacgttgttttctaccccaccccttcctgcagcgggagaccccccccgctctttccttcgtggcgagacgtgtccccgcggtcggacccaccaccccctgtcgtgcgagtccgtggctggcaccccattctttcccgatacacttcttttcgtggcctccatctcgctgggtaccactctccagtggacccaccggcgcgcggcaaacggagtccacccccccgccgactcgaagggtcttctcttctcacccttctttccaactaacggcggcgcagtatcatgcttgtcttcttccaccacccacgccggggtgcaccaactccgggcaaccgatgagacatctctggggtaagaaaaacgagcgggctggtccggtacaggagcctaccccgcgggccccacagtcacattccttgccaccccccgctattgctcccctccttggttgtgcacaggcccacatagtcacga

SEQ ID NO: 611683 - DNA, 554 bp, Homo sapiens
atgattctttgatgaatcctgagtccataaattacactttttttatcaaactcacacaatccacagtggtgctgactgtaataaccactatggggaaacatcccgataaacctgcctgtagccatgccacggggagtgactgaactggtgacatctgtttgagcatgctttgtgtggctggtagaatgccaccgttgtgcatacacttggtacatcaggggtgacgggagggttttctaaattctggggggagggtaaaatggggatatttttggtagtacctttttggatggggtgtgggggtatagtcctcagcttaggccctaaaataacatgtataaaacccccggcaagtatagtgtgggtgtgtacgtgtgagtgtgtgtgggtatacgtcgggcaataaaggcttggtcttcgggaacttagtgacttcttacctcttttccctccagaagtatcggcccaagataggtacctaagcagtctacttagttggtccaccatgaccatgttgcagcaaaccttatgcatctacttcctacagggttaaa

SEQ ID NO: 611684 - DNA, 112 bp, Homo sapiens
attcagtgaccaaacagggattaatattagtggatttgagaacaaaatttcatacttgtgcaaaggttaaaggagtattaggggcagtggtttttttttgatgattctcaag

SEQ ID NO: 611685 - DNA, 1164 bp, Homo sapiens
  misc_feature (194)..(194): n is a, c, g, or t
  misc_feature (974)..(974): n is a, c, g, or t
  misc_feature (1007)..(1007): n is a, c, g, or t
cctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatcnactgcatgtcagaccagactgactgcacaggagcaggtggaggggggctgcatatgccaaccattactcttcaatagagtgtccttcatgagctcttctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgctggaaagtctggcagcccaggccataggattccagttcagcctacgatttcctagggaaatcaccaagttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggatangaatggtgatatgtatgtgtctggtgagttggnttctcacctggactgtgagggctaattcacaaatcacaccatacatgcgcgtgtgcatgcgcacacgcacacacacacaacacacacacacagtccaagaccctcatcagttctctggtaaaggttaagtccagatctgatgggactggtccagaag

SEQ ID NO: 611686 - DNA, 1041 bp, Homo sapiens
  misc_feature (194)..(194): n is a, c, g, or t
  misc_feature (909)..(909): n is a, c, g, or t
  misc_feature (1020)..(1020): n is a, c, g, or t
cctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatcnactgcatgtcagaccagactgactgcacaggagcaggtggaggggggctgcatatgccaaccattactcttcaatagagtgtccttcatgagctcttctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgctggaaagtctggcagcccaggccataggattccagttcagcctacgatttcctagggaaatcaccaagttccaaaggctggtttttaaacctagaatatccatgtatccatttcctaatgcagtttggacctgttctagacagagcactcagccttagcaagggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgatcgttgngtgtgtgtggatgtgcattccagtgatgttactccttcaagcccctgaatcactatagccacgactcttcaactgattccaacctttaccattattctggctctcatatanggaccagtctctggcgggggt

SEQ ID NO: 611687 - DNA, 489 bp, Homo sapiens
gggtaatcatctctaccataaaataacttcatcggaaacgtcaatgcatcagcattctgcagtgcaatatggaaatgaactgttaggctgtgttggtgctggaactgtgggggcttactcaggctgtttttatgactccaagatgttttttaatatctggtcttttttttttaactggtgaccactgacggactggcattacgaaggactggggtctgagaggaaccataaatggtaaaaagaaaaaacctgttaaaaggcaaatacaagcttcttttatgactttcctttaaggtctgatgtggtggtcctcgtgtttatcgatggctaatcccaattccctacaatccatgtgaaaagcatgtggtatccagaagatcaagcactttgtgcctcgaacacccgttatccttgtggggtgccagtttgatctccgtaatgccgacctggaagctgtaaatcgaggccagggcccgttagcacaggtaa

SEQ ID NO: 611688 - DNA, 233 bp, Homo sapiens
taacgggtgtggaaggtggcagttctggtgtggaggaatgtaggagtgtctcattactgctcttcgatgggccagtgagattgttttccttattgctagagtgtggtcaaatgttaggctcacaattcacctctgggggtgtaagtgtggggttgcatagttattactatggtgtggacctgaagtagagcagtgactctttaagtgtcctgcctcacggggctgcccttgcc

SEQ ID NO: 611689 - DNA, 178 bp, Homo sapiens
atgtttccaaggcccgcaagaagtacaaaggtggaggtatcctatcatggtacaggcacgggaccctgaaaatggggcacatcttcaactgcattcagcgagcccaccagaccacgttggagtgtatcctcccttcttattttttctagctgttggaggtgtttaccaccagcgtata

SEQ ID NO: 611690 - DNA, 863 bp, Homo sapiens
agcggagtgtcagccggaacttgttggttcggaccgtgggtgggggtggggccggggccgggcctggaggcggtgctggggtgccgggggctggtgctgcctgcccttcccccgtcacttcctgccgtgcttgcggtgcgcctgagcggctcttcagcgtaatgcgccggcggttgccgcgtcatctctcggctccccgcttccttttgacctgacttccaccaccccacggcccggtaaggcagacacggcgaataccttcacaatggggcacactaccaggcgctcgtatcgcacgtccccgttatacgtacgcccattcatataaccatattcgccatttatatatgcgctattcgtaacaatttcaacacatacatataggcagggcaacaggggacactaggggacccttgcccgtgctcgggatgggatacacaaagcatcagtcgagacaaatggcatgccccaagaaaggttctagttttagtctcaggcttaaaacgccttcttcacggaaaccttgggcgcgcagaacagcgagcaagcaattttggtcccctaatggaagtagcagccacgctcttttttataaacgagacatgagaaaagacgagcattagcaccggcgccttaagtgtgggacggaaaccttgacgagtcggccgctctgtggtcgccagtagtaaacatcttggggtgagagaagatgagatccagcggtggtgttagcaacgaacctggttgtggaacccacttgtagattactgcgggacatgagacagtccagtggctgtaacttacacttgaaccaacaaccgatgtgtaggggagggcaagtgagtgagcttataatacacgcg

SEQ ID NO: 611691 - DNA, 344 bp, Homo sapiens
caccagagaatgcagtaagctataacgtgccacatggtaatgaagagggggttataatcaccgctcctttaagtcgattgagaagacttttgtcgcaatttttggagcatattgtgacgtagcgatttgacgcgagattccagcatgattcacatagatggttttctctcttcccagagttaactcagattcctctctgacgcagagttaaggtacatgcagacggtaagagctgaagcttggccaggggtatgagctacacgttcatgtatccccattatctgggtgcgtgattgaaggctcaacactggacatctacttgtacatggttgggtttctgcgag

SEQ ID NO: 611692 - DNA, 838 bp, Homo sapiens
gacaatggtggatgtggtggccaggcgtgccagtgatcaggtaggggcgtcaatgtatgtcacgatgaagacctgcctatgggcaagggtccaatcgatggtatctctatggatccagaagttcagtggcccatatggcaggaaactgtgtcccgtgtggcctcttcagtgccttcctacgtattacgaatgctctggggatatgtggaataagtattgccaggacagcaggatctcagtgaaatgggtatggcatcgagaactcctatgtgcctactgaaacaagtcaggcaagatccgcagtaaattgtcagatgttatcagtcctaactttggcaccgaaacgcttggaatattgcgagattaggtcagtatacttttcagggatcaatttttgacaccgtctcaccatgtggttgtcgcatggttgcgcaagggtaatatgctgtgacctcgcaggaatccaggagtataaatccaatcaaatggctcaacggaaagatagctcaggcgtcttgctactcgaagctggtgacggggagactaggggcgcgatgaattttgctttaagatgatccttggcacgaagaacggtttcctcagtatgaggaggttaaccagtggcaggggttatactagggatgagctaagtcgagattgtggtaacggcaggtgttgagcccgtgagcttttccggatactgtagaacaggtgggtttgaacgaccatcttggaagtggtgccctgaattcggccttgcttcttgtgttgggaagggttcactatggttttgaaggggtcgggacagatggtccacgggtgcgatgtggtaccttga

SEQ ID NO: 611693 - DNA, 115 bp, Homo sapiens
caccgcagctatggctcggcctacaggattgcctacggcttccggtattgcccgatgatggcgtgctggaccagccgattctcttcgcgcgtgccgcgcgcaatgttgtgcagca

SEQ ID NO: 611694 - DNA, 133 bp, Homo sapiens
ttttttgcggtgcctttcccagaaaattgatgaataatccacccttgttagcatatgatcaagaaataaccataaaaatagccaacagcgctttgggactgtctatggagtagtcattcctttcgttcttttt

SEQ ID NO: 611695 - DNA, 592 bp, Homo sapiens
cgcggtggctcacgcctgtaatcccagctctcagggaggctaagaggcgggaggatagcttgagcccaggagttcgagacctgcctgggcaatatagcgagaccccgttcttcaaaaaaaaaaaaaaaaaaaaaaaaaaaaatttttgggccggccttcgggcctctcggaaaaaacgtttctttaaaacaccaatctgcgtgtttggggcgcgcgggggcgcccaagtacgggtcatgtgtggacactggggccatataagtgtggtttcccttaggagaagaactccggggccaatggaactagagtggtcggggtattcttcacccatataaaaaacgcgccgggggggcaacaccggagggtgcctgtgagaacaaaccccaaggagggggaaggcccgagggggcaataccgggggactctactaaaacgagggaggccccaagggaggaaggtccgaaattttaaaattaaccgccccgacccgggggggggtaaaaaacaaggacaaggaagacaacacaccacaacaagaacaacaggaaacaaaaagcaaagaaaacatcacggcacagaggaaacaacacag

SEQ ID NO: 611696 - DNA, 318 bp, Homo sapiens
gatttagtaagacgagttactatgtgcgtgatctcgaactcctgacctcaagtgatctgcccacctcagcttcccaaagtgctgggattacaggtgtgagccactgcacctggcaaggcaaccttttttttttttttttttttgggtaaaaaatcttggacctccatttaaatggggtaaatgtgcggtaagtccagagcctggtgtaaggtcccgaggaggggagggctggcgggattctcctttatccctcaaccagaatcccagcccaagccatttcgcggttcctcttctcgggataaactctatcatccatct

SEQ ID NO: 611697 - DNA, 1351 bp, Homo sapiens
agtgggtgtgtcttgtgtgctgtgtcgcgagtggtgcttcttggtttgccttagcttctcggtgcaccactgtgtcttgtggtgggtggccgctgctctccgcttttgtcttctggtagtgtgggtgtccttttggcatccgtttgtgctgagtacgcttcccgttctgtgctttccgtttgactctctctcttttgtttctcttttggttattacatgtgaccgttgttctgcgttttttgccattttgtttttcaaggtcttttggtctgtgtttttgacatgcgcctgtgtatctcttgccggttctttctttttttatattaccccttggtttggggtttttgtgcccttgccctttgtgtgtgtacacaatggttttctgccattgcgtgggtaagcccttttgatgccctacgtgtgtgtgatctgcttttggccctattcccacgggttggttttcgctgtcacgggtgttgttcccctttgggttttctttgagaccattacctggcctttcaacgttctgtgcttccccgtgtcttgggttttctttccccgtgtcacaagttattttgccacaaagtgttagagggagtgccttttgaggttatgggtttcgcgtttctgataaaggggtgttggggcgcgacttagtatcttcttgagtgcccaacaccacaccttgggttctttttctatacccccgctggctgaggccacgtgaaacccgaaaacacggttttaagaaagagcccgcggtgtgtacatctgatacagcaaggaaaaaccggctgccaattatctctgttctccacactaaaaataagtgggcccaataatagtattattatgcgtttatagtaagggctctctaccacttttgggcactccgctgtgtaagattgtaatacatggttaatggtgtgttataggcaccacggctctttcttttgtccgtatgttgttgcagtacccggtcacagcacagcttccacaaatactttttaaaaatagaggttgtaacacatctgtaggttaatttgtcacaagtcttgtgcgcctgaataagagtacgttaagcaaactatttggaacttgtctcgccgtcaaattagaaagactctggttgaattttggtttccgctttggatttttgggggaagggagccactcgatgtttatagctggaataatgaagtctcgagacctttccggtgcatgggaacacacacagagttcggttgcaaagttgcaccagtccgactgtcgcatcttcttgtgatgctttgtatcatttttgggcacttgatcggtactcggggacaataaaccagtattatctaagaga

SEQ ID NO: 611698 - DNA, 499 bp, Homo sapiens
aatacataatcccattagtcatcagataaatgcaaatttaaactgctactggatactaatgcatactccttataatgactataagtaaataataaaaatatcaagagttgccaaggatgtggagcaaccaattttatatggctggtgggaaaaatatttcaactacgttgacaagcaatttggcaatttttaaaaatgaagttaatgcagctgggcgtggtggctcacgcctgtaatcccagcactttgggaggtcgaggtgggcagatccatgaggtcagcagatcgagaccatcctggctaacacagtgaaaccccgtttctactaaaaatacaaaaaatgagcctggcgaggtggcaggcgcctgtagtcccagctactcgggaggcggaggcaggagaatggcgtgaacctgcgaggcggagcttgcagtgagcctagatcacgccactgcactccagcctggtgacagagcgagactccatctcaaaaaaaaaa

SEQ ID NO: 611699 - DNA, 681 bp, Homo sapiens
gtgcccattacggccggggagggggaccaaaaaaaaaaaaaaaaaaaaaaaaaaaaaatttttgggccgcccgggccctgaaaattttttaaacaattcgttgggggcgggggcgccccaggtagggtaacgtagaccatggggccaaataggcgggttcccaataggcgaaactccgtggcacaggagactaagttgctggggattctttcaccaacattaaaaaacgcgcccgggggggcacccgggcgctgtcttagaacaacatctcacgaggggagctcaggagggcatacgggggctcttattcacagggcggcacagcggagagcccagaatattaagatttaccgcccggtcgcagtgtattaatcgaacaactagatgagtccaaccaaaccacaaagcatatcaggaccgaacaaagaacaacacatcaccaagacggagctagcgacagatcgaatcatcgcagcggacacagagacaccacggccccccccccggcctgccctacacatcggcgccccgcgaacacaacagtaggtccgaacacacctcgcccacgaatcgtgacccagcataacaagccacccagcggtagcaatcgaccgaggatccggtgtcgtcacacaatagtcccacgaccccctagcgaaaacaccaggcccaggagaccgc

SEQ ID NO: 611700 - DNA, 251 bp, Homo sapiens
agggggggtttccgaacccccccctcccccggggggccaatttttttttaaacccaccctttgggggggggggggttttttactttttcccccgggttttttaaaaaccccaaaaagggggggtttggggggggggggcccccctgggggggtttttttttggggcttggggaaaaatggtttccccttggggttttggccccccccttttttttttttttacccccccggaataaaaaggtttttcccca

SEQ ID NO: 611701 - DNA, 578 bp, Homo sapiens
tcttcaggatggagtgaatggcacaatcctcggctcaccacagcctccacctcccgggttcaggtgattctcctgcctcagcctcccgagtagctgggattacaggcatgtgccaccacgcccggctaattttttttttttttttttttaattaaaaacaaggtttctccatgttggtcagactggcctcaaactcccgacttcaggtagtccgcctgcctcggcctcccaaagtgctggggattacaggcatgagccactgcttccagccagttgtaaatatttttatattcccaccaaagtgctgggattacaggcctgagccacccgcctggcctagagcactgtttttgtaagagcccagatattgtgttcaccagaaagagaatggttcaataaatggtggtatatcagtatatggactgtgggacagcccttctttttaataaagaatgcaatatttttacataaattatatggtatatgtaagattatcacggttttaatccttgtgaaactttatgatacaagaaaataaaacaggccagccagtatgcttgagcccaggagtaccagac

SEQ ID NO: 611702 - DNA, 279 bp, Homo sapiens
atatgagacacatgtcatgaaatgtgtcgtgtcacaatgttcaatgacataatcaaccgcaaccattatctataccaactgatcatgctggggaggtaaatgccacatccttgcggagcgttatggagctcttgtatgtcatagcttttcctgtggttaaaggtaaatgcttttaatcaagcaggaaaaagttctcgtgattatgccaactataattttaataatgtgatatctattcgttatatgaatgtactacagtttacctagatgcttttattg

SEQ ID NO: 611703 - DNA, 129 bp, Homo sapiens
  misc_feature (94)..(94): n is a, c, g, or t
cctcccccccttttttgtccccaacttaaaatgtaaaaggcttttggtccccctgggagtgggtggaggcacccagggcttacctgtacccttnctttagacccgttgaataaaagggcccccccttta

SEQ ID NO: 611704 - DNA, 365 bp, Homo sapiens
  misc_feature (8)..(8): n is a, c, g, or t
  misc_feature (197)..(197): n is a, c, g, or t
  misc_feature (223)..(223): n is a, c, g, or t
  misc_feature (331)..(331): n is a, c, g, or t
  misc_feature (339)..(339): n is a, c, g, or t
  misc_feature (341)..(341): n is a, c, g, or t
  misc_feature (364)..(364): n is a, c, g, or t
aatggggnttcactgtgttacccaggattggtctttgatctcctgacctcgtgatcccaccaccctctgcctcccaaagtgctgggattaaaggtgtgagccactgcgcccaacagcattgccttttttatggtgtacccagacctcatgcacttgataagaaacgccttcatttttaccatggcaacctagagcgnacagtcaggtctgtgacaaaaaaagnacattgtactgtgcggtctacaagacagcattgtttgatcattgtaatttttttaaatttaaacaacataactcttccaaaagaggagatgcacttggatattaagtnaaaatagntnaaggacacgtctcttgatgcagnt

SEQ ID NO: 611705 - DNA, 80 bp, Homo sapiens
aaaacttattgaaattctagcaatttctccagtccagatgtaaaatgagaaagagcaaataaagccaaataccccaaaaa

SEQ ID NO: 611706 - DNA, 111 bp, Homo sapiens
aattgtgcctgactttaagattttgttctgctgagatactcgggaaatgtcaggagcagatcctcagagtcaaccacaccacggataaaattgagaatatctggtatcaac

SEQ ID NO: 611707 - DNA, 176 bp, Homo sapiens
ctgtggtgttaccgttccatatacataagattaaagttgaactctttacaccacatacaaaaatgaactcaaatttatgtaaatttaaacctaaacttaagtgctaagactataacactctttaaagaaaacataggggataatcttcatgatactccgtttagcagttattcttc

SEQ ID NO: 611708 - DNA, 389 bp, Homo sapiens
ataatgttataaagttggttagtttttccctgtctttggttcagaggagtctcttccaaataagaatgtaggacagttgatttttacaatgatttttcaggtggctcacacctgtaatcccagcactttgggaggctgggggaggggtgcagatcacgaggtcaagagttcgaaaccaggctgactaacatggtgaaaccctgtctctacaaaaaatacaattattagccaggcgtggtggcaagcacctgtagtcccagcaactcaggaggctgaggcaggagaattgctgaaacctgggaggcgaaggttgcagtgagctgagatcgcaccactgtactccagcctgggggacagagagtctgtctcacaaataacaaacaccacaa

SEQ ID NO: 611709 - DNA, 1510 bp, Homo sapiens
gtacccgatgcccgggccggagccgcgggccagccgacgagtccttcgggcgagtgctgggggctttccggtcggggccgcaggcgcttccggagccgacgggcgagtgtgcgttccccgagcctggttctgctctgcggcgtctgacgcgcaggcggaccgcagaatctcgcagcatcagtagactccggggcgctgaacactggcatgcgacgggagtgattgcgctgtgtgcacgcgtttcagacgcgagataagactaaccctgtctaggcaagtacccgtaggagttggcataactcgagagatcaagttccgatgttgtgattgcagcctgggtgctcttgcaactgctgtcatgaactgaacagccctttatattgcacagaaggcttggatggttccctacacgtaggctcggtggcttttgcacacgatgttcatgctcaagtgtactgggtctacgagtccgtctcgtgaatgcgtcgctgcaatcccgacccctagccgttctcgcccgtctaccatacggttcgcctgcgtggcagtctcactcaagtgcccacttggaagaacgacacatgcatgaacccagagacacccattatggacaaattatctctatagaaaaaccttttaggaacctatagtaagtacgaggacgcaagcaggataagccaaggccgaatccaagatttgtggccttcgcaaaacaaccttcttgtagagcgacgaaattggcactttggaacatcactggaatgccccaaccatatggcaaagactatctgtagggcccggcaacaacccttgggctcttagtagcaacaacacatgttagcgcagtaggcttggacccaccaaggcccgggtggaatccaattatacaggtcgcattggatatcacatatcccttctcccaaccttagcgagccctgatcgctttaaatgcatagagttctctttctccaaggggatacagtgcacacggaccgttttctatcttaggggcctaaaggcacagttccaacctgtaccgccacccaagtgctataaggcactatattctccttaggcaccaaaattccttaacgcggttcggcaccggaactttaccaactgcggcaaacacgattggcgccactatctactgtgacacccatgttccatttgcacatgcactcacttctatgggctataggaacaagccgggaagacatcacaagcgtgtgaacgcaaaccgatcgaacaataacttaagctcattggacgagctaaggaacaagaaaagggagactgcggcctctatcgcccacttgggcccttaacagatgtggtactcccccaccaaacccaaccatccactcatagatcaccctgtcggacaatttaaccacatcagtgctcctgcaggtacccgccacttaatagagaacatgtaacggaacaccgacaactgcgacatgatatttctgctattggcacttactacagcgatagtgaggtcacc

SEQ ID NO: 611710 - DNA, 162 bp, Homo sapiens
actgattacagcgacgtgatccgcgagctgaagaagacccagatcaccggttcggcgatcctgccgttctacaagaagcgcctggccgacatcgaggccatcatgcgccgcgagcacgagatcaccgtgccggagcgccacgccgtgatccgcctggccacc

SEQ ID NO: 611711 - DNA, 323 bp, Homo sapiens
gcgagcggctacaagtcatatgcccagagctaaaagagatgataaatgctacttcggggaactatgaaaatagtccagctaatatatcgtggttactctccccagtcgctcacgagtttaggacacacatctactaatatcctccaatgattctatgaagtgaaaatcataagatggctaaacaacactaaatagctaattacgggtcaccttcattgtgtaaccaactgcccacgttactcaaggctcaccttcggtgcaaatcacgtatgaaaattaattcgtccttctcaatctatcgcattttctctacataatcgccg

SEQ ID NO: 611712 - DNA, 463 bp, Homo sapiens
  misc_feature (349)..(349): n is a, c, g, or t
aaagcggcggtacggccggaataccgggatatcggtgtggactcggcaagaaccagcgcaagagggaagcggagttatagctaccccgggcgcggagccggctcactgcactacccccgcccccttctttccgtcccaggaacggccccgggaaaaagggtttccggacccggggtggtcggtcccttccatggcgggcctggaggtactgttcgcatcggcagcgccggccatcacctgcaggcaggacgcgctcgtctgcttcttgcattgggaagtggtgacacacggttactgcggcttgggtgtcggtgaccaagccgggtccccaatgattacagagagtccnatgggcaaaaaaaaagcccccttttttgtggggggcccccgttttttgggggggcccccccaaaaaaggggggccccgtttggggggggggggggttgggggggaaaacccaaa

SEQ ID NO: 611713 - DNA, 318 bp, Homo sapiens
cgccgtttcaaccataggatcactcttagggtccaatttccgccagcatagattcagcgcatacagtagcatgccaagtgctgaaactccagcccaggcagcgtggtaagccctatgcacagcaacatgagccactatattgacacatacaaatcaatatgtaaggtcccgatcaacttcgggcaagcgcgtctcctatgaacagctcacatgctagttaggcaacaaatgaaccatgccagaacactataggctctgtctcgatatccactcatcgtacacagagctatggcagactcaaccccctcaatatcagag

SEQ ID NO: 611714 - DNA, 274 bp, Homo sapiens
ctcaacatcgaagctatcagcaggcgtaaacccgcactgaactgccattgcgatgaccactcgctctgatcctgcagataaatcgctatagtcgtcaccgtaccgtgattattggcatccgttgctgcctgccgaacaatcaccggcgtactggcaccaggattggctaaagccgcattgatggaagtaagtcctccgccgccggtctgcaaatccgcagtatagcggaaattatccgcttcctgcctgccaagctcaacgccgcgcagagttt

SEQ ID NO: 611715 - DNA, 278 bp, Homo sapiens
  misc_feature (12)..(12): n is a, c, g, or t
  misc_feature (15)..(15): n is a, c, g, or t
  misc_feature (17)..(17): n is a, c, g, or t
  misc_feature (49)..(49): n is a, c, g, or t
  misc_feature (80)..(80): n is a, c, g, or t
  misc_feature (108)..(108): n is a, c, g, or t
tgccgattcggngtntncacctacactaaatatgggcattttaaaagangattccccccttcccccccagaattctgcanttactaaatttgtcttaagtccaattgngtttaaaggtcatgctggtcgggtgtggtggctcacgcctgtaatcccagcactttgggaggccaaggtgggcagtcacctgaggtcgggagtttgagaccagcctgaccagcatggtgaaacccgtctctactaaaaatacaaaaattagcttggcatggtggcgggta

SEQ ID NO: 611716 - DNA, 268 bp, Homo sapiens
gatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagacc

SEQ ID NO: 611717 - DNA, 419 bp, Homo sapiens
caacccccacctcccacttcaagcaattctcctgcttcagcctcccaagtagctgggactacaggtgcctgccaccacatccagctaatttttttgtatttttagtagggacggggtttcaccgtgttggccagcatggtctcaatctcttgacctcatgatccacccaccttggcctcccgaagtgctgggattacaggtgtgagcccctgcgtccagccttctatatttttagttttttaaaaaagcagtagaggcatagagaagttaactttcccaactcagcacaggcaataaatgagattcaaactcagaaatggctgacttcccagactgtgctaaactatctaaagcaaaatggaggccctttcctcagggtcagtgaagacacaagaccagagaagggtcttgagacgctt

SEQ ID NO: 611718 - DNA, 635 bp, Homo sapiens
ttaagccccctacaagaaacatgtgccccccgggcctaaggtccagttcccaaggattctgtaaaaaaggcataatgtccccgtaaacccaatgtaatctattcttgtatcaatggctttggttcggtaaacaggacgatatttgtacgattttggcagcaagaacacgaggtttcagacgtccttttccaaggaatttatgaacctctttgatagcagatgtatctctaacattctcagaatcctgccgatatgttccacaccccagttgatcattcgatttatgagcaccaaaactgtttgtcagggcatgtgtgatttctcacactgtacatgttgcctcagatgcatccctgcaacgagcaaggatatttccatgtcggcagcaagcacatgcggttagtgcagcaggacagcgtacagacaaagcttgatcccagatgcatttgatgatcagaggtttttcaatgtgcatgtttcgcactagagtattatcaacagccagaacttttacagcgtcttccttttccaaatggtacttatttagtccaacagttactagagaaccagaatatattgtagtttgtctagcgtcagtacattgtgctatagggagcttaggtattccgtcagct

SEQ ID NO: 611719 - DNA, 818 bp, Homo sapiens
  misc_feature (799)..(799): n is a, c, g, or t
gaggtttttcttgtcgcctagccccctcttcgaaatgctggatggggtgtattgtgtcgcgtcgtattcctacctaaccacataaggcggcgacctctcgttccatgaggacccctcaacggagaatagtgtggccccccacttttgcatcatgcgctgtattgcatagggtaggggacacaatgcctattggcggccatccgctacgctaggaatccttctggccaccgcctgttttgggtccccttacgctcgcaacacacacatgacaagtatggcgcgctcagctcctcgaggtaggcattcaggtaccctctcgtgagactcactcatatggtccagtagtgcgcaaggaccgccgccacgagattcattccatcgctctcttccccattgctccgcagtcatcctctgaccccgccatgaccccagaaccggactctaaccagtggaactatggccgtctgtacgtcacagcgcttctggaggtgacttggtctctgcaaagtcaaaggcctgacagctctgtggcctgggaatccattttctctgcggcagagccagtggtcctgagctgttggaaccctatggtagctgtgggtatagccacagcagaaatggaagaaaacaggtctcagcctcagggtcctcgctcactccctcactccccatctttgaagccatctctgttctgcacggtgagtaggactatctataagatccatgtcatcacaaggacgttgggaacaaaaggaattctcttcgcatagaatgcctctgctggtgctgtttgataacntcgagaggcagggtcattt

SEQ ID NO: 611720 - DNA, 141 bp, Homo sapiens
cgccgtccaagctattttctgtaaaaatcgtggctctcggcggactcttgggattagaggtgcaagtgcgctcacaccgcggccggggtcgcggccagagctgtggggatcttgagcgggcgggtcgcagaagaccttacg

SEQ ID NO: 611721 - DNA, 157 bp, Homo sapiens
accagcttcatgcagaatggactggggcccccagctcatcacacagaacttctctcacataaggtcccataactaaaaatagatacacagccatattaaatatttgcagaaccttctccccagagtattcgttctgaatagtacaggaaacaccatt

SEQ ID NO: 611722 - DNA, 150 bp, Homo sapiens
  misc_feature (58)..(58): n is a, c, g, or t
agcggcgagcgcgggcttttttctttcctggtgtcccgtcgcggcttgggacccggcntgatgggcatgaagggcatgaaggagaagaagggccgcggcgcggcgaagacggccgccaagatggagaagaaggtgtctaagcgctcgcgg

SEQ ID NO: 611723 - DNA, 794 bp, Homo sapiens
tcggagtcctgaggaggcagacatgcggtggcagctgctgagttctcggtgaaggtatttcatttctcctgatccctcccctccccacccatctattaatatattcttttgaagattcttcgtatgtcaagccgccaaagtggagagtgcgattgcagaaggggatgcttctcgtttcagtgcttcttcgggcggaggaggaagtaggggtgcacctcagtcactatcccaagactgctggcaacagcgagttcctggggaaaaccccaggcacaacgctcagaaactggattcctgcacgacgcactagacgagatgacaagctccgcagcaaacaactccgcacaacgaaacagaacgacatgatgcactcttcaggaaagtacgaggcatactaaataagcttactcctgaaaagtttgaccagctactgccttgcgctcctccatgtgggtgtagagtcataaacctacatccgttaccggggtcatactgcctgattgtggacaaagaccctagacgcagccacagtatagctcactgtctgctcagctatgtctgcgattggcagaaagactgcaaacgacacgtttgagtggaccaacagccagaggggtcaacacggaccagcaagcaacgcaacacattcagaagcctccttatttccaaatacgagatgccttcgacacgacctgaaactgtgaatgtcacgcaaccctgaatccctctccgggagagacaggcgcagcaaccagcgtggaaccccctgtctctctccccccctcattcccagg

SEQ ID NO: 611724 - DNA, 654 bp, Homo sapiens
  misc_feature (654)..(654): n is a, c, g, or t
aatgttttatatgaaagttttattattatttatagtatttacaatttaaatgtttgcatagtacagggcaaatgtttgttagtgttatctgctaccacattattttttggatattctttcatgtttacaacactaaaagagatgcttacttttaactgaggtcagtggacatacaagatttttgggtgatagcttatttttctgtaacttctttttcttttagttcttagtattttttaatgtcagatcatttagtgatggacattgttttatgtgattttgggttttcctccttatgaaattttgaggcaaggttgacattgttttaaattcatggtcatgagatgagatatattcttaaatagagaacttttcctgaaaaaccatggcttgaaatattttaagagtattttgtttaatgtcatgctcgtactccaaacacttctgtgtcagaattataatttcattattctgttctcttacaatttttatagaaaggatatattctccaaattatctgggtgatgtacactattagtaatttcatgtaagtctggttcattcgactattcttaacttttttattatataagtaagttttcacaatcattaatcgctatagcattctgagataatgcacaattatttctactn

SEQ ID NO: 611725 - DNA, 477 bp, Homo sapiens
tctcagcacagccgggggaggggtcatggttctcctcgtccatcagggatctcagaggctcagagactggaagcggctgggcccaagtcacacagctagtgaagaccagagcagtttcatcgtgggtggtgactctaagctcagggctctctccactaccccacaccagcctgggtgccaccaaaagtgctccccaaagggacggagaaggggatttttctttggaggcatgcacatcgggaattagggtcaaactaattctcacatccctctaaaagtaaactacggtaaggaacagcagggttctcacagggtggggcagccgtccttctaatgaagacaaggatatggacacggtccctcttgggcagtggcataagtaacttggaaaggtatatgacggagcgtagcatacaggttaaccggcagaaacagtacttaggtagagagcagggcaaggtagagagccgggcaagg

SEQ ID NO: 611726 - DNA, 206 bp, Homo sapiens
cttaacccaggctcctttagaggtatatgaagcaccgcccgggcctttgaggcttaagctgcctctcgctgcggtctgtcgagcagctttgttgatttaactgtagaggctttatactaagcatagaggggtatctaatcccagttggggtcttagctattgtgtgctcagatatcaggccatgtactagcctagctatagttaaa

SEQ ID NO: 611727 - DNA, 143 bp, Homo sapiens
tagtaagaagctaagaagcagaaagaggatgcccacaatgagagcagggaatcagagacaaagctgaatggagctcccaggagtgtgcaatgatgaccatgtatggcccatctgggaacgagtgtcagcccgtgcctgacaac

SEQ ID NO: 611728 - DNA, 192 bp, Homo sapiens
tcccccccccgggttttttttttggggcgggggggggtttctttttttccccggggccccttttttccttttggccttttttgggggcccttttttcccgtttttttccaaaaacggggggggggggggggggggttttccggggttttttttccccccggggccccccccggggccccccccggggtccga

SEQ ID NO: 611729 - DNA, 1209 bp, Homo sapiens
tatatggagaacaccaaaagagttttttggttgaaccaccagaaaaatgatgctccacagaggcgcttcgggtgtgaaaccccgcggttttcccccgcggagaatttgttttccccccgcgggggaagtttatttttcgtgtgtcagaagacacctcatcacggggcggtttccccgcgggggggacaacatcacaccaaataattttctttttgggggttgggagaaaccacccccctttattataaattttaaaacgttgtaacgtggtgatagaaacttttagaaaatattagacactccggtgtgtcctctgccaacaaaacactcttaatggggacgacttcttcttcttgaaaatagacgcactattttttctcttttgtagaaagagcactcttcggtgtaaaacagtgaataaaattctggtggaaaaaaagctccttgtgttgtgaaaacactcctgtgtgtaataaaataatagctcttcaaatagaggagatataaaaagcgtctttttacacacacggagtatatagggagtctttgagaaattttctcccggagaatattcccacacacattcgtggtgacacacaggcgcgtttgtgagcacaacacttctgcatatcacctataaaaaggggagtgttatacacgcgcccccttttagtagaaagatgtgtgtataaggcgtctataaagggacgcacatcttgttataaaatatatcgcgcataggagaatatttacgcccacaagatattatattaaatatgtgtaatacacaccccccacaaagatgtagaatatcgccacaatatgtttagagaaatatgttatatatttagcacattcttttgatatccacaacaatgcgctccacacaatggtaatggacacaataaaggtgttctctgtgtggcggttataaataaataatgtgtgtgtgttatatttgaaaccacatttttgtgtgggtgccaagagtaaattataatggttatatatattggattgttataacccataatagtgccccactttaaatatctcttttttaatattaaaaatatatattccaaataatagccagaaaaatataataaataataaaatagccccttgtaccccttcccacatactattttgccaaatttgcttttgatttttaaataaatataaatgttactcttttgtacttttcca

SEQ ID NO: 611730 - DNA, 256 bp, Homo sapiens
  misc_feature (1)..(1): n is a, c, g, or t
natttattttacaagatacacctttcgtcgctggtaggtatctgagttaccagatcactgtcatagtatcgcagtgcttgtgttcaagtaaccattttttgaaatgccaggtccataacccactgagtgacaagtaacctttattttacttaataatggccccaaagcacaagagtagtgatgctgggagttaaccatgcttaatttgtaaatgaaactttatcctaggtatttatgtctggaagaaatgtagtta

SEQ ID NO: 611731 - DNA, 544 bp, Homo sapiens
  misc_feature (65)..(65): n is a, c, g, or t
ggctcaattgcctctgtaggagccataagtgccgaattcttcaatgattccgcctttctaaatgnacatgttggtgggcagcattcatttcctggcagccttggaatggatggctttggccaatcagttggcattcttgcacgccctgccacagcatatggattccgccgtgatgaaccttactactatggctatggatcctgataaagtatctgtttccatgtgtaatctcagcttagaagaaatctgtgtgggctgggttaattttggatctttgcctaataatgcatgttgatgttattgcgggtcagtgctggtttctatttttatatgttgttagctgcagattaaccgcagcccctctgtcttgtgttaagtacagttgatgctgacattgttcactcatcgaaccccatggtgatggtaaggggcatttcccatgagcctcaaaactgaatgctgaaaagcttctagcctggaaaacaaacgcggcattatgtatgttaagtgactgatttaatttcaattaaaaagcgtaaagtga

SEQ ID NO: 611732 - DNA, 604 bp, Homo sapiens
  misc_feature (198)..(198): n is a, c, g, or t
  misc_feature (204)..(204): n is a, c, g, or t
  misc_feature (276)..(276): n is a, c, g, or t
cacgaggcgtcgtcgattgtctagagcatacctagccgctgtgtttgtggctagatgcgactggaaggatctagttggccgaatgtcctagatgcaagattgtaggaagcgcaaacgttgggggtcaccttcgcgtcacagggtgtatcccgcatcaggtcatcaagtacgcgtagacgtacttacctggtgcatccncctggnatgcgcgtcattgataggaggatcggcgaggagacacaaaagagatgagagtcgaccctatttgactgctgngtgaaagtccatagccctggacttgtcccgtgatacaggcatggttgcctagaattcaaagcacctattgtccctctcgtatgttcatgcattgcagccgcgtttcagacccgttctcccatgtatatcttctcgggcgtggcaactggggcccttccgagccgaaccttattgccacctgcgcaaccatccatgaagctctccaaagcgcatggcttcgcctacaaagtcgacgagtcgcactacgggaccacgagggggccaagctagtccgaaaggcagacgcatacggggtcactagaatcccctgaacaaggtattggtaccg

SEQ ID NO: 611733 - DNA, 910 bp, Homo sapiens
gtcaattgaatggaaagcagccgtgcgcctgccgctgatggatgtgcgtgtgagatgactcaggatgtgcagaaggcgatggacgagaggagcatttcgaagagtgcggttcgactccgagggaggagcgttcgcggtgcgacctgaacaccgtacaagcgacttgcccatttaagctggccggatgatcagatgccaaagaccaattgcaacgtagctgtcatcaacgtggagggcacccagcgtgtgggatgaacgcagtcgtactctccagttgtgcgcgtggcgcttttgccggatggccatgggatgctcctgccatctatgatggcttttgacggctttgccaatgggccagatcataagaactcggctggtccagatgtcgtgtgtggcttggcatccggcgcaatgcagtgctccgatgtcttggggacaccagggcgtaatccccgtgggaagatacttcgcgaaagagatcggccatatatgatgcgcacgcacagctatcaatgtgcgctgtgatcatcggcggattcgaaggctacctgaggaactccttgagctgtctagccgcccggggcgaagcaccaatgcagttctgagtccccaggtcaccggacccgcacatgttttgaagcaaaggtgccgggtacgaatagcagcatcggcgcacaccaacggccagatgacaatacggacaccctgtggacgcataagacgagtcgccacggaacacaaacggcgcgcgtaaacacctagagaaccctgtgcggcacctgggcgaccagcaccaaacagacagagccccagcacgataagaacccctacacccacgagcacagtcaaaaggacgacagacgcgagggctcgcaaaagagtacaccccccccgcacagcacagaaacag

SEQ ID NO: 611734 - DNA, 201 bp, Homo sapiens
  misc_feature (143)..(143): n is a, c, g, or t
agggaccttctgaacacagagtcaggtagagatttaacactaaaattccactcatgccgggcgtggtggcacgcgcctgtaatcccagctacccaggaggctgaggcaggagaatcgcttgaaccggggcggtggaggttgcngtgagctgagatcacgccattgtactccagcctgggcgacagagcaagactccatttc

SEQ ID NO: 611735 - DNA, 173 bp, Homo sapiens
  misc_feature (164)..(164): n is a, c, g, or t
ccagctaatttcttctttttctctctatctctctctcatctttttctttcttctttccttctactttgtatcttcttcttctttcctctttacttcttcttccttctcctcctttcttcttcttattcttctccttctccttctttttcttcttcgaagtatancgcgttgag

SEQ ID NO: 611736 - DNA, 343 bp, Homo sapiens
cgtttggtgacttagaggatcccagtcccacactcaccggggaggtcgaggctgccgaggtgggaggatcacatgagccggggaggtcgaggctgctgaggtgggaggatcacatgagccggggaggtcgaggctgcagaggtgggaggatcacatgagcctgggaggtcgaggctgctgaggtgggaggatcacatgagccggggaggtcgaggctgcagaggtgggaggatcacatgagcctgggaggtcgaggctgcagaggtggcaggatcacatgatcctgggaggtcgaggctgcagaggtgggaggatcacatgagccggtgcaaggtgtgggact

SEQ ID NO: 611737 - DNA, 182 bp, Homo sapiens
  misc_feature (18)..(18): n is a, c, g, or t
tatcccaacacctctggngtttgtattcacttatctagggagagacacaaatcccaaatctataaagcctctagcccaagggtatccaatcttttggcttccttgggccacacataaaatacattaacactaacaatagctgatgagcttaaaacaaaaacaaaaaaacaaaaccctcagta

SEQ ID NO: 611738 - DNA, 815 bp, Homo sapiens
aagactgcgaaatccgctgatgatgaggagaggaccgtcaacagcagcacacatggtggctcaatagaagaatcgttgtaacggttatgtgggattgccaatctcccaagatcaaaggttatacagaaagaaggtcggtgaagagaggatcgcgagagttcacgcgtgtatggtagtgggtgaatcatggatgggaaagtgggacattaatctgactcattattcctcacagattggtagtctccagagtatccggaggtcctgctcatagacattctaaagactgtaccggtggaagaatccaaagttttaaatcaaatgaaggtggtgttcagttgctgctcagaatcagtggataccccaggatttggatggcatgcagtggataaatagtaatttgcctggcgagccgtgtatatcgactcacgattgatagtaaaattcgaggactacctaaatgcatgaatcacgagtgaacagacgtccacatgcctgataacagggtgcaggtgttgttgtatacttcattgctcctgcaggacatgcgactggagaccattggatattgagtttatgaaagcgtttgcctcgacaaaagtggtatcatcccacttatggcgagagaaggacagactcacgacagaggaatggcactgtgtaaaaaacagatactgaaagaatccaggaacgtaattgcaagtttaagaattcagaacagatgtgcaaaagcacataactgttaaaataagggccgtacccttgcgggggcgcacgaaaaactggaactagggccaggtcaccgagaacacgggggc

SEQ ID NO: 611739 - DNA, 160 bp, Homo sapiens
  misc_feature (85)..(85): n is a, c, g, or t
  misc_feature (104)..(104): n is a, c, g, or t
tggccagcatctgggaactttgggttgttggaccaacttcttccaacacgtgcgcactgatggccggggccccagccaggcctgnctggaagggtcttccccgncccgagggactgtagggggtctctaggaagcatcacatcaaggtcctcaggttaga

SEQ ID NO: 611740 - DNA, 1056 bp, Homo sapiens
agcggagcagcaggaggaggcacagcactagcatcgctgcgggaccagactcgtctcaggccacgttgtcgagcgcttcatcatcacgaaacgctcgtatcacacacggaaacagctccacatacctactgacgaagttagcacgtgacttctgcgttatctgccgtccgtaggcagtcacctgtggccagtagcccatgttaaactaggctgattctggaagttctgaggaaatagcagctttacaacaaatacccagatgctgtggcgcacgagtggctaaagccctgacccatctcagtaagcagaatctcctatgccccatcaggaatgtctgtgtcctctgaagaaatcctaatgagctttaatagcaagagacccttccacatgtaacgtccaagctgacaagccatgatccatcactgagatggactagtgtgagtgactcaaggattgactgagtgaccactgtggcacaaggcaggacgtccacttagatcgtcgtaagcgactctgaatgaatgtacgatgacactgagtgacttctcaccagtctgatcagtctcacgcacttctgtctgaatctgatgaactggttcactgattttcccacgtgacctgccatcaaccgatagtcctgcactccagttgtgcccacatgtatacgcagtattgactggccgaggtgatagtgtggtgtacggactgaggtcataagtctacgaagttgcgcagacctgaacatccagtaccctgatgctacagacgaggacattcacctcactacatggaaagcgacgaagttgcaatggctgcattcaagggcatgcccccgttgcccaacgacccttaaacgcgccttctgattgggacaagccgaggggaagggacccagtctgaaaacgaggtcaggtgggactgacccgaagtgctgaaacccagagccagcatagcagtccagaatatattaagacggtaagcacaattgattgagagccaatgtagcattccgatttgatgatagtccggaactttccaaatcagctggaatttccg

SEQ ID NO: 611741 - DNA, 219 bp, Homo sapiens
tccactagtgtaggccttttgggttacaagtggttttggttacgtggatgaattctataatggtgaagtctaagattttactgcaactgtcacccaagtagtatatattgtatccagcatattgtcctttttttttttcttttttttttccattccaccatggcctaatgaaaattttgttaggaactgactttaggccccctttgacctaccttgacc

SEQ ID NO: 611742 - DNA, 427 bp, Homo sapiens
  misc_feature (293)..(293): n is a, c, g, or t
  misc_feature (382)..(382): n is a, c, g, or t
cctcggaaccatggcgtccctttcccttgcacctgttaacatctttaaggcaggagctgatgaagagagagcagagacagctcgtctgacttcttttattggtgccatcaccattggagacttgataaagagcaccttgggacccaaaggcatggacaaaattcttctaagcagtaaacaagatgcctctcttatggtaaccaatgatagtaccactattctaaaaaacattaatattaacaatccagcaactaaagttttagttaatatatcaaagattcaaaataataaanttaataatagcactacctctattaccattttagcaacagaattattaaagaaaacagaatctttaattacaaaaaagattcatccacanaccatcatagcgaattaaagaaaagccacgaaaactacaagagaa

SEQ ID NO: 611743 - DNA, 1188 bp, Homo sapiens
  misc_feature (363)..(363): n is a, c, g, or t
  misc_feature (365)..(365): n is a, c, g, or t
  misc_feature (387)..(387): n is a, c, g, or t
  misc_feature (590)..(590): n is a, c, g, or t
ctctataaaccacaatagaactttggaacactatacctattgagttcgtgcgcatgagctggagtcctatggcacaagctcataagccgtccttattcgaagccgagctgggtcccagtctcaggactaatccttctagagttgaacgtaactacttcgtacaacgtttcatcggtcgacagagccatgcatgttgtaataatcttcttcgtagtaatatcccatcataatcgggaggcttaggcatgctgagctagattcccctaaataatccgagtgacccccgaatagtggcgcttgtccgccgacactagagacaacaataacgcattctgagctcttaacctgcccgtctctctctancntccgtgcatctgcagtcgtgcntagtaggttgagaccgagccggggagcaacggtaacatgagtatgtaacaggatcatatgctcgtcctcgttaagacaagaggagatcgtacctcccgactccctgtgagccgtccgctcagatcgctaacccagtcgtatcgtctcttagcagccctagccagggtgatcatccgtgctatcgtgtagcgcggaccaatcanattttcattcacaaacgagatttatcaggtattaaaacctccacatgtcataagcgccgaaataaccaagacagacccccttcttcgatcgtgaatcgcgttccttaattcactaggcagatcctaagttgtgcgtacctattctcattcccaagtccctagtcgttgctgtggcatccactatttatttacttaaacagaatccgggagagcttcgaaatccaagctttcgttcgacccccggcgggagggaggatgaacccccactttctaatttgcaaagaatctattacgtagaagtaatcccgggcacccttggaagttctatattgggttatcctaaccagggggttcccggaatagtcttccaaattggctacctcaacaaaggtccggaacagcaggaccccctcttggactccacacggggtttcgaccggagcgcactgggcattcactggggccccagagggttaaccgcgtgagacgccaatattctacggcgacatgtccgctaacccacagacgtagtgtacgtcggccagttatatcggcgtacccacggggatacagatatagcgaccacagccacggaaat

SEQ ID NO: 611744 - DNA, 642 bp, Homo sapiens
aataaaacattatgtataaaagtcttatttttcacatttttcatccccaagactacaccctcctcgtggtatcgggggttttctctctaactttctaaaactcaactacctctctttactctggttcggcgcgtactcacccaatgtctcctacaagtgtcaattctttatcttcttaaacgactttacagcacacaagtcttatctttcaatcaggtcctattactattcaaatctaatactgtcacaattttaaaaacacaattatccaatactctgtcttttcacttacatataatgcaattaccccagcctttgatacagtgaattctacctaataaacacttttagattctattccacataaaactcattcctttttatgccaagtcaaaacgggccctccatgctccactccttctctgggttataccaaacatatttctttttcactttcataaactcgacttttttcatgctactccttataaattaacactttcaataactttctcataactaatttctcagttcattataactaccaaaaacactatttaataacttttccgcaataattaactataacttcattaaaatatatctttacaaataattactaataaccttcacctttcaccc

SEQ ID NO: 611745 - DNA, 105 bp, Homo sapiens
atagatcgagcagtgctccatgcttaactgatatttggaggtcagcacaggtgctcactgtgtctgacggcaacttgtacatgggaggcatgcacctgaagtggg

SEQ ID NO: 611746 - DNA, 310 bp, Homo sapiens
acacgctagcggttgcttcatcagaggtgaccaaaccagaagaaccaacaatactaatgactgacaataataagtctagatgtaaccatcgtacaaataacttcataagtcacattcttaatcaccaatagaaaaataatgaacaagtaaaactcttataaaaccaatatttacaacaatcatgatcacttatagcattatcaccaccattctttaatcactacttgtagtaattttaatcacaatcaattgttcatcatcatcaccaccaattgtcatcttattcactacttaccacaaccggcaacaa

SEQ ID NO: 611747 - DNA, 155 bp, Homo sapiens
aggattgttagagctcaggcgttcgaggctatgtagtacataatcacacctatgactagccactgcattccagcctgggtaacatagcgagcccctgtctcttaaaaaacaaaagatgtggccaggcatggtggctcacacctgtaatcccagca

SEQ ID NO: 611748 - DNA, 158 bp, Homo sapiens
  misc_feature (7)..(7): n is a, c, g, or t
cgcaatntcttgcgtccacctctcagaagtttttccaactgtgcggttgctgagcaccgctaggggaaatgagggtgacataagtggggtgattaggactgctggacccgtactgttatctcactcatgagggccgactcctatccccactttgattt

SEQ ID NO: 611749 - DNA, 1383 bp, Homo sapiens
  misc_feature (1383)..(1383): n is a, c, g, or t
cggtacgcgtgctcttggtgcgtaatcttgatattgtcatgcttgcagcttgattagccgactccttcataccaggaccagtagccgaacgagcaacataaaacgatcatcacccactaggatgagcagacgaactgatgacaccactgtagcacagatctgacatgaaccaaacgagcccctgaactacaatcacaactgtgtccaaaaataccgacctatccgcattgacgggggagtcaagtcgcgttagtctaattaagccagtgccaagtatacctatgtatatgtgtacctttgcaggcgagggggactgtttttgtacgtggaaagtctcgtttgtgcagctctagcatcctcgaggactcgtaagggcccccaatagacgcgcgcgcgataccgaaagcgggaagggcgaaactttctgaccacgcacaagagcgaggacgtctgtcacgctcgcgggctaaaaatttccacattcccaaaagctctgccacttgccttgatatctagaataccagtacttgaactttcgggcattctactgaaggtgattactaagagtctagcgcgttgagggcgacatcgcaattcaagtttcttgagactcaacatacatagtcaaagcacttgagagaaccttaagcctcacagtttgcattatcgccatggtatagggctgtacatccatcaaagtccttgatctctgtggtatacatctataccctttgtgattggccctataacaattatcaccacgactcgtccaggcatccctaccttctccgtcaagcgtaattcgccccatttcacaaccccagatctccctccgaaggcggggcccacgtcttacctaggcggatccaatgcggaaattgttggtgtggggtaattgcgcatacgagcgttttgtccacagctggtggacccttggccatcctccttccattttatttggtggccttccatatttttcctccctttctagtggtagtcccctcgtttagtaccaaatctcctgtcccaaaatcttaagaatttacctgtttacaaccctatttaccatgtgcgcaaatagcaatttcaccgttttgggtgcgttggccagaaaaagcgcccaaccccagtgcgtggcactcacattggggaccaattttcttgcttaaggaaatgataggggcgaccgcatcggtcaacatttacacaagggcacttggtccctatcccaacgcgtcactatggatttggcaccgggggtgctgtacaccagggcacagctatacacacaacaagaccctcctgacgagtacccagtgggaccccggccaagaaaaccctaccccggggttctcccccatcggagagatcatatcgtactgn

SEQ ID NO: 611750 - DNA, 126 bp, Homo sapiens
gttatcttgtttttaatattttctctttgtctttaatttttctctgttttattactgtgacttggtatttccctctttggctttatcctgtaatgggactctctcctaagttgcccgccaatcgaa

SEQ ID NO: 611751 - DNA, 318 bp, Homo sapiens
tactgtatctctaacatatgggcacatagtgagaccatctcttttaaaaaaaaaaaaaagaaaagcggggtgtggtgatgcgtgtcatagtcccagctactcgggaggctgagctaggaggatggcttgagccgtgggagttggaggttgtagtggcgctatgatcatgccacggagactctagcccaggagccggggcaacagagcaagaccttgtctctaaacagggcaaaacaaaaacaaaaaaacaaaattcaatggcatttttatatattagcagtgaacacttggaaatacttgcaataccatttataacag

SEQ ID NO: 611752 - DNA, 224 bp, Homo sapiens
gaaaagaaccatacatcaccaggccatatagcaaactgtgtaggaagccgacgcttatactatcttataaagcaatgatggtccagcacacacattgaaatgcagcatagcaagccaatacgcaatacattcaagcagagaaataggtgtcttcacctgcactgcttaaccgcatggactctgatgtaggtcacgtgcaccttagaccccagcaagcagcatga

SEQ ID NO: 611753 - DNA, 928 bp, Homo sapiens
acatcgtgtgccaaaggctattgctcatggagaagtgtcggtagccatccatcagtgctttcagtaatgatgagtgtaggacacagagccagccgtgggtcaggatgcgaattattgataaaagtctccaggtgaacatggctgaagatttgctaatatattaataattgactaggaagatgaacttgaaacaaatctttgggcagctgatagattcaaatctggatgggcatgctgtgcactcaccaatgagaccaaacagacatcttttgatatatcttataaatggaaactttacacagaagaaattagggatatgataaccactatagattccgtctacaaaatcgaactaattcttacagcttttctatcagttagtctatggaactagtgttgaagtatctggcagagaatcagggtaatccctaaggtcttgacaaaagagaagaaaaacaagcctcctcgtcctagtcttctgtctagcaaagggataaaccttagatggcagcttgtactgtgtcagaagtcccgggtatacactcgtgcttctgttggagagatgagacattagaccttagttccagtcttcttctgatgtttccaatctaccagaacccctcaagaacattgttgccaaatctgggggcaataggtggtactcaggattttaacccaagtgttcaaacgctattgactcctgaccttggttgaattcaaatgcgcttaaatttccttaacgtttcggtaagctctcagggacctacagggggctcaaaaagaacaaagcagggcgcacgacccgagaacgccggcaatccctccacccccattagataatatcacatatacaataatgtccagcacgacaagaacctgtcatctcacatccacgagcaccaaacaaataaatgtcccacagacataa

SEQ ID NO: 611754 - DNA, 222 bp, Homo sapiens
ctgtgtgtctgccacttagtcgtgctctctttgtttcgtcatctctctcttttgtctgcgtctctcttttatctctgtttctcttcactctttgtctctctcatctcttttgtggctgtctcctctccatctcttatctctgtctccctcttgtttctgtctcgtgtgtctgtctcttttatctcttcgtctctcatctttgtctcctcacctctctctctt

SEQ ID NO: 611755 - DNA, 873 bp, Homo sapiens
  misc_feature (853)..(853): n is a, c, g, or t
aagcatggtatcaacgcagagtggccattacgcccgggcgcagtgattataggctttcgtctaagattaaaaatgcctagcccattcttaccacaaggcacaactacaccccttatccccatactagttattatcgaaaccatcagcctactcattcaaccaatagcccgtggcgtacgcctaaccgtaacattactgcaggccacctactcatgcacctaatggaagcgcaccctagcaatatcaaccattaaccttccctctacattatcatcttcacaattctaatcctatgatatcctagaaatcgtgtcgccttaatccaagcctacgttttcacacttctagtaagcctctacctgacgaaacacataatgacccaccaatcaaatgcctatcattatagtaaaacccagccatgacccctaacagggccttctcagcctcctaatgacctccggctagcatgtgatttcacttccatccataagctctcataataggctataaaccaaaaataaccatttaccaatgatggcgcgatgtacacgagaaagcacataacaagggcacaaaacactgtcaaaaggctcgataaggaaatcctattatgactccgaagttttctcgcagctttctgggctttacatcagttagccctaccccattagagggttggccaaagggttacccgtatcttaagccattaacatcggtacgtacaggtcaccggcctgtttgaacccggccaatcgcggtgtcaagggggtataccaacagggaggggcaaacagggtggaatggacggaggagtagctgcgaaacagcgggtgtgggtcgcctccgcaacagnaacgaaagcgcgacaagaca

SEQ ID NO: 611756 - DNA, 1373 bp, Homo sapiens
gagatgcgcacgaagactccttgttctggtcacacctggacaccgtggtgctgactgaaataactttactcaagcggaccagctattttagcgaacttatcttcttcctagctggcatatcggcacaatgtgctctggataaccagtagccgatcactcggtgtgcgtatctcgcctagagattgcttgctcctgtaagattggaaagcggattgactgaatcccctatagcccttatcatacctgcaggcaccatacatggatatccggagtgactggctcatgatagcgacgttgcgtgacgccctacccatgattagtagtcgcgtactcgaaatcacgttgttgagagcattgcaatgaagaacgtaatgagagaccccgtaatggggaagactcagggatcatgagagatttcgcaaaagtttataccctggtggcacccccattgaggagattatctttgactctcgatcccaacctcttacctagagttggtgggccattcgtaggcctctactaccaaggacacggaaacaacaaggacgcattggcgtattccaactcattaggaaacgtcttttagtccccactggggaataggctccccataaagggcgacagagaagctccctctcttaacttcgcacatggattggaggacggtaacctcgttgtgggacaaggctctttcctgacgggttcgaaccttccgggcgcgatgggcaacacaatttaagttgggttgcggcacacgtttcgcaaaaactttgtgctcaatcagggggggctcaccacttgcggaattagacacagcccccatatggcttctgtcgacaaactacctaagaaggcggcacagccaaaggtttgtggaaacaggcccacagagtttcggacccattgataaagacaaccgtctctccacacattatctttcggacaacgagggcggtttggcaccaaaagcgaccgacttagggcaaacgcttggctcacccgaaactttatcccaacccacggaagttaggttccctaagcgacgcacattttggccttgcgccccaaaaaaaacaggaaatatttcgctgacacttttccaaccgacttagattctttcccacagtagcagaacgcctaacgcgccgtgtcatagtttggccccataaaaccgatgttaaccgttgagacgtcttccctttgaccccctgggactagacggcaacccagaacattagaatatacggctttacacagggaaagatcggaacgtaatacggagagccatctgggcagtcatttgagacagtaacgcctctgcacatagcacaaggtgtacggaaccgacacctctcggagacgacatggcccgc

SEQ ID NO: 611757 - DNA, 128 bp, Homo sapiens
cagcgggagcaggataaacagcgcaatcgccgccgtgcgaatcaggtacagcaacgacagcagatacttgcgccggaacagcccgcccagcgcgccgcagtaatacgtgccgacgatgttggcggccg

SEQ ID NO: 611758 - DNA, 364 bp, Homo sapiens
gggggggaaaaaaaattttctcctttttttggggaaggaaccccccgccattttcccccgcccgttttaaaaaagttggggtttccccttggtggcctttccacccttttttgttcctttttccccattgaaaccccccaaaaaaaccccttttgggggtttttaaaaggggtggccccctttcaaagcgttttttccctgggggggttttccccaaaaaggaccccttggaaaaactgggttgttttccctttttttgaaatttgttttaaaatttttggaaaccgggaaaaatttttggtttttttttttgtccaaaaaaatgttttttggtgggccaaaaaaaaaaaaattttggcccata

SEQ ID NO: 611759 - DNA, 137 bp, Homo sapiens
tgattcttacgggcagcacacacggtgtgaatgtcagcatgcaaacaaagccgaagaacagcaaggcaattgccccgaggttgccactgcccagcgtgctggcgatgcggccgagcttgtcgtcggaagaggactcg

SEQ ID NO: 611760 - DNA, 641 bp, Homo sapiens
aaagagggaactcaagccagaccagactgttcatgcaacacaattctatacccaatacctagactatacctacatagatgccctcttctgggccttcccaggccccaaccccatcaccctactttaccagttccactctaatttaagtcttagcaaacacctgtaatgccttgaagccagaaagtgaagtcctccactgtgttgtcaaggccaccaggagaagtggatagaaaattagtcccatgttcttcaaaatataacaacaaactcacttatccaaacaaataatagtgattaaggggtattatgctattactgcaaaaggaccaacagtttagaactgggaaggctgtgtactataagcaaaaaaacatggactttggagcctcatcgaaatgaattacaagtggacactacaacttaatggcaagcctagtatttaactcagttttcacacatctaaaatgcaaataataccttctttatagagctttgggacattaccataacccaaaatctgtacagtgcctagcacattggttggtgctccattcacctgttcattattctctttttctttttcaagttttccaaagattacccaagatttgatattacctttatttcccccggacacacag

SEQ ID NO: 611761 - DNA, 140 bp, Homo sapiens
atggcatcgtattcagggaaagaaaagctgttagacgccaattaaggttatgaattctgctactactttaatattaaacctttaagtgacactttattgaacactattacaaatgtggccaactgacatagctggtttac

SEQ ID NO: 611762 - DNA, 1134 bp, Homo sapiens
  misc_feature (120)..(120): n is a, c, g, or t
  misc_feature (495)..(495): n is a, c, g, or t
  misc_feature (501)..(501): n is a, c, g, or t
  misc_feature (950)..(950): n is a, c, g, or t
gtgttgtccaacgccgctcgctgttttgccctatatgttccacggtattttattgttgccacgcccgcaaaattagatgtttaaatttgggagggcgcccccccttaatcgcttgttggngggacacaaaattctcagcatggtgtttaagacttcggggaagattaaaaattttgtaaggagaaaaatattatagatatagtgtttccccccttagatttccaccgctgataaaattggttggtctatccttcggagagcgcacccacaaattttcttaatgtgggtagaaatctcacatctatcacacagtgattttgggccgccccaacacgttggtgtttttcgtgctttttgagagggtgtgtgtgttgtatatgttccacataggacgccacacttatggtgtggtgtacagcacgcccacattgtcgcgtgatatcgcacagatgggtgagagatgtatatatgagacacactcgcgacatatatatncgcacntctcacacgggcatatatagagtatatatgttgtttgtgtggggttattatcttgcccccacactgtgtataaagagggtatatctccacgcgtatatgtgtgtagatgcacacacactgtatatgtatatatacaatatatatgtagaaacaatatgggagattgtataaatacgtggtataatatatacactcgtggttttatatttgtgggccacgcgtgagcacgtgtgtataataataatctcatagagaggtatatatataataataaagttgtgtttgtatacgtctggcgcgtgcacctcacacacacacacacatcgggctataggagataatatacactcctccacacacaatataagtatatcttaacactttggcacatatatggtgaatataaaggagagagactcgggggctatatataatatataagattattnttgagggcacgaacacgaggaggctcgttaatcctatactgagtttagtaatgtttctgtaaattgaggagaaaatgttcacccacacaattattaactttttaagtgagtttaaacacatggacacttttaataggggacatgttctgtgtatagcgaataaataacttttatagtatcacca

SEQ ID NO: 611763 - DNA, 590 bp, Homo sapiens
caacgatggtcctacagctgacactgcggaggaggagagggaagagatatcatcccctcctatggcaacctgtgggatagcaatggcccttttcctgttgggtgtaatctgctgccatctcttgctgtctgcagcctgacacagaagggtgaaggtcaccaggttccactgacagtggtctttgtctcaagcagcaaccctaggacagtggctcccttgcaagattcagccacatctcatgactgtctgcaacacaccccatgcctctgatggaaggaacccaatgccccatgctacacccatttctgccagactggggtccctgatctcaatttccctctgcagtccccaactctggggtctgcagacacatttcagatccatccttagtacctcccaggaggcagaagccagaggaaataatccttgccccaatgcacctgaccatgccacttcactgtatgctctttctccctctccaggaaaaatcaagcttgttgaatacttaccaatgtgcccacgtacatttagtccccacaaccacttcatgggacagcattatcatccccaagttacagatgaggaaattg

SEQ ID NO: 611764 - DNA, 136 bp, Homo sapiens
aaccaaaccaaacaaaacaaaacaaaccaaaagaagctatggaagggccttataagctggctcagaaccaaggacttcctacctttctctggtttctccccatctcccaagcacagggaggggcactcttgggaag

SEQ ID NO: 611765 - DNA, 120 bp, Homo sapiens
ctccaatcagtgctcccctcccatcaaaccagcgtattgtgtgacacgtcgttggactgctgtttttgataaccaacaagaggtcaatgtatagaaatccgctgatgggagcaagactgg

SEQ ID NO: 611766 - DNA, 362 bp, Homo sapiens
ttcgcggaagcaacactgtatttgctgactggaaaatcaaagataacttaaagaatgtcttgatatttcaggtgggacttagttattaggcagaccttggcttgcgcacctatttcttccgatcccggcgccgaaacaacaccgttttgtagtccttaatccacgatcctcatgaatgtattgatatgatggagtgcagacttaccttattagagagacctagactcaagcatgctattacttccccgtagctcgaatacgaaaaccgttgtctattctttatccccttccctcattaaagactggtagatgactcagtggccaaaagaagacagagaccaaaatgcaaaagggtaccgagc

SEQ ID NO: 611767 - DNA, 125 bp, Homo sapiens
  misc_feature (18)..(18): n is a, c, g, or t
  misc_feature (87)..(87): n is a, c, g, or t
tcggtaccgcgacacgtnagctggacccgcagctgaagcggaaattagacaggctggcacctccggaaaaactgcctttcagccttngtgttccgtgcggtacgtgtccggtacgtgtccggcca

SEQ ID NO: 611768 - DNA, 148 bp, Homo sapiens
ccctccctattgagacatcagctcaggccagaagcacctggacactccggagcttgtggactgcgtactgacgtgtgctggaagggcaggactcaataatgagatcccagtttgactcccatctgtatgtactagtgcccgtctcctg

SEQ ID NO: 611769 - DNA, 182 bp, Homo sapiens
gtgacatcgtcttttaaaccctgcgtggcaatcctgacgacgcgtgatgccaggagacaggcgactgagtcactacttctagatcatcactattgatgatatcgaatgttcatgtgagcagcatgtgctcagcagatgcagcagatcgcatgtcctcgcggagctgtgtctgatgcagacac

SEQ ID NO: 611770 - DNA, 378 bp, Homo sapiens
tgtctgcacggatggcaaatatcggtcatatgacccgattgcccgggtttccattgtaggactgacagctcaagttgcctaaagtgtggaacaagtactgacaggtagagggagtttcactctatgtctatgtgaaggaggaccttaaagagattctttcctgtataatacgtgggatacagtacactgccaggtgaaatcaggagcctaaataaagcatgcttcgcccacaccgcctgtatgagacccgcgaagcttgggggtcacattgagggatgtagcatctgtcgaactgcaccatgaagcttggagtgaagctcttccgggggacactgtgggcttcaatgtcaaggaatgtgtcctgtcgaggatgtacgg

SEQ ID NO: 611771 - DNA, 137 bp, Homo sapiens
cagaaccggaagcagataggaaaatgattatgagggcgtgatcatgaaggtgataagctcttctatgatggggaagtagcgtcttgtagacctacttgcgctgcatgtgccatccgaacttctccttccttcgcacg

SEQ ID NO: 611772 - DNA, 906 bp, Homo sapiens
  misc_feature (2)..(2): n is a, c, g, or t
  misc_feature (98)..(98): n is a, c, g, or t
  misc_feature (100)..(100): n is a, c, g, or t
  misc_feature (167)..(167): n is a, c, g, or t
  misc_feature (391)..(391): n is a, c, g, or t
  misc_feature (502)..(502): n is a, c, g, or t
  misc_feature (574)..(574): n is a, c, g, or t
  misc_feature (600)..(600): n is a, c, g, or t
  misc_feature (604)..(604): n is a, c, g, or t
  misc_feature (693)..(693): n is a, c, g, or t
  misc_feature (725)..(725): n is a, c, g, or t
  misc_feature (754)..(754): n is a, c, g, or t
  misc_feature (765)..(765): n is a, c, g, or t
  misc_feature (767)..(767): n is a, c, g, or t
  misc_feature (788)..(788): n is a, c, g, or t
  misc_feature (796)..(796): n is a, c, g, or t
  misc_feature (820)..(820): n is a, c, g, or t
  misc_feature (842)..(842): n is a, c, g, or t
  misc_feature (902)..(902): n is a, c, g, or t
angggtgaggagagggagaaaaactgaaaaagaaaagagagaggagagaggtttggggcaggggagaaaagccagctagatttggggcggcaggagananttgagggggtgggggccaaggtggggccacaggaagagagggctcctccccccagaatacaaaattngggggactgaaaggggcggtcctgggcctgcgggacggggaagagaagggcgatgtggtggggctgaggtcagttgttggtttccttctccacccaaccccctgggttcctgcgcaggatgagtttgcggatttcgtcgtagaaatgtatgaggaaactgtaggggaaggcacagaaccaccagctgggcttgagagggtacatgcgcgggccacgtccatgcnggggcagtgggacaggaaggcagcaagggccgtttcctcaaacagcccgaagatcaggatcttgttcttcatgccctgctggaagaccgagttcctccgggtcttgcagangatcagatcggcccactggacgacaacaatgctcacaaagaaggccgtgtggcaggggaactccaccacctncctctgctcgtatgttcactgctgcncgtnactgttttccaggtcattgacggtgcggtcatcccagttcagccggatgcccaccaggttgccgggcaagaagccattttctgccaggntcacaaagtaagaaaagaagccaccgagagcntgggtcattccaatctgcccgtggcccangctgaagagtntnttattgaccaatttgtccgtncgcgggtncctgggctgtctcttcatgaagtngctttcggcagcttcgtacgcnattaagaaggcagggaccatgttagttcccagatcgatgcagaagatggtgaaggtgccnaggg

SEQ ID NO: 611773 - DNA, 192 bp, Homo sapiens
tagagtcagctcaccaggatcttctttccccgctgattccgccatggccttctctcatatacctttatagaagaggttccatgataaactagaggcacagggagatgatatgactatgcctagagtcacactagcatattacagtggcagtcagtaccatatctgaccgctagagatctatactcatgcaac

SEQ ID NO: 611774 - DNA, 151 bp, Homo sapiens
catcatgtaggcagtggtccaaccttctggcaccagggctgttttgtggagacagtctccggggactcgggtcgggagcgtttgttcagatgaccgttccctgggatcacagtgttagtcttaaggggcagcaccaggccctcactgggca

SEQ ID NO: 611775 - DNA, 381 bp, Homo sapiens
cagttccccactgatatccatgttatacccagagtatagctcccaaattcacctgtaagtgaaaacttgcgatatttggttttctgtttctgcattaaattcgtctagggtcaatggcccccagactacatacgtgtagtcacaaagcaacatcaattttgttcttttctatggctgtgggcaaacttaacacacaacaaaactcagatatgtgatctgaggttcataactgatttttatctcagaaactcatatttcacttttgtgttcttgtctattgtaggttttaacacatcaaagctgggaaaatcggagcaaattgcccttccccatggccagcttgtccatggtatacacttgtatgagcaaccaaaagataaa

SEQ ID NO: 611776 - DNA, 334 bp, Homo sapiens
cggtgaacgccaaagccagcttttccgccacgacaccatcgaaaggagcgacgatcatcgtgccacgttgtgctcgttcggccaggccaagcgccgccttggcagtgcgcgcttgaccctctgcgaccgctagctgcgccttcgcgctctcgaacgcagcaggggagatgacttcgctttcgagcaaccggcgctgttgatctgtctgtacacgtcgatccatcaggccggcttcggcggccgccagggatgcttgcgcttgtgtcacgcgaagccggtcaggttgcgcatcaagttctgccaggacttggccgcgggagaaccgttcaccccc

SEQ ID NO: 611777 - DNA, 835 bp, Homo sapiens
tgggcttactattcagaagtttattggacctccccagccaggcaggccaacccttccgagcgggggaaatgtccatctagcggccctctgctgggttgacagcctatgcccatgaaagggtatctgggaagcagggagggagcccgtggcgtagggcaggccttaaacgcaagggaagctggagcagagatctgcacgactcaaccccattggatattcttctcctgcctcagtcagggccagcggtggtgggtgactagagccgggggccagatagtccggtggccatctgcgcagggtgaaacgctggcctttctctaaagatcatggggtgcccgccaagaattgcgggtggacttccgggtcttcccggggcttggggaaggctctttctcgggggcgcaggataactccgacgggccatgtcccaatgtcggggagaacatgacgggcatgaaggtgggacacacaggggctggtgggcgggcaccttcctcctggctggaggatgtaaaccctggggcctccacctttggggggggcttgagggaacctggctggaccttgaccaggccccgccgaagtcctcccggttcaagcctcggaccaagggccccgaggtttatctccgggcctcggcctctccaggttcttgtgggacacatctcaattgcgtgtcaccacaggtgcgggatgttcttgaatgtcctaaggaggctcacacttcgtttccgtctttaaaatggcgcgctctagtgtccttgcacatgtggcccggccatggagggaaaccgctccaaaggagagaaagtccaagtcggcgggctggaatatg

SEQ ID NO: 611778 - DNA, 443 bp, Homo sapiens
ctagagtacccccctcccccacagtgagcatgcctcttcagaggtagagccaaagccttattgtgaaaggcctggacttggcctaggacccatcaggcctgggtctctcacgcataacatgcaaagtggattaatcgccaaagattcttctgatctgacattaggaaatggtgagagaaactagatgactgtaaacttggtcacaggcctggtcctggcagttctttgcggacttttctctagcataatgccaaataaacttgcagtctcagtgtgctctcgattgtatgaatatctagtcctttctgtggtgctcagccaagacataaaatctaggattcagagcacatacaataccagttatgtttcggaacgagggaaaagagtcccctagcccggatcttgtgctgctttgctcactgtggtgtaagggaggtccgagc

SEQ ID NO: 611779 - DNA, 2323 bp, Homo sapiens
ggcacgaggcccgccctcgctccctccactcctctcccctcccctccccggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggtggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccgtgggacagccccgccgcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaag

SEQ ID NO: 611780 - DNA, 365 bp, Homo sapiens
tgccggtaccagcgctggagcgctggcaaacagccacagcagcacagggtgaagcaccacatcaagagcgtggtcagcaccgaaaagtaccattgcagggtaaacgcctgggcgttggtcagcaggtagtcgcgcgattcgggcatgaagatcgccatggcgtacaggagcagcatcaggctggcgctgagcagggtgacgatcagataggccatcggggccagcaaccaaccgccgatacgagagtattcagcttgagacataaaggcttcctgattgaaacggggatcacaggcggcatagcttagcgggtaataccggcttcgtcatctcaatcaaccggatagctcggcatcgcggcgggt

SEQ ID NO: 611781 - DNA, 880 bp, Homo sapiens
  misc_feature (226)..(226): n is a, c, g, or t
  misc_feature (454)..(454): n is a, c, g, or t
  misc_feature (635)..(635): n is a, c, g, or t
  misc_feature (769)..(769): n is a, c, g, or t
  misc_feature (854)..(854): n is a, c, g, or t
tctaaattcactcagcttggctggagaatttggttccttggtgactttagaactcatcagagggctgggcacgggtgggtcacgcctggtaacccccagcactttggcaagggtaagggagggccgattggttttggagctccaggcagaacaccagaccctggggccaccattagaccaaaaaccaccatctcctattcaaacattaccacaaattggccccaantcattgggtgggtaccctgcaggtccccagactactgtggggagcacatggaaggctggcagcaatctgcttgtgggccctgggcaaggcggcagggttgagcagtgcaacccggagcatctacggcccaatggcacatcccagagcccctgggcatggaccagcagattaaaaacccctggtcttctcaaaaacaacaacaacaaacaacaaacaactctggagggnggggggcgcccggggtacccccaaattctgggccctaattagatggaggtccgtcaattcaccaaattccacatgtggcccggtacggtcttcaacccaacaggtctggtggacatggggggaacaaaacccctgtggcgggttaaacaccaaacatttaactctgggccttgtgcagagnaccatatcccccctattctggccaatcatgggcgggtaaatatagcgagaagaaggcgccccggtacacgcaatctgggcccttttccacaacaaggatgtgcgccaggccctgaaaatgtgggcaaatggggnataattggttaagccgtttaatactttttggtgttaaaattccgcgggtttacaatttttggggttaaattaaggatctattttntttcccaataagggcggatcggggcg

SEQ ID NO: 611782 - DNA, 539 bp, Homo sapiens
  misc_feature (92)..(92): n is a, c, g, or t
ccgccgtaccagttgcgggataagctcatgggactccaattgcatctaaataaatgtgagagtcgaaagacccataaggggcttcccttgtnttacgatgttgtattttccctctctcatagttgatgaaatgccagggtgaaaggaacagccaactggactagagcacaagtgtcactccagttaccaggcagagtgtccagtaaaggttgaccactaccaccatacatctgctcggggatgaaaaagggctgattgatcagtaagctcttgaaaattcttaagctcactgcatcccttcaggtctccaaaacactaagtttcctccttgtcgtgagagacatgaagcgaacttagtgtcggaagacagagactggatggccctcgggctgacctgcagggtgttgaacttcgggatatagcagagagagagcttggcacgacttgttaccccaggctgtggaatcctggaaaagagctaccatacggcccatgcctggtcgactggaggaccatcctagcgcaactggtacggcggg

SEQ ID NO: 611783 - DNA, 259 bp, Homo sapiens
ctattcacccaatcccggtaatatgagatggccagcaggctcgacacaatctatatcagaaggttatggccctatatggcatcagctagcatgttaacaccaaaagccttatctctatggaactatctgcgtaaagaccttagacttgtaacagacctggaaactaagaaaagcttcgatcctcagcaccaggggagtgccattcagattatagaagaacctatacaggcccactaatgaaagactattctagcaggat

SEQ ID NO: 611784 - DNA, 237 bp, Homo sapiens
actgcgaagcggctctttgggaatagtgtacagtttataacttatgtctgggagtgagggatgagattgcttacggagatagtatggagaagataagggggcttatgagtcagccctgtgaatctttcacatttgaaatttggtagaaagaaatggaacaaaagaggctgagaaggaagaagccgcttcgcagttcgcagtaagaagccgcttcgcactatgaagccgcttcgcagt

SEQ ID NO: 611785 - DNA, 491 bp, Homo sapiens
cacgaggggtactctaaacgatgccatgggaaatacagaactctctatgatccctttctttgtgggattaacagtgttaagatcccttgttttcatttgatttaaaatgccacctgcaattgcaatatgcagaataaatggtataaagaaagacatacaacatcttttcatttcacttatagctcactgtatgatcaaaactatgttacttgacttcacagcactccattccatatccataaatgatacttatttaccatttctaagcatcttgagatctcctcttaaaatatgctttgaactattcagtctaaatgcagcattctaaaaagctactagttaaaaaaataggaaatggagttaatggagttaatcttgtgtaaattcagagtgggatgtcaagaatacctctaagtaaagaaaatgactctaatcttcttaaataattcattttctcagcaactttgatgcacgagttaatttactctgcc

SEQ ID NO: 611786 - DNA, 401 bp, Homo sapiens
atccatgcttcatagttcataagtactctaactaggcactgcacttcatagtagcatggtcatgtcgcacttggttatcatatttcgtcagcatcatcagtcagttgcaatgctctgatctcctgctcatcctacaatcctttgcgtccgtaggtatgtcatacgtcggtcagatgctgtagattgtagtccaccgtggtcggttaactacgcacaagatctccatcgcaactggtagtcatactcttcctccagaatcgttcttatcagacagcctgtgtgcctctcgcactgtcatctgcttcagttgtcacagctcttcctgcttcagcctggacatagtcaccttcatattgaatgtgcaaggcccctcacatcacgtgtcattacatggaccttct

SEQ ID NO: 611787 - DNA, 2114 bp, Homo sapiens
cggcgggcggcgagcggcgcgcacaatcctcgctcggctgcggctcccgggtgtcccaggcccggccggtaagcagagcatggccggtgcgggcccgaagcggcgcgcgctagcggccccggtggccgaggagaaggaagaggcgcgggagaagataatggccgccaagcgcgcggacggcgcggcgccggcaggcgagggcgagggcgtgaccctgcaggggaacatcacgctactcaagggcgtggccgtcatcgtggtcgccatcatgggctcgggcatcttcgtgacgcccacgggcgtgctcaaggaggcaggctcgccggggctggcgctggtggtgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtagcctgccactccgtgcattgacttgatgcacaacatcacaaaggcgatttttgagaactgatagtgcatcagccgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaaggagagatcaatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgcacatgatgtgcttaatgaaagtagcaaattgcttcaggagttgagacaggagggagcttgctgtcttggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggatacagttgatatattagttggatggcatagagatcatactcagaaaccttcgctcacgcagcaggtatctgggtggttgcagagtttggagccattttgggtagctgatcttgcatttcctacgactcttcttggtcagtttctagaagacatggaagcatatgctgaggacctcagccatgtggcctctggggaatcagggatgaagacgtccctcctccatcagtgtcatcaccaaagctggctgcgcttctccgggtatttagtactgtgctgaggagcattggggaacgcttcagcccaattcgggtcctccaattactgaggcatacgtaacagttgttctgtacagagtaatgagatgtgtgacggctgcagaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattataccatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaaattggg

SEQ ID NO: 611788 - DNA, 1076 bp, Homo sapiens
cactggtgcagagaggagggaccccgttcgtgcattctgacaggatcttgtgccagcctgcatgtgtgagtggatgtgcatgtcatctgccattgactagatggccacccctgtgacaccccagcattgctgtctgttgtcacttgaactggtgaaccactgcctgtgctgcctgcctgcgtgattggagtgctgtgcagattgactcatgtgatgttgcatgaaggctgactgtgaccgacgacgtgagactttcacatgactgctgtgttctgcactcccgatggtgacgcgacgcattttgcctgtgtgcaaccttgacacaccttacaacgcccgacctttgccactcacatgcttgcctgtgcattgatacatgattctccaacacgaaccaaatttgcaatctgctaggcctctgtcatacaaacctgtttgtgtgtgtgcacccccctgcctggccttgacgaattgacaccatgctgtgccctggtaacgtctttccaagccttgatggcggcctgttgtggcctattttgccagacccggggcacaccacggactcgcctcctgcccagtcttacctgcacttggccatctacagcactgtgcctatccgcccaagggggcaccaagaagtccacacatcgacacagtccgcgccttgcgacccaacaattgttccgtgcttggagcctttgtggacgcaggagcacaaaatcgggatccgggcttccccaaatatccaatttggggcagaccaacacaaccagacctggtttccttcccactgtgcgctacaaaagataccgatatgagcgcaaggaacgaaaatcagcccacacaacaaagaaccgcccgcacactggcacccagtgcaatcaaacgcgccggccttgcgcttgaactcacatccgcgtactgtgattccaagaactgctctctaacacccattgacagaacaccccttgctaacccactgtcccaccaccagaacacccgacgtagacctcgacacccaagcaacgtccatatgacgatcccccaattgccctccattggtgtctacacccagg

SEQ ID NO: 611789 - DNA, 228 bp, Homo sapiens
gaggagtcccagtgaaacctccggcctggtcaggaggtcagggagggcttcctgcagcgaggtgagaagggatgctctggcagtgttgtggctccagacaagagctgccgtttgagagtagctgaggcctgtcaggtttctaccagcccagttacagatgtggctgctcagctcagagagaggggttgtgactcccctatggaccacttcttagctgtgtgttcctag

SEQ ID NO: 611790 - DNA, 201 bp, Homo sapiens
tgcctgcagatcacactagagatcccctgggcagaaatatatgaaagaatcagtttgccatcccaatgctaccactgttaatcttttggtgttcaatgttccccctagacatttctgtgcatagatatctctggtgtgtttacatagtcgttattctgtatataccatttctgtgcccatttcaagggtaccgaggctaca

SEQ ID NO: 611791 - DNA, 841 bp, Homo sapiens
ggaggctgtgccggtgggagagggaggcgagccgaccggtgggctgctgggctcccgcggcgctcgtgctccccgccgcagccaggcgcaggcagagcgcaggcggggcgggcggcatggagagcctgctggagaatccggtgcgcgccgtgtctacctcaatggagctcacgggcatcgtgcaagaaccatgcagagcctcatccatcccagacgagagcgtatcgacgagctggagcggcggtggacagatgctgagccgcttgagaaccgcagcctgtgggagcaaacagcaagcttgttgcaaagcccagcctccgaccgggtactggtaccccccccgtcatacggccccgatgcctggccggtccgtggccacaccggattcctagccgccgccgaccaaggggcccgaggaaacctctccgaaggaccaggggacagggctcaagcagcccggcgccccgattcccgggccccggatcggtgcacgccgcggtcaagcaacgccacgggacagggctcctggaagcatgcacacccaaggggggggacacctggacaagcccaagggggcttcaagaagcatccgcaatgggtcggccccaaaaaaggcatcctggggggaacacaaaaagggggggcccgttgcacgtgacccaacgggagaaagggacggcggtacccgcccggaaggtttggatgcggcatggtttgcacgggaggcacccatcacgttacaagggcgacagcaattccccctttccggagccttcgagcaaagggggaggtcctgagcgcgagtgagcaccttgaggtgaccgggcgcacaagggagatg

SEQ ID NO: 611792 - DNA, 627 bp, Homo sapiens
gttccattccagaccaccacaataaagcaaatattgcaataaagcaagtcacacaaattttttggtttcccagtgtatataaaagttatgtttaggccagacgcagtggctcacgcctgtaatccaagcactctggaaggctgaggcgggaggattgcttgaatgtcaggagtttgagaccagcctgtgtcaacatggtgaaaccttgtctctactaaaaatacaaaaagtagctgggcatggtggtacgcgcctgtaatcccagctagctcaggaggctgaggcagtagaatcgcttgaactcaggaggcagaggttgtaatgaaccgagatcacgccactccactccagcctggacgacagagcaagagtctgtctcaaaaaaaaataactaataataattcacaataaagagtcatgttctacattatgctgtagtctattaagtgcaagtaggattatgtctagagaaaacaactgaatactgtcttaaggtaggaaagacactttcttgcgtaaaacagtactaacaatcatctgaagccttcaggcaaggtcattatctggtcagctggtaagagtgtcttgcctcccatgtgggtgactgctcacccattagtgtggtgg

SEQ ID NO: 611793 - DNA, 905 bp, Homo sapiens
  misc_feature (280)..(280): n is a, c, g, or t
ggccgcagcaagatttgtggggcccgttttggtttgggcccaaaagcggcttgttggacgcagacagatgattttcctgaagagaggtggtgcaacatctgttgtgtgggggcgcaccgacacgtaggtgtctgttctgctagggagaactctctatataaacgggcgtgggtataacaggaacagatggcggtgcgtcctgcttgttgtctgcacaacaagtgtcgctgtgtcgggcggcgccacacagccccccccaccggtgatatatacaccccgncttggtgtggacgcatcgcctgtgttgttcttttcgcctctcacgagaatggactctactacttctgttgtgcgatcaagagaagatagagacgcccccgcgctacgggaacacacactaatcttctgttgtgtaacaaaacaagagaaagggcgtactatagaaataaagatgtctgtgtggggtgcgcccgctaaacacacctcttctctgtaaggaggtacatcacggggggcgcatatttcatatcatgttaccgcaaaggagtgatgtgacaaataatgtgctcgcgtctggttgataacgcgctgtgggtacatgcctcgccgctccgcacgcgcgctctctaatactgatgtgcccccactgtttgtgtgcctaaaacgtggggtttggggaccaccggggagcaactattgtgggaatattttgtgggcgcctctttaagatttctttttatacgccaccagtattcagagagtgatgagagaaagtccccaggagaccatgtgtgtctcacacagtgttttctcatgtgtgcggggtctctcgtcgcttactctcctctcgttgagcagcatatacaagaagtagctcctccggaccacaacaaatgtccgaacaa

SEQ ID NO: 611794 - DNA, 333 bp, Homo sapiens
gcacaaggttttgcctgaacccctggttcctcttttaagttcccagaagatagcagtagcagaattagggaaaggattaaagtctttgatctctcggaaaagggaaaaaaaaaaatgctgacaaaaggggtcctctctcggcttcggcgcccccaaaaaagccccccatgtgatttgcttgcccttatcaatcacttgggaggactccctttccttaccctgcccccttgccttgtaaacaaaaaataacagccccttcaggcattcggggcccctactggaccccgtgcattaatggtaggggccccctgggcccaactgtttttcctccta

SEQ ID NO: 611795 - DNA, 559 bp, Homo sapiens
cgacggacggaggacggacttatgactgactgacttcacagtgagcctacatcatctgctcagctcctgtgcagactgggtgcatggaagacatagaccacgatgtactcagacggaggattatcgaaccctcaccacctacaaggacttcagccagtttgtcagacccctcattgctgcccaacctcccaagattgctgtctccaagatgatgctggttacgggtgcacaatggcgggagtacagtaccaataaccccttcaaaggccgttcttggggcatcaagtggcagctgcggcaacagcagcggtagctgtggtggagagcctggtgcaagccactgaggtagcaccatcacctacccctgtggaggtgcctatccgccaggacaagaccacggcgggccaagtgtcccactgctcggaggacgcccaaaaggcagacctcgtgtccctgatgccaaagactgctacacccaagaaagtactcccctgaaaatcatgctgggaggtaatggttccacgcgtaagagatcatcgaagtaggctgctgacttaac

SEQ ID NO: 611796 - DNA, 153 bp, Homo sapiens
  misc_feature (116)..(116): n is a, c, g, or t
ctacgacttcgagctcgtgttaccctaggcgcatctgttagcaggtgaatggcgaggtgaaagggcggttcagcttacgcttgccatcgtgagtgtaggctaggcatcggcagctngccttgtgtcgcttcgtcgtgcagagcgtctccagga

SEQ ID NO: 611797 - DNA, 429 bp, Homo sapiens
  misc_feature (8)..(8): n is a, c, g, or t
  misc_feature (102)..(102): n is a, c, g, or t
  misc_feature (240)..(240): n is a, c, g, or t
  misc_feature (333)..(333): n is a, c, g, or t
  misc_feature (417)..(417): n is a, c, g, or t
  misc_feature (422)..(422): n is a, c, g, or t
  misc_feature (428)..(428): n is a, c, g, or t
acgagccnactccccggggccatccaaaaagccctccttttatcccagagactccccattcccctcccagtatcccaacctatttagtaccccacctatatncccaggcacctaggcaggagactggtgccagctctgcccctaaagattcacagtcctgagtggagagggaagtggggacacacatcaaaagttatgacagtgcatcccagcaggtgttttgatagatgtacacacaantgccgccgtggaagcaaacaggagtaatttagtctgcttaggagtggatggggtggctataaggaaatgctgctttgaagaagcaacatttgncctgggttttgaagtttgagtaagagttcatcagggaaccataagtgtaaaggcatggaggtacaactattacgtacccaatangatgnaattcnc

SEQ ID NO: 611798 - DNA, 855 bp, Homo sapiens
taaaaaacggggtctcggtatgttgcccaggccagtctcaaactccgggcctcaggcagtcctccccgaaggggctggggattatagggcagggaggccgcggggccgggcctctatttcttaaatacctgccctcagagccgtcctgctttataaactggagtgcaaatggcagcagtgaataatcaattcaggggttcgctgtgcttggggattatagtacaacgattatttataaagaaataacaaagggagaacaagattgacgctggatttggctgattctcaggtatctgtaccccagggtcaaccctgagatgggcccaatctgccagaacctaagatgccattttggaccccaggggcagtttccagaagccacaagcctgcatttggggaggagtgtgcgcagcctccagggctgggactccaaatctcgagctgaaggaactatgctggcaggtagctctctcagggtccaccgggggtcccagctgctccaagacacagcacattttagccataaacttggaagggctgggacctacaggaggctccttggtgtagaggccaggccaggcgtgtgaccttgaaccaggtggacttgaggtcccttgaactcccttctctctctggcttgtcccctgaagcactggccccccagtgctgggcttattgggccatcctgtgccagccccctggtcacccaccgtcacagtggaagtgtccctcctcttacaagggtgtcccttgctcggggggttctggggacaagaacatctttttccatccgggaacgaacctgtgcactcagtcagcgcttctactggccctcctgacggtcaaacctctgag

SEQ ID NO: 611799 - DNA, 174 bp, Homo sapiens
agagcagagactacgccacatgcttatgctgcagctgtgccgctggctatacggtcaatgtcaggcaatgtgttgcagaaggatacccgcagcgagtcaatggcacggtgaaaggaaggatctttgtggggagcacgccaggtccccattgtctttgagaacactgacctgcac

SEQ ID NO: 611800 - DNA, 236 bp, Homo sapiens
ttcccccccccattgggccccagggtttttttggcttttcaggttttattccccttttggggatgttttaaatattaatgtttggggtaataaagaattttttaaagtttttttttgggtataaaggtttctggtcccaaaatttccttttttttttgggggctgggaaatttctgttgggggggggctgggccttgtttttttgtttccccccccttttcccccttttggggcca

SEQ ID NO: 611801 - DNA, 165 bp, Homo sapiens
aggtgtcatgcgagctcgtatcttttcctctaggcagagcacagcaggcgatggggcgatggcatctctcggtgcctggggctgtcctgttgtccagcctctcccgttgctcagccgaggcctgctggagccccagatctccctttcctactacaccatttctgg

SEQ ID NO: 611802 - DNA, 1360 bp, Homo sapiens
ggcccggggtgtaccggaggtgaggtggagatggtgaaggggcagcctgttcgacgtggtgcccgagctacacgcagattgcagtacatcggcgagggcgcgtacggcatggatccgctcggcctatgaccacgatgcgacaagactcgcgtggacatcaagaagatcagccccttcgaacatcagactctactgaccagctgcacgcatccgggagatccagatcctgctgcgcattccgccatgagaatgtcatcggcaatccgagacattctgcgggcgtccaacctggaagccatgagagatgtctacattgtgacaggacctgatggagactgacctgtacaaggttgctgaacagccagcagctgagcaaatgaccatatctgctacttcctctaccagatcctgcgggggcctcaaggtacaatccactccgacaacgtgctcgaccgagatctacagcctccaaacttgtcaattcgaacacaacctgcgacctttacgatatggagatatcaggcccttgaccggattgccggatacctgagcatgaccacaccggatttcctgacggagtaatgtagactacgcgctgataccgagggcccagagaatcgttgctgaaacattccaaggtgctaataaccaagttccattcgaccatctgagcctagacgacatgccatacgagccatagagatgcgactcttaacagggcccatactatccctgacaaggacgtacctgggatacggttcaccgcacattctgggcatcctgggagatccccaatacccacgaaagaacacttcagatggcttcgctcacacaattgtaagtgcccagcaacaaccatacagagattagtgacatacacgacccagctgtctttgagccaaacattcccccaactacaaatctcacaaaccttacagctgtgccgacgatttaccataaccccaacatacgcatcacgtgagaaagctgctacccccaccgagcgactatatccgccagataacacaactgacgaacccgcacactcgacgcaggtgtgacaccacacagggagagcaccatcagaaaagagacatcacggagggaagcaccacaaaaaacaaggagggcgacaacaccacctcaacggacaatcccacagcaacggggagcacaaagcaaagccacgagcgacgccgctggtagaacgatagcgcatcagcagagagtgccgaaggcaaacactgccgtcgaccaccagcagaaccagcaagaccagatcgcaccagagcacagcagaacgacgaaacaacgcaaagaggcggcaaaacaagcaacaaagaacacaacaaaccggagg

SEQ ID NO: 611803 - DNA, 209 bp, Homo sapiens
atcccccggggtagagccccgcttcttcttggtttctcatgccgaggacttgcctttgggaacttcaaaacctgaggctcgctctccccagtctccggctgcacctcgctgcatcaaaggagtgccgcactcggaatccacctcaatttcctcctccctgacccttcgaatgggatgatgcccttttttctccttcaggggcatctacc

SEQ ID NO: 611804 - DNA, 423 bp, Homo sapiens
cttcgtcccgtcgcgcgacttgttgcctccggctaacgttgtcacattcactgtacaagccccgtcgcgattttcctgtgccctctctttaacaaacgattcaggagtggctagggttgggcttcgaagccggcctagggcagagtccggctccggacaggggttcagtatctgtgggcagcaagacttgctccagcttcactgtgcttgttccttctgggactctgtcaccacctccccatttccgggtctcactggtcttgttcagaaccgtcttccggctgtggctttcctggggaggctccacctccggcccagtcgtctttctctttgcggaggccaaagaatggacgggcactgagatccggctctcctcgccctcctgcagcttgcggtccgttgcgatctccatgtccagggcca

SEQ ID NO: 611805 - DNA, 1173 bp, Homo sapiens
  misc_feature (1001)..(1001): n is a, c, g, or t
ggccctttgtcgtctccctttgggccccaagaagggcccttgcgtgtgtgctatggccattgtgggggtgccctttggtcccctgttgcagatgccccggaggtctgttgtgacccccttcgtgcgctcgacacccgtttgtcgcgcggtgtgtctgtgtgcgttgtcgtcgcgcgctggtggccgctgtggaggggggcgcacccgggggtcccctgtcattttgcggtgtgggggtctcccccccctgtgtttggtaatttcccgcgggggtttgtgggcccctgttggacactgtcgtctctctgtaggcgctctctccgggggaacgcgcggggtgcccctcgggagccctctccctagggatagcccgcggggggcgtcgtcaccggggtgcccacctctgtgttgtttggggttgggagaccgcctcgggtggccctctcaccgccacgagtcccacggtgtgggaacccgcgcctgtggtggggctctgtgtggccccccccactttggggactccagagattgggtgtgccctttcctctctctcgccgcgcccgccgaggagggctccccttgttgcgcacacggttttgtgtggggcggagagtgcgcgctgcgcacccccccaccactgttccaaggagagagtgccccctcgaaatctgcgtctctccacaggagaccccccccccccgagcccccggagcttggcttgggcctctctttcccaaggcccaggactcccctccccgccacctcgaagatcgcccacaccccgccctcttagagggaaagagcccaccctctcctcgtgcacaccccgagcctccaccttggagaagccccttcccccccactctccctctggattccccacagaggtgtgtgtggcgagttccccccgcgaggtgtgcccccccctcttgtgtggggggggcgcaaggtgctgcccttctccccttgtgcaccaacctgctctctcccggagaaatgcncaaatgagacctccctggagaacctgtgggtgtggaaattggcgtgaaccccaaaatggaaggccggggccccggcccccggccccttccccgggccggaaggggaggggaaaaaaaatttccgactttgggaccccggactccccacgaattaaccaataaggtggctgtt

SEQ ID NO: 611806 - DNA, 938 bp, Homo sapiens
cagcataatcatgctgtagtttggcacacgaggaaataacataatactagtctgagtgctcagcgctccttgcttgatggtacagctctggtaataaaaactccgtctccggaatcctgtagattcaggacctatattgaatttgtgtgggagcacgaggtggtcgaggcccactactctgcgtggggatatagctatattgataggttcttcgattgcaccttcctgatgtagatttggttctatgggaccttgcaactaatggcgcgtcatatagggcagaaaagcactataacgatcctcttccgttgcttatgtgagacattttctaaatggggtggggtttagcattgccgtttacccttgctccacataggacgaagttccacggttccagaacactgctgaaacccgattcggaatgaacctaacttgtcctaagtagctattcagtagtcctccatatgcacattggatacggaggattcctcatagacgttttttacgaggcactacctagtgaaaagcttacctcatattgaataagcattttatatggtgttagtgccttgtgatgccaatggcctatgggtcccaggcaccaggtctggccccggatgattaaatgccaagcggagctatgatgggactgtgggtcagatcctattgcagtgagctctgagcagctagcgcattccagagccgttggtgctgggctactgcttcttctgcgcatctgaggacctttatccggccatcctccgctggccagcactacggggcgtggccgttggcttgtcttgattcccgccgccctcacaaaggcttccttcctcaatgtggaagcaacccctgtttttcacccgccgccaacgtgcgggcctttggcgccacgagggtgcttacgggtctctatacatcttcctggggcttccgcc

SEQ ID NO: 611807 - DNA, 1312 bp, Homo sapiens
ttttatttttttttttcgcaggtaaaaattatacttttattgagagtcaccaggaaaaagaggcactggtggttcaagtcaaatgttcaaaatcataacaggccaaaagggttggactcccgagcacaagcccacgagggaggggaccaaaacagaccaaaagtgagacaacaaccccatataaaaagagtgaacgtgggggcttcacacactcacacacattacacattacgacaggggagtgaaagtgttgtggacgagagaggcaaattttcagggtggctcagtttaggtggtattcattttataaattacgagggttgtggaaggggtggtaattgtgggtaattttgtcacagcttattaaaaaagaggcgccaaaaggtgcagtggtggtagaggggggaagaggcaaaaattataagcaaatcaagctcaattattcccggggagggacagtaaaagggagaaaaccgaggaggcaagggcatagaggagaacacgcatatattacctaccaccagcgggggctatactagggtaatatccttaagaaattgggtccacaaaagagttatatattcaatatttcaagagcttaggagtgccttctttccgggggaatataaaagtagacgctgagacaaagaccatactgtggcgacctgtgtactagaagaagagaccaggggcgcatcaagcgccaagcccaggccacagagccctacagggggaatacagaggagcaactatcaaaggggactgggatgggatatggggtacaaaaacacagaagagccccagaaaagagcccgggatcaaattacagaacccaagggtgtgacaagaccctaccataatcatcagaggggggtgagaaacgaaaacggggccccaaaatatataggcacagggaaacatacaacagcaaggagcatcatgacaagaaagaagaatccaaaatgacagtgatgaatgtgaccaataaaatcggcaggcacggggaaaactaaagggcgagcgtgagaaaacaaaggggagcgagaactaatggaagaggcaccacaccctaactcacatacacgaaatattccaaaagaacacagggcccacaaacgagagagagggtccccgtacaaagtggtgggcccaaaaacaaaaagcaaaggaaagaagaagaacacccaaagtgaggaagaagaagacaggagacaaaaatccaacaacaaccgggagaacacaatacggaaacatgctaaccaacacagcagtagcaaaacgacgacgaaaaatgagaaagacaagcagaagg

SEQ ID NO: 611808 - DNA, 357 bp, Homo sapiens
caggtgcccagacgggtcccgaacttctggagttcaagcaatcttccgtgctcggcctcccaaagggcgggaattagagtagtgagccacggcacgtggcctcaatcccccactcccccgcttcttttttggagacagagtctggctcggtcacccaggcgggagtgcaggggcacaatctcggctcacggcaacctcctcctccgggttcaagtgattacccggcctcagcctcccgagtagctgggactacaggcatgtgccaccatgcccagctaatttttggtattttcagtagagatggggtttcaccgtgttagccaggagggtctcgatctcctgaccccgtcctccaca

SEQ ID NO: 611809 - DNA, 414 bp, Homo sapiens
caattatattactaccagtgacatgactcttcaactaacgcataatgtgaatcaactcagccacgcacagcctaagtattagcatcgttcccctactattttataaccatatcagacaacgacctatttagctgttccccaaccttttcctccgacccactagcaaccatactcctagtgctaactaccggacttctacccctcacaatcatggcaagccaacgccacttatccagtgagccactatcacgaaataaactctacctctctatactaatctccctacggatgtccttagattatgacattcacagccacagaactaatcatatagtatatctgcttcgccacacttatcaccaccttggctatcatcacccgatgaggcaaccagccgtcgcctggacgcaggct

SEQ ID NO: 611810 - DNA, 582 bp, Homo sapiens
  misc_feature (197)..(197): n is a, c, g, or t
  misc_feature (422)..(422): n is a, c, g, or t
  misc_feature (426)..(427): n is a, c, g, or t
  misc_feature (432)..(432): n is a, c, g, or t
tgattagtgtagaaaaagttaattatcaaatcgctgatcaacatattttacatgatgttgattggcagattccagctggggctcatattacattgacgggaccatccggtggtgggaaaagtacgttattacggatcattgcggccatgatttctaaaacaagtgggaccttgatttttgatgggcagccgattganagttatgacccaatcatgtatcggcggcaagtctcatattgtttccaacaaccgacgttatttggtgagacggtagcagataacttagctttcccgtaccaaattcgtaagcaagtcatggatacgcaacgagtggtaacgccgttaaataatgttgggctgtccgaacgaaccctgcatcagccgattatcgagctttccggtggtgaacggcagcgggtcggntgtnncgcancatcttattcttaccaaagtgttgttattagatgaggtgacagcttgtttggatgaaaataataagcaaatcgtgcacgccttgttacgacagttaatgagcaggtcacgtgacaacgtcatgattactcatgacgcgacagagatttct

SEQ ID NO: 611811 - DNA, 110 bp, Homo sapiens
tagaagacacactaagggagaaatttagaaaagcacacctcttgtgaagttatctttatggtattggggggagtcctttatttgaacagtaactaagttaataggaccta

SEQ ID NO: 611812 - DNA, 1599 bp, Homo sapiens
  misc_feature (381)..(381): n is a, c, g, or t
  misc_feature (524)..(524): n is a, c, g, or t
  misc_feature (539)..(539): n is a, c, g, or t
  misc_feature (804)..(804): n is a, c, g, or t
  misc_feature (825)..(825): n is a, c, g, or t
  misc_feature (835)..(835): n is a, c, g, or t
  misc_feature (887)..(887): n is a, c, g, or t
  misc_feature (923)..(923): n is a, c, g, or t
  misc_feature (1009)..(1009): n is a, c, g, or t
  misc_feature (1111)..(1111): n is a, c, g, or t
  misc_feature (1135)..(1135): n is a, c, g, or t
  misc_feature (1277)..(1277): n is a, c, g, or t
  misc_feature (1363)..(1363): n is a, c, g, or t
tcagagaatgcttggtccgccggaagaaaatcatctagtgttgttggaaagaacgagttggaaacacaaaacaacagatggtctctcaaaataatataggacggccctcctctcctcttgtggcgacgcgaccaccataaaccacaacgtgtgtatttttggagggaggccccaccacttctgggggggggaaaaattttgttggggcgcgtttatactatattttgcctcttgggggaagaaccccccctccttcgagttttcctcaagggaaaaaattgcgcccctttgttccaacacggcgggaaaacagacattttttttcccaacaggggggaggagtgttctctactcaacaggggggtttctctatttgggagnccccgcctctttgtgcgcaaaacgcttgtcctcacacagtgggggcccgccctaccaacatggcgtttatctccccacaaaaaaaataataggaggcgttgggggggccattctcctccctttcacaagacagagaagagaanttgggggggacaacnacaccgcgcacttgggggcattataaattcacggcggggggggtgtgtaaaaaaccgccgcaccgttctccacaatttacaaacggcgtttctcaaaatccctctggcttaccacagactgttggtaggagaccttatgtggagcaccccccaccggggttgtaagagagctcaacgcggggctcttgtagaagaaagaacctcgggccccccccatctgcgtggggctccttaggagaagcatgctttttttggcaattaattnagggtgcccccaactacggcncccccttttnggccgacacaccatcctgtagcgaacacaacagtgtttttccttcttctatntggacaacatcgtttaatacttgatcaggtgaaatnttttataaacgagggttattaccccctcttcgagaagacatcttgcgcgagagcgaaaaattatagagagagagagcgccttctgngtgacaccacaaaataaaagagttgggagagacaccctctccttcgggggaattacacagtggagaaatggccctcgagatttatcagagacacacatcggngggccataattagacacatatagnccctcataagagagtataataataggcgtctataagagaatctgttcggagagtatacactatataaacactgtaaattgactgagcccgggcgcacgggtggcgctacacacgccctgtgaaaatcccaccgcacactctntggggagaggcctacacaggcgcgggacacagagaccacatagagagagtctacaggagagagattgagagagcacacatccctgngccacaacacattggtggaaaaccctctgttttctaactatacaaaatatcacacaaaatgagagcttggttgtggtgggcacacgtgcctcgtagttcccacagctaacttcgaagagggctaaaggcacggaaaaatcgcttgaaacccacggaggcagagattgcagtgagccacagattgcaccagctgcaactccagactgggcgaacagagcgagactccattctcggga

SEQ ID NO: 611813 - DNA, 237 bp, Homo sapiens
cagatgagtatgacgatgctgagttaattgggaaaactatggaaggagccgatcagtgtaaggtactacggctggacagcaagcttgggtgctttccagggccagcagcggatggctcagaggggctgcattagagcatgcgaggaggagagagtggaaacgccggtcagcgaggagcctggggccagatggaggaccctcgctccaaagctcagtcatttcctccttaacggagaa

SEQ ID NO: 611814 - DNA, 725 bp, Homo sapiens
gcctgtcgcctgccacggaggaggcttctaattagctggaaaagagtattcctaatacgtggcaaggattagccaaatcttcttatggaacgaaacgaagacaagtgaagagtggttacctatacctagcatagtacaatcagaacctcgtgaagaccaccgggaacaggcttgcggacgccggctgtccttcccgccacgatctttctgtggtagcggccagcaagaagacatgggctggttccccaatccctttttccccactccttctttatgtgcacacaaggaacacccaagtcttccacaggacagggggaacttttcacccagctctgcccaatcattaatggcgaaacaggtgctagcgtgtggcttcacctttccatggggggctgttttccaagcttcggtccacaaaggctcaattcggaattttctttacagttaggataaccgggtggtaaataccccaggtggtggctttactgacgctcacagtcaagtaagaacggttctttgacattcccactgtgggcgaggtcacacctagagttcaacgggcctttcccttcggcaaccaagggagccagagaggctggtccatccgtggcatgtgccgtgggaactgacacacagagacacctcaattccaatgcctgggagaaccatctaagaaaaaccctatcacggcagccctccaggtgctgtcgaagaagaccaacttt

SEQ ID NO: 611815 - DNA, 238 bp, Homo sapiens
tattgtcgtgcaggcgcatcggtgaggaggcgttgtcacattcagctgagcaacagctagggcgaatcagggaaaaaaacagtgaaaatgaaagaaagggggaaatcaggatatattgcgagacctgattgccattgataaaaactggaaaatcacaaggcggagttggcttgaaggggaaaaaaatagaacttgtcttcagacttattgattgtgtgacatcagtggaagaacccag

SEQ ID NO: 611816 - DNA, 546 bp, Homo sapiens
  misc_feature (3)..(3): n is a, c, g, or t
  misc_feature (72)..(72): n is a, c, g, or t
  misc_feature (100)..(101): n is a, c, g, or t
  misc_feature (108)..(108): n is a, c, g, or t
  misc_feature (122)..(122): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (188)..(188): n is a, c, g, or t
  misc_feature (191)..(191): n is a, c, g, or t
  misc_feature (210)..(210): n is a, c, g, or t
  misc_feature (226)..(227): n is a, c, g, or t
  misc_feature (277)..(277): n is a, c, g, or t
  misc_feature (288)..(288): n is a, c, g, or t
  misc_feature (302)..(302): n is a, c, g, or t
gcntagatgtcattttcccacattatccaactgtgcatctcaaacatatcctcatctcagtaaagacaaaantatctatttcattttgttaagtgcaggnngttgagngggataaaaatccngtgaaaacacatcaatctcaattcaactcagttaaaggggggggaagcgaatttngnttngttttnttnagggaggggagggaaaggngtccatggggttaggnntcaaaactggccagggctggcaactttagatggcatgttgtagctctggnaagtttctgtnacatgatattttanaataaagtggcttttgtggattttttcttttttggtattgtaaacatgtactgtttaatattacccgaatttaatttaaaacatgtttgcaaacaaaacaaaattaaaagcctttaaggcaaacctccccctaaggaaaaaagtcatttgttataaaattgtgaggacacccaagcaagaccccacttaagattcgtcagcatgaacttgagagcttttgtccactgctcctcagagttaaact

SEQ ID NO: 611817 - DNA, 1458 bp, Homo sapiens
  misc_feature (156)..(156): n is a, c, g, or t
gggccggagcggagatggcgccgcagaggacagggtggctgtggcggcctcgtgtccttggagttccgtctgcagatgctcgttggcgtggtgcacgccgcgagatgaagagcgcgcttggtgcgccgggccaggattgccttgacggtcatggcntgctggaggtgtgcagcgtgtaggtgctggaactctgcgacggcctggtgcgcttgccgcgtgcggagcagcttgggtcgcgtgggacgctgtggccagtgtggacattctggacgatggctcaccttggagcgtcagagtgcccgtgactacccatccagagggtcgtcacactctcaaggcgaacggaagacgtaacgagacttacacaaacgcaagggaaggggaccttgagagaatcgatctaggcatgacacatttctgctcaatagcactaccaagtgaaaggcgtcaagacagagttaggggcaaggtacccttaggttaccagaagggtgcccatcccggtgggcaacagggaaccagggaaaattggggcaagacacagaaggcaaatcttccaagccaacccaagggtccttgtgggcggccccagtgaacacgcattgccccattggttcttacacctttgccgcgcaagttccgccacccggaggacaggcccatcacaaacaatcttcaaatgcgagtccgcccttacaagccagtggaggggaccacgaactcttgttcccattaagggaagaccccttgtgagacaaccttttgaaccagcgcaagaacgacggacagaagagccttgtgccacggggcaggaccctcatggggcgcccagggcaggcatagtttggccaagcggtggcgaatgcaaccagaaggacacagggggcgggggcagaggcgaccccaaaaagagttggagtgaacgactctggctgcactttggggcccccatgcagactatcaggtgaggtgtgcggcccatagatagataggtagcccaaggcttatcaagcgggaacggggccattgagattttaccacagactatggggccccccaattcaagagggcttgcaacgtggtcaccaagctttgacaagaaaaggccctggccattcttagcgcgagcaaatttacgggcacgacgcttcccttctgtctcacaacacgttttgcacccctggacatggggtttcccacccccccaactgggcccctgctttgggacgctcgttcttccacgcgagcacagggcttgtttcctcgcaagagcgctcggggttttgacaccgcccaagtgccgggctggcacaaggcgctcgcggcgctacaactccggggacccgggtgtgcccgtgcgtttgtgtgccacgctgacaagtcgaccgctgcgcttgtctccctttcttaacgcgcggggtctcggggcgcgcattggggcatacccctgtgtctcgc

SEQ ID NO: 611818 - DNA, 217 bp, Homo sapiens
tgcgcgccttgagccgtcgccacgttagaggtggtacagcggcggacgttgtacagcagttggggtcaagttcattgtcgccctgcacacttgctcagttttgaggctgtcgaacagcccaatgactgggtggtgatcacctgagccgtggaacaccgccttgatacaaacggcagggcgcatcggtacgtgttcgaaaataacagcgtgcgacaac

SEQ ID NO: 611819 - DNA, 1577 bp, Homo sapiens
actactttaaatttcacatgagtcaaagaagaacccatgtagccaagacaatcctaagcaaaaagaacaaagctggagacattacaatacctgacttcaaactatgctacttccaagcctacagcaaccaaaacagcatggtactgataccaaaacagacatatagaccaatggaacagaacagagacttcagaaataacaccacacatctacaaccatctgatctttgacaaaactgacaaaaaaaggaatggggaaagaatcttctctgcagtaaatggtgctggctagccatatgcagaaaagtgaaactggaccccttccttacaccttatacaaaaattaaatcaagatggaaacaagacttaaatgtaaaacccaaaaccataaaaactctagaagaaaacctagacagtaccattcaggatataggcatgggcaaaggcttcatgacgaagatgccaaaagcaattgcaacaaaagccaaaattgacaaatggtatctaattaaactaaagagcttctgcacagcaaaagaaactatcattagaatgaacaggcaacctacagaatgggagaaaatgtttgtaatctacccatctgacaaaagtataatatccagaatttacaaggaagttaaacatatttacaagaaaaaaacaaccctgtcaaaaaatgggcaaaggatatgaacagacacttctcaaaagacattcatgcagccaacaaacatatgaaaaacagcccaacatcactgatcatcagagaaatgcaaatcaaaaccacaatgagataccatctaatgccagtcagaatggcaattattaaaaagtcaggaaacaatagttgctgatgagatatggagaaataggaatgcttttacactgctggtgggaatgtaagttagtttaaccattgtggaagacaggatggcaattcctcaaggatctacaaccagaaataccatttgacccagcaatctcattactgggtatatacccaaaggaatataaatcattctataaagatacatgcacatgtatgtttattgcagcactatttgtaatagcaaggctgtggaaccaacccaaatgcccatcaatgatacactggataaagaaaatgtggtaatgggtgcagcaaaccaccatggcacatatatacctatgtaacaaacctgcacattctgcacttgtatcccagaacttaaagtataataaaaaaggaaaagaaaatgtggtacatatacaccatggaatactatgcagccataaaaaggaatgagatcatgtcttttgcagggacatggatgaagctggaagccatcaccctcagcacacttacataggaagagaaaaccaaaccccacatgttctcactcataagtgggagttgaacattgagaatgcatgaacacagagagaggactaactcacaccagggcctgttggagggttgggggtgaggggagggaacttagaggaccactcaataggtacagcaaaccaccaaggcacatgtatacctgtgtgacaaacctgcacattctgtgtatgtaccccccttttgtttagaag

SEQ ID NO: 611820 - DNA, 211 bp, Homo sapiens
aaggacatataatacacacagtgcacacacatgtacacactcaaacgcacatgcacacacaaactgccagcacacacacacacactatgcacaaaaacgagcacaaatgcacacaaacgcacatgcacactgcacacacatgcacacacagcacacacacgagcacacagcacacacacaaagacacagtacacatggaattgcacacaca

SEQ ID NO: 611821 - DNA, 215 bp, Homo sapiens
gctggctagaagacagcaggggaactcgagaagttggttgttttcagcagattaaaacaatacagatttatcagcaagactgttgaacgcatacgcccaagatgcctgtccctccccctccagtccccagcgcacgagtgcgtgggcaataggaattactgatcaatagaggggaagaccttgttgcggcgctgaaagcaaggatgcatcggata

SEQ ID NO: 611822 - DNA, 787 bp, Homo sapiens
ggcgcgtactaggtcccccaggtctctccgggcctccggttccgtatagccgcgcatgctagcccgaagctgatgctgcccggtcggctccggccttcccggctgcctgacccgccgggccccgaagccccgggctccggcctgggcccagcggcgtggagcgcggcttggcccgtctgcccgccgctcgccgccacgacttcgcccgtctgtgccccaccggccgcagctttgaataggtagtcgtactcgtcgtcccgggtccccattgtcctggctgcttccggtcgggatcggcgactccgtgagacaccaccgacaaacacctcgacggtggtgctggagcctggcgccagcgacagagcaggcggttgaactggcctatcatgcggcgagtggagtagcgacgggcaccacagcgaagcctaatcagagatggaagtagttgctcatgagggtgggtcgcctgtttggtagccatcccatcctcgtcccatcggtgctcctggcagaagaggcggaccggcaatgcggaccttattgaagtgactggacgcgccgagcctatcaggggcgagctcacagaggtgctggggcggaacgcactgcaggaatgagaatggactttgacagatccgaaatagctaatgagagggcttgatttgagaacctacccgactatcagaggacctgtccgggaacgagaaatggggcctacggtccagacagaatctcgctctgttgcctgggctggaagtgcagtggcactgtatccggaatggggggg

SEQ ID NO: 611823 - DNA, 352 bp, Homo sapiens
gggaaatgggagctcacagcactgggaaatgggagcatagcattgggaaatgggagcacagtactgggaattgggagcacagtactgggaaatgggagctcacagtactgggaaatgggagctcacagtactgggaaatgggagcacagtattcggaaatgggagcacagtactgggaaatgggagctcacagcactgggaaatggagcatagcattgggaaatgggagcacagtactgggaaatggaagctcacagtcctgggaaatgggagcatagtgctgggaaatgggagcacagtactgagaaatgggagcacagtactgggaaatgggagcccagttacttgagaa

SEQ ID NO: 611824 - DNA, 356 bp, Homo sapiens
cgccaaattaatgatcaaaaaatggtattttgtcggttcaacttacatgtccttaatgattaaaagctatgtatctgtttattatttacccattttaaaattagtcttatattgttaatttgatcttgatattgtaaaaatattgtctctttagagtggtttgaatatgatcttgataaaacaatgaattgaactagatgactttgaattttatgatatcatggtttccttatgattaaatgattatgtgacaacttcttctccagggtaaatttcaacgttatatttctgctttattgatctttaacagttaagggaaaaaagtcggaggctggctttggcccgcggaaaagggg

SEQ ID NO: 611825 - DNA, 924 bp, Homo sapiens
tgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctccactaaaattacaaaaattagctgggcgtggtggtgggcacccgtagtcccagctacccgggaggctgatgcaggagaactgcctgaacccggaagtcggaggttgcagtgagccaagattgtgccactgcactccagcctgcgtgatagagcaagactgcgtctcaaaaaataaatcaataaacatttaagtaaaagtaaaataaaactgctggggaatctacaattactacctcaccatctctcagcgaatccctgagaaagggagccccctgtaactgatggaggtgtgtcttccccctgggagaatagggccacaaattaatccatgggtgcattgattttttccttctattgtcccactttcaatcctttgttctaactggattattaccttttgggcagggttcattcggttaccagccggatgtctgtcctgtttgggtcaaccgggcattgatcccccggaccgggtgctccactctgccccgaggtggacaggtgccacccgcctttctgtgtttgaagagcgcccgtcgtgggtccagcgtgtgaacctcccggggcggtgccgggcgtggtgttgacgggggccccctgtgggttgtggcctcctagttgtggtgtgcttcgctcgctcccgc

SEQ ID NO: 611826 - DNA, 106 bp, Homo sapiens
cttcttcctattgctacgccctagttgctcccttcccctactgatcgcactaatttatcttctctcttccactgtgctatactctgtttgtggcggtagctctggt

SEQ ID NO: 611827 - DNA, 1717 bp, Homo sapiens
aggacccagtagccaccagaaaaagagttgtactgccttacgactacgagccgagtcgagacttcgaaggcctttgggctggaagacgatgcaagatccgatcagtttcttctcagctttgatcccatgataaacagtagccccgtctggcgaaggataatgctagttgccaggcacaataacatagattgatcacatgtcggctgggaaaacactaagcatgctcctttcctatactggtaaagctcacgacacgaggtcgttccaggctacacacttggtcccacagaagcatacgttcctaggagatgacagcgtgagctgcgctgtggaacccggtacagcaaccaagatggctggctgcgtgcctcttccgttagcataccatagtttgtctgaaaagccgactctaacaattcgtatccatggaagcaacaagaaacaagacatagagagacaatagacacaaagaaacaaagcggcggggcgcagaacacgcaaacaatcactactcgcccctcgaaagggggacacacaacaagacagaacaaaaggcacgtagataacccctaattacaatgtatgacagtgaaaaacacagatagggagcacactctatgatttatgtgtgcaaatctgcacccatatataatataacccaatagaggagatccctatggccaccatgaggttacactttcacaacaaacaaacataaatcaggaacgcacccagcgggcacagacaagcaggacgtgaacacacccattggaggagaaatgcagcacaccatggaggcacgaccaaggcagaacacctagtgtaaaccccaattacctggggagagccgagcactgccccaacacacaactagcgagcgaaaaccaaaactgtgcaacaccccacaatacagcaagaacaaaccattccatcaaaaggccccgtcacaacacgggggacacaaacaataccacaccacgacaaaatcccaccccagaaaaagtgtagaaccaaaacacacgcgggcgaacgacccaaaccgaccacaccgacatcggcaccgacaataatgcacccatgagcaccagacgacccccaacagaaagcaccctataatgtgacgaacccgcgcaccccaagcgaaactagacaactaaacgcacaacagccacgacaacagcaaaccacacctcaacaatacacacaccgagaacagacaagacaccatcgcacgaacaaacacaccacaccacaccacccaaacacaacacacacaacacaaatagattacaaacactaaaatagaaaaacatcacaaatatcaataaaacaacaactcaagtctagacaataatacaacataatctacacaactgacatacacacctactatactacctaacccaaaacgagagggagagagcgacacagagcgagacgcgagaggacgaacagggcgagaaagcgagaagaccgcaacaagcagaacaggagcgcggacaagcgcagcgttgcagctacagcaacagcaacgaagatcacgacagagagacagcgcacagacagagccagcgcgcggcacaaacaatgagcagcgtggacgagagcagagcgacatagaaacaatagtgcagagagagatgatcacagacaggcgctcaacgcatcgaccgtcgcaacgacaaagcgacagagaggcgcggaagggaggagaaac

SEQ ID NO: 611828 - DNA, 230 bp, Homo sapiens
cgagggttggaacgaaaaatgggaattaaataactatttaggacattaaattagctgggcaggcagacggaagaagaggatgaagggggccgagtcaaaggtgactaaggttctaggcccaatgatgagtggatggtgaatagagagaccatctccatttgactggatagtgacagttaaaagataagagagtcccacatcctcagaagcccttacagtcctgggaaaat

SEQ ID NO: 611829 - DNA, 266 bp, Homo sapiens
  misc_feature (102)..(102): n is a, c, g, or t
ctcgcgaacgtattatcacgacaaagaactcacgtttgccaacactaagtcaagtccccccgcacagcggccacttaaagggaagaggacgacggggccagncctctcgtctgtgacctctgcctgagtgtgtgtgctggactcactgacacacatgagtcatatagcgagaaaggcactcacgaaaagcagaggtttcggcaataacagacgccatcacacactctctttccacacagtatatctcggtgggcagcaattgtcca

SEQ ID NO: 611830 - DNA, 120 bp, Homo sapiens
ctcaacacttttcctactaaatgtgaccacttgctaacaaattcccttcttctcaacaggcatgtgacactgccagcagcctgagtccttccaaacagtgctcacagtccaaacagtgcc

SEQ ID NO: 611831 - DNA, 153 bp, Homo sapiens
ggttttggatttttttttcttggggtttgttttttaaggggatgggcacaccccttgttgtttaaaaggggctttttaggcgggcccctggcttttgaattcttccttgccaataaatgtaagaatttggaataaaaaaaagagccctgctta

SEQ ID NO: 611832 - DNA, 623 bp, Homo sapiens
agactaattcgtgtcaaacttactcgcacgggacgggctccagctgcagcaccctgggtctgtcagtcggggacgggttctactgaaagacctggtacgtcctggctaggcgaccgtccttactggacaggtcggtctgtatgtgctcatacgtggctaggtcatctagttctcccaggtcgtacactcacggcttccctcgacgcatcttagaagcgactctcttcacatcttccggcttcacgtttcgtatgagcgtgcacagctcgtgcggcagctatctggagcgagtggccagcatctgcctcagcacatcctcgaagatcacaggcctggattccaggttcatcatgagcattgatgtcagctgcgtcttggctcgttccagctcctccgtgtccgcggttccgcccattaaaatacactcctatgtgatgatttctaccatttctcgagcctgtcttgggtcggcgctggcatgtatgcaaagtaggtcagtgtcctcgtagctgtggtggtagaaggtcgcgttatacatccagtggtgcctgttgagcacgttgaggtagagcctggagaacatgcccttgtcggggccaccaggcgagaaggatccacctccg

SEQ ID NO: 611833 - DNA, 151 bp, Homo sapiens
tctagaggatcaccggtcggcgtatcggggggtttcagggggtttttggttgtgtttggttaactaaacctaaaggttgacttactcgttttctttcctcgtgtacctctccaaaggaactgagagagagagtattaagagggaaatacag

SEQ ID NO: 611834 - DNA, 680 bp, Homo sapiens
agaggcggacgcccagcgctgcagagagaaagtgacgagccgcccttcgttgtcagccaggaacgcggacacagcggcgctcccaccctgctgctgtcgatccctaggccgccgcgatggcagctgccggcgcccgaggcctgcgggcacctaccaccgactcatggataaagtggagttgttgctgccaaagaaattgaggccgctttacaaccacccggcaggccccagaacagtttttttctgggctccaataatgaaatggggattggtgtgtgctggactagcggacatggccagacctgcagagaaactcagcacagctcagtccactgtgttgatggctacagggtttatttggtcaagatattcacttgtaattataccaaaaaattggagtttgttcgctgttaatttctttgtggggtcagcaggagcctctcagctgtttcggatttggagatataaccaagaactcaaatctaaagggatccagtaagagagttcctgatcacctgaacattctagatgtggacagaaacattggaacctagtgtatttgcttaccgataaggtgatgctaaattctgataacattcgaaaagaaggaaagcaaaatctaactgtacttaaaagctagcacttgacttcacaaaaaataaagcaaacttttagtacca

SEQ ID NO: 611835 - DNA, 583 bp, Homo sapiens
  misc_feature (6)..(6): n is a, c, g, or t
caagcnggatgcaaccaggtagatgccatccttatctcaacccaaatgaaactttctggatttctgcaaatcaaaagatattgtattggttgcctatggtgttctaggaacacaacgatatggaggatgggtagaccagaattcccctgttctcttggatgaaccagttcttggttccatggcaaaaaaatataatcgaactccagccttgattgcccttcgctaccagttacagcgtgggattgtggtcctcaacaccagtctcaaagaggagcggatcaaagagaacatgcaggtttttgaattccagctgagttcagaggatatgaaagttcttgatggcctgaacagaaatatgcgatacatacctgctgccattttcaagggccaccctaattggccatttttggatgaatactagtatgtgaggatgtctcctgaaaagcctatgggtgggacactgctcagctgctgccatctacagacttgccacttctctgtagcaattgagaacttcttgaagataacaaaaagatatcataccactctgaaaacaaataaaagactcattcttcagcactta

SEQ ID NO: 611836 - DNA, 1020 bp, Homo sapiens
  misc_feature (316)..(316): n is a, c, g, or t
agcggaaccgtcccgcaactgtcctgtgccacgacctttggcaccgtcggggtccgtcgtccccgcaatgtgacagtaatccctcaccccggctgctgaccaggatccggcggaccccggcctcgatatgggagaccctggaacatgcctggctgcccgggaaagctgaacgtgctggtgcggggatctgcagcagcttccgcgacttacgcgagatgggctcctgaaggtgtccctaagactggtggaggagctgactcgcagtggagatgtggaagcaggaaggtgtcccctggtggttcttgcagggtggagngacttcaaggccgccacgaacatccttcccaccatggtaacaatgggtgagtgcctaccacgaggctcgttcgcattcatgcaagcctcctgtggagacgagtgattcgttccaccaaggcaggtcgtgctgagctcacggcagaaagacgctgtcctgtggcacattgcgtcagtactattgccacacggcaaagactgtagcgctgctggtgagccccagacgtggcctggcggtgggcacccctgagggggcagcggatccccaagcagaagcaagccctggccaggacgcgtagccagaatgctagagccaagaggctagaatggcgacagttcgtgcagacttcgcgccgtgaaagagacactacatttatgtacataccgtcttagcattcgatcaatcaccgtgtgtggtgaccgatggccctatctcttccgtcggaggctccttctttgtgacggctcgcggtggtcgccatataagggaaagaccagacgaggatcttgccgccttgaaccttccccggggttgtttgggaaccttggcatggggacgctctataacgcttccccttgcgtagggcgccgagcgcttgcggaacatgcgaggtcgcgccacggcttgccatcgccttgttgcgctacttcgcggcaagtcccgcttggtgggtcacttcaccttggtgtgggaccccccccttg

SEQ ID NO: 611837 - DNA, 241 bp, Homo sapiens
gacggcactggtgtatacagtggttgaaccggggcaggtgacaaggcacctgtgtggctgtaggccggggggtcatcagtggttgaaccggggcaggtgacaaggcacctgtgtggctgtgggccggggggggagaatcaggggttgaaccgggggcaggtgacaaggtacctgtgtggctgtgggccgggggggtcaaagcccggctctgactccctgccagcttgctcagccacctccc

SEQ ID NO: 611838 - DNA, 352 bp, Homo sapiens
caacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatgggaaattttaaataaatggggatcaggatcttgaaggccttttcattggaaaaattgtaacagggagatggaaacatgggctttaccaggcggcaatcctggaaggacaaaacaaggcgtgggttacccaggataggtagtttcagtttaaaggcacagggggactgggtttgaggaggcaagggttctggggcc

SEQ ID NO: 611839 - DNA, 412 bp, Homo sapiens
  misc_feature (27)..(27): n is a, c, g, or t
  misc_feature (37)..(37): n is a, c, g, or t
  misc_feature (127)..(127): n is a, c, g, or t
  misc_feature (157)..(157): n is a, c, g, or t
  misc_feature (198)..(198): n is a, c, g, or t
  misc_feature (248)..(248): n is a, c, g, or t
  misc_feature (277)..(277): n is a, c, g, or t
  misc_feature (281)..(281): n is a, c, g, or t
  misc_feature (352)..(352): n is a, c, g, or t
  misc_feature (362)..(362): n is a, c, g, or t
ccatctttgtgttcaatgatccgggangctgcggctnaaagatctttggcagacgcagcagctgaagggggtcccggtgcgtggggcccggaaccaagtgcgcatgtacctgaccatggcggtggcnggcgcgcagcctatgctcatgtactggctnaccttccacctggtgcggtgagcgcgcccgctgaacctccngctgctgctgctgctgctggggccactgtggccgccgaactcatctcctnctgcaggccccaaggtccaccctgtctgncacnagcaccgcctccatcccatgtcccgcccagccccgcccccaacccaaggtgctgagagatctccagctgcnacaggctacncccaggggtggccgctgttacagaaacaataaaccctgatgggcatggaa

SEQ ID NO: 611840 - DNA, 821 bp, Homo sapiens
agtgattggatagacgcctgcgaggcggcaatcagtagcgacacagaggacccgccccctgagcagcccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtagtgggtgtgctgtgtgtgtgtgtgtgatgatgatgatgtgtgtgtgtgtgtggcgtgcagctgtgtcacgtggggtgcgcgcgatgatgtgtgtgcatcacagggctacgcgggggtgtcgggctcctgggccatgaggggcctgaagtgatctcacgttgtctccgaaagccttggtgtgttccctgcagcgctgctggcccccaccagctctttggtggtctctggtctccccgcgcgggggaagtggggggagctgttgctcggcagagtagtcgcgtggagcaagggaagcccatactagagggctggaagcaggatctctagcagatgcttctcaagcagggcagcgtgcactcatctcaaagctggagcttccgcgctctctttctaccatccttcgtagtgcgcagtggggcggaagaatacaagagcgcggcggtatcccacaaggttccctgggggtgggcaccagaagaggggaagcccggccccactcccctagtggtaaaccaaggagagcccggtaacaatgtaccacgggcttgtgtagaagcagaagcagggcgttgggattgggggacacgttgataatcaaaaggcctttaaataaaagggagccgggc

SEQ ID NO: 611841 - DNA, 731 bp, Homo sapiens
  misc_feature (641)..(641): n is a, c, g, or t
tcctggcgctcaagcagcagcagcagctgcagaagcagctcctgttcgctgagttccagaaacagcatgaccacctgacaagggcagcatgaggtccagctgcagaagcacctcaagcagcagcaggagatgctggcagccaagcagcagcaggagatgcgtggcagccaagcggcgagcaggagcgtggagcagcagcggcagcgggagcagcagcggcaggaagagctggagaagcaggcggctggagcagcagctgctcatcctgcggaacaaggagaagagcaaagagagtgccattgccagcactgaggtaaagctgaggctccaggaattcctcgttgtcgaagtcaaaggagcccacaccaggcggctcaacattccctcaccaagaccccaaatgctgcggagcccaccatgcttctttgtggaccaggagttccccctccacagaggcggccccccttgggacgcctcgctcctagaaaggtgccttggccgtgggccctacgacagtcgagaggatattcccccttccgaaaaaacagccttcgtgaaccccaatctttgaaatgttgcgttcaaggctaaaacaagaagggtggctgaggcggagaagccagtccccttctgcggtggcnagggattgcgactgttattagcaccctttaagaagagagctgttgagatcacagggtgccggacatggggcgtcgcccgtgtgtaacagg

SEQ ID NO: 611842 - DNA, 1090 bp, Homo sapiens
ttgctctcgtgttcttgttcagtcatgcttttgtcctcttctcttgtcctcttgttggccctttgtttgtgctctgttttggggttcttggttctttattttcctcggtcataatatgtgtcttgtgtctttctctcgtgccttttctctttcttttccttctttcactgtcttcattggtgtgttcgtttttgtgtttcctttgttgtgttttggtcatctcttatcttctatttttcgcttttgttctattgttttgtacttactggccgggatgttcttcgtcttgtggtttcccctgtccaggattatcgcagtctttcgattgggatcttgccaagtctcgtgtcttatttgcttcctgtccgtgctctcattcttttgtgggtatcatcatctcgggttcttggtgctcctattgtgctagcggtttcatagctagttgtttcgtttgggtagttgtctttggcgcgttatggcgttttttgaggtctttgtatgtcctttgctgttgtgttttttttttgtattttttccctttcttgttacttcattggtcttccatgtctgttccgtattggtgtatgccagttttggcggttcggctccggtcaagtctgtgatggccttgtggtttagtgtgctcctctgctcatgtgttgatgtgcattgggcccatggtgttggccttggggcacctcagcgtgatattgtgcttagtatatttgttctccatgccgtcatcctgggcttttccgtcctgtgtcttcgtttacaggtctctctagcaagtcctacaggacgtcgtcgtcgtccgttccgtgtccacctgtcagcttcttctgcgttgctgagataagaaccatttgtgttacacctacacttaacttcagaaagacatgcaattatgtaggtgtaatcaaacccgatgctttcaagatgacctacggacatcttcaatgtggataagataaagaactaaacacatgcatctaatctgctgggcaatccagttgacgtttaaatgtaagaatggattccttacacttgacacattcagctatatgacagtaactcatgcgcggatatg

SEQ ID NO: 611843 - DNA, 1025 bp, Homo sapiens
  misc_feature (26)..(26): n is a, c, g, or t
  misc_feature (33)..(33): n is a, c, g, or t
  misc_feature (35)..(35): n is a, c, g, or t
  misc_feature (41)..(41): n is a, c, g, or t
  misc_feature (44)..(44): n is a, c, g, or t
  misc_feature (56)..(56): n is a, c, g, or t
  misc_feature (62)..(62): n is a, c, g, or t
  misc_feature (68)..(68): n is a, c, g, or t
  misc_feature (79)..(79): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (92)..(92): n is a, c, g, or t
  misc_feature (118)..(118): n is a, c, g, or t
  misc_feature (126)..(126): n is a, c, g, or t
  misc_feature (132)..(132): n is a, c, g, or t
  misc_feature (143)..(144): n is a, c, g, or t
  misc_feature (150)..(150): n is a, c, g, or t
  misc_feature (156)..(156): n is a, c, g, or t
  misc_feature (375)..(375): n is a, c, g, or t
  misc_feature (468)..(468): n is a, c, g, or t
  misc_feature (482)..(482): n is a, c, g, or t
  misc_feature (995)..(995): n is a, c, g, or t
  misc_feature (999)..(999): n is a, c, g, or t
  misc_feature (1004)..(1005): n is a, c, g, or t
  misc_feature (1007)..(1007): n is a, c, g, or t
  misc_feature (1013)..(1014): n is a, c, g, or t
  misc_feature (1016)..(1016): n is a, c, g, or t
  misc_feature (1021)..(1021): n is a, c, g, or t
tagaggtggagatccatgccggcgtntcaaccnanagccgnttntaaagcgcgtcnatgcgnacgccnacccgcggcantatgntnanacgntcaaggctctccgcgtgcggcggctnacagtggnagccgnacaggttcctnntcagcnactggnaggcgccctgcgtgtgctagcgaactcccgcctcaaggaactgacgctcgaggacctaaagataaccggcaccatgcctccgctgcctctggaagccacagaacttgcactttcccagttgcgcctacgcaacgtgtcgtgggcgacagggcgttcttggctcgccgagctgcagcagtggctcaagccaggcctcaaggtactgagcattgcccaagnacactcgcctgccttttcctgcgaacaggttcgcgccttcccggcccttaccagcctagacctgtctgacaatcctggactgggcgaacgcgnactgatggcggctntctgtccccacaagttcccggccatccagaatctagcgtgcgcaacacaggaatggagacgcccacaggcgtgtgcgccgcactggcggcggcaggtgtgcagccccacagcctagacctcagccacaactcgtgcgcgccaccgtaaaccctagcgctccgagatgcatgtggtccagcgccctgaactccctcaatctgtcgttcgctgggctggaacaggtgcctaaagaactgccagccaagctcagagtgctcgatctcagctgcaacagactgaacagggcgccgcaacctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgcagctccaaggggcccggggctttgcctaagatccaagacagaataatgaatgactcaaactncttngcttnngngagtcnncncagancttt

SEQ ID NO: 611844 - DNA, 532 bp, Homo sapiens
aagccatctcggtccttgctggaaggtggagacatcgcttgtgttctggtgtcaatcagggggctggatggggcaagaatgggggacaagggtggctttgtaaatagcagcaaatccctgcaactaatttattactttttctttttttttttttttttggagacagagtctcactctggttggcccggggctgggagtgcagcgggcgtgatctccggctcactggcgaacctccgcctcccaagttcaggcgattggtcctggcctcaagttcccaagtgggctggggattacagggcgcccaccattatgcccagctaattttgggtattttagtacagagggggttcaccatgtgggtcagcgctggtctcgaactcttgacctcatgattggcctgccttggcctcccaaagtgcggggatcacgggcgtgagccagtgggccagctaattataccttttatagcgaaagcgtatgagcgccttgaggcggttgcacggtttgctcaggcctgggacctgtgcagctg

SEQ ID NO: 611845 - DNA, 220 bp, Homo sapiens
tgtagattaaatggctgatctatgtatcacagagcgcaatatgtacgggacaaagtgggaggttgtatttcttggtctcttcctccttggataaagtcttgatgatctcctccttcttgtgcctggaggccgctcttcacggcgcttgcgtgcttccttggtcttagacctgcgagtctcagcgtggtcagccaggagcttcttgcgggccttatctgcg

SEQ ID NO: 611846 - DNA, 171 bp, Homo sapiens
catgactgaggcgggcataactgtgaccgtagcccaccacaggccaggcgctgcagttcctgcagcctttcgacaagtggcactggcacggcccttgaatggacctgcagactcctcatcaagggtcaaaggggagttgtaccatttgaccacatctcgagctgcaggccc

SEQ ID NO: 611847 - DNA, 358 bp, Homo sapiens
  misc_feature (129)..(129): n is a, c, g, or t
  misc_feature (131)..(131): n is a, c, g, or t
  misc_feature (153)..(153): n is a, c, g, or t
  misc_feature (162)..(162): n is a, c, g, or t
  misc_feature (180)..(180): n is a, c, g, or t
  misc_feature (206)..(206): n is a, c, g, or t
  misc_feature (213)..(213): n is a, c, g, or t
  misc_feature (301)..(301): n is a, c, g, or t
  misc_feature (339)..(339): n is a, c, g, or t
  misc_feature (342)..(342): n is a, c, g, or t
  misc_feature (355)..(355): n is a, c, g, or t
cccgcggtggtcattgtggtgccgggccgcagatagtccagcccgaactgcccgcccgccacgtcgaccagcgtggcgatcagcccgccttgcagcgccccggaggtgttgaccaccgcggggctgacngncatggtcatcgcgaactgaccnttgcgggtnccggggcgcatgccgatntgcccgaacaactccgccagcgacgncgcgctngagtcctcgtcggtgtcccggatgcccagcgcccggctgcagaagtcgtagagctggccggcgtcgacgggggtgccgttcaattccncacccagccagtgcaatcgctgcgcacccatcatggtntgnatgacgatggcgnccg

SEQ ID NO: 611848 - DNA, 286 bp, Homo sapiens
ggtggatgaagactcggtaaacagctttcaccagcttctgcgtatcgaccgtgacagctccagagtggaccaacctccgaacagctgtacggataaccacatccactcctggacagtaatacagtggcagcactcctcacgcctccacttcaggttgacttgtgacgagacataagacggtcccatgacccacgtgccactgaacgcgacaaagggactccaggggggcacgttggactgtgtcctacaatcacggagtctgggggacgagatccagtgacttctg

SEQ ID NO: 611849 - DNA, 466 bp, Homo sapiens
  misc_feature (424)..(424): n is a, c, g, or t
  misc_feature (430)..(430): n is a, c, g, or t
gcacacctgtcgcaggtctgtcttctgtacgctacagagtcacgcgtaaaacacctactataccgccaaaaaaatacaaaacaaacacacatcgacttcataaaacaccaactttataatctgtatataacacaagtctgaacgttacacaacggccttaaagcaaggcggaatatatacaggatgcacacattactgaattcaagaacagccccaatgcatacgattaagtagcctacactgacaacacggactgtatctagagtctggctggttgaacgtctcttggagaatctctgcctgttaaccaaaaacatgtgctacacgcgccacttaaaaaaatataggcctcttaattaaaaaagttcagacggaaatcgagttaaattactttcagaaaaagttatagattaaacgttaaaanaaagtngacgcggccgcgaatttagtagtagtaggcgaccgc

SEQ ID NO: 611850 - DNA, 126 bp, Homo sapiens
  misc_feature (5)..(5): n is a, c, g, or t
ctcancccaagcagcagcacatttggtcgcaggcttcccagcaaaggctacacaagggcagctcagctgtagcaaagcagctcaaccaagtagcaagcagtcctgccagcgaaaacgggaagctat

SEQ ID NO: 611851 - DNA, 199 bp, Homo sapiens
ccggagggagaggagaggaaggaagaagagagagaaggacgcgaaagaggaagacgaaggtaaaaggagagagatgcgaggaatggacaaaggagacaagtcagcacctacgaaggttcgagaattatgtaggaaaagatagaaaaggagacgaagaaaaacgaaaaactacagtagtcaaaaacaagctacaaaaggg

SEQ ID NO: 611852 - DNA, 149 bp, Homo sapiens
gctggacctcagtacatggaggatgattccaccaccgtctcacaaaacggacaactgggtcagccaccttgatgtctatctctgagtacatcttccgcaaatcatgcagtcacacatgtccagtgtagagctccccatgtgcccagtga

SEQ ID NO: 611853 - DNA, 553 bp, Homo sapiens
  misc_feature (553)..(553): n is a, c, g, or t
ggcggggcgcggtggctcacgcctgtaatcccagctctcagggaggctaagaggcgggaggatagcttgagcccaggagttcgagacctgcctgggcaataatagcgagacccgttctccaggaaacacggcaacaaaacaaaaacaaaaaaaaccaaaggaccaaaaaagaaacaaaaaaaaaaaaaaaacatatttgtgggggcgccgccccgcgcgccctgggaaaaaaggtttttaaacacccatttcgggtggggcgcggcgcgggcgccccaatcggtagtgttaatggcaacacgtggggcaaacacggggcgacccaaaggagaactcggggggcaagcgagagaaggcggggtggggttctcctcccacaccataaaaaaaaccgcggcgggcgggacacacccgagcgcgtttcttgggacacaatccccagaggggggggttcccgaggagggcgcacagacgggggctctactaacaccacgagggtgcgccaagaggaacgcggccgaaattacaaaattaaccccgcgcagaggtaggn

SEQ ID NO: 611854 - DNA, 637 bp, Homo sapiens
  misc_feature (10)..(10): n is a, c, g, or t
  misc_feature (215)..(215): n is a, c, g, or t
  misc_feature (329)..(329): n is a, c, g, or t
ggggggcagncccacacccctccaagtgtggataaaaattttcccggcagggtcttattgggcgcgaaaaaccaaagaagttttttccatcccccgtgggttggggggcaaagtggagacctcaaacccacaagggatttttattccccgtgacaattaattgctggccctcggagagtggaaagggcggtgaggcgccccatagaaaatgaggnccaagaaaataatttagaattgaatgaggggggtatccccaccccccccccgttgggggggggggggcctgttatcggtgagattaatgggggggattcacaacccagttcccnaaaacccctgggggggggcccgcctgtgattgaagcccaaaaaaaaaggggcggcctggggtttagcattggggggcagcccaaagaatttttcccgggtcaaggttcctttgttcccaaaaaaaatttttggaacaaacggggtccccaaagggccccagggaaagggaaacacccccgccgggttttccccaaagccccctttcctagggggaaaggatgaaattttggaaaccccaaaaagggggggggaaaaggaaaattttcaaattaaaaaaaaaaacgcccaagaggggggaagggttttt

SEQ ID NO: 611855 - DNA, 275 bp, Homo sapiens
cgatctagaggatccctcggacagaggtagggacacacccacccgcacacatccatacagtccacaccataacacacacccgcacacatccatacagtccataccatattattggagcatagaaaaaaagttcaagccaggtacaggggcaggtgcctgtggtcccagctactggggagacaaaagcgggaaaacggctggagcccagaagttcaaggccgagccggggcaacatagcaagaccccatttcttaaaaaaaaaaaggttccagcca

SEQ ID NO: 611856 - DNA, 116 bp, Homo sapiens
caagtttatacggtgaacccaagctcccctcgtctatcatccataaccctcgcatactcgagcaacagccggaacatccaagccggcatatcttccctcctcagcacccttttcgg

SEQ ID NO: 611857 - DNA, 174 bp, Homo sapiens
cctgttgactcacacagacgtggcatgtaaggtggagcgttacaagaataacaaaaatagctccgtcaaaaaagcaaaaggcttcatgctatgcagagcagcactgagtttgtgaagcctcagtatgcctctttatcattaccagccgttgctgcacacgcctcaaatatctca

SEQ ID NO: 611858 - DNA, 910 bp, Homo sapiens
tagcggaaatagtgcgtagatcagcctgggtatcccatgtctattgcatcaactgacttgggtacctactgagacgctgatatgcctgagatgactatgagcttattgacgtggtgtataatccagatgacaaacatgtcagtgggagatatggagagcatatggaagtgaagtcagaagatagtcgatcacaaataacgattggacttagttagatacgctaaggaatggaaggagatagagctgtgatgaatgaggcaactggattcaatgagtactaaccaaggattcagcatttagttaaagcatatagttgtagtatcggttgtctaaagggatgctagagaaggtgagagagtgttttagggtaaaggaatgcaagtgtgctgtgaagtccagaccggatttttagtctgataaaatgacttttccattggggacaatgccccgaatgatagtggagatcacaatcattgcgctgaattggccaagcctttgtgtgtccaacccattattatctgaatctttgcatggctgcccacgcagaatagtctttcaggtaatcccgttaaagaaagcttaaatagcaatcctaggtattatcgcacacgtaattagacaaggccatttccttggtaaaaaggcagttccgagattcaatgcttcctatggattctagagtcgggaaccaattctcgtaggccaatgatggacccaatgtcaggagcttcggctctgtggacagccacataaagtgcgggccaccaggaatttgtactcccaccggtgggtggccgacttggaatggccaatatgagggcccacagcctcgccggccagccaaaaaaagggggaaaaaggccaaaattcggtttacacgactattccttgttttgcttctccttaacca

SEQ ID NO: 611859 - DNA, 146 bp, Homo sapiens
  misc_feature (55)..(56): n is a, c, g, or t
  misc_feature (108)..(108): n is a, c, g, or t
  misc_feature (142)..(142): n is a, c, g, or t
gtttcaaactacttttaccatgttatatctatttgcccaaacgtttgacatattnntggtcaaacaaaaagctataagtttatggagcttgagtttaaaatgtgcatnctttaggttaactcttaaacttgaaaaaataagntggg

SEQ ID NO: 611860 - DNA, 1182 bp, Homo sapiens
agcgggcgttctctcctccttcctccccgtcctccaggctgccggcaggaactttctctcgctgccggtgggaccccgtggtcatcgaccacgcgcgatgcactatgtcccccttacgaaagggaggtgactggagatgtaaaaccgacccccaatcgatcggacagatttggaatctcactggaacaacttggtatatgtccgagattgccaggatgttggggaacactctagctgttactcttcgggatgtgctttgaagctcaattaacgtgcaaggcctttctcgccaagagacacacctttcgcccgttccttgccattcgtgattgaatcccgtatagttgacaaagcatgaggtcactcgtgtgtcctagggatagacaagggttggggcaccgtttccttggggtccaaggtagcctaccatgagcaccagacaaaagcccataagaatttccgctgtccctttttcccttaatactggtgagattgcgtactattttgacttgggtccctgtgctggaagcggggcaagcctttcgatcaatagtgggggccacggggccccctgggtgggggaacattgggctttggtttcctattcttccatttatttataggtggccccttggggggcatggggcgaatacgtttgtccaattccttcaaaccaaacggttgtctttcttctggagatggagtcgcactggacttgatttctacggaccacctgttttggaaaacgcgaacaagggtggtccatcaatacccttattcccccgacgaattagtgagtgaaatcttatcattatacccttgagtaaatgacggcgtgtccgaggctttgtaaaccaggaagttcgacgcgggacaagattaggcatcctgggggccccccaagttttactacgcacttaaaaccttctacacacgacggcgtgggtgcttggtcgcacaagaagggaacgggacgcaatttggagaccaatggtcaatggaaaccctgggaaattaagtggaagttattggacttgaggttgcataggagttaaagaaacttccctgggtggtgttgattcagcaatgtctcaaaaacgaaacagacctcgtttaccggctttcattacttcaatcgcgaatgttggggacctcttgaaccataaaggaagacatatgcga

SEQ ID NO: 611861 - DNA, 100 bp, Homo sapiens
cgcacacgcccgagcacccacaccacacgccgagggcccacagctgcacacgcgaaagaccaaaacgccgcgaaaccgttatcgccgatcttcacggggg

SEQ ID NO: 611862 - DNA, 988 bp, Homo sapiens
atatgacctcccaatgaagaattcacttcttgcctacgaggataacactaagtggattagccaaaaatgccactgaccttcagaactccagcatgtcggaacgaagagctgacgctaaggccatggaggggcctaggcatggacgacggggatggggaagggaacatcctccccatcatgtcagagggatcatgcacgtaatcctacatctccaaggcatgtgcgtgtaccctatcgactgaaagtgagatcacaagaaaagctatccaggaatggcttgcatgcagatcatcggcgaatctcgtactcctcctcatcatcgagtgttgtataatagtatccaggagcagcttcacagcgtctgtgtgctaaaatatggtgcagccagatttgcaggccagtagcacccccagcaggacgagtggacaacccactcgaataaggcctcgctatctgagatggacgcgttcggatcgttaagtgcgcgtcaagcgtaccataatttagggccatcctccaaaagagcttggttggacgcatatgactcctggactcaacctttgacctgggatgccctcaatcttgtcgggacccacctatggtgcctgtggtagaagcagtgtctgatcatgtgaaacacaacacgttgtcctctctgagtcccagctatggggaaacctctggagtcagcagaaaccattgggggtaactgaagcaagggaagtgtcacctgcggcgaggaagttctgccgcgtggccctctgtcatcccattcaagattgttgcctaacagctgaggtttttgcctcttggtctctctagggactaggggcctggtttccaggcccttttgtggaaccttctccatgggggtttctgcccagtttaagttcacttcccggcggggagggaagggaccccttggggcggcagccttctcttccccaattttttttggcccctttttacattaaagagagtgggttca

SEQ ID NO: 611863 - DNA, 515 bp, Homo sapiens
tataattattctcagactaacactgataaagtggcaaagttggagcatgtctctacccaaagctattttacagtgttgatcatatatattttgcttaaattaacagtgtgacaattatgttactctgtcatatatcagttctaacaaattatttaaaaaacacttttctcttaatgattttgctattcataaacatgactgttaagtctagggctgatagcttgtatttgcagtttgaatgacaaatcttttttttgtttctcaacataattgacatatttttaaaagaactataatttttcaaagacattattttcttttatggcagacaccttaaacaatcagttatgtctgtgtgggtaattacttaaatgttccagcagttgcatgacactatataagtgagtgtagttagaaaaatgagctcatgcccatttatgtataaagagcatcatgattaaaattaccaaaaagagaaatataagccaagcccaagttatcagtgtatgtttctt

SEQ ID NO: 611864 - DNA, 184 bp, Homo sapiens
ggagttcaaagttaagaacgggaagaatgtcaataagggcacctttccaagagctactaagcaggcacttggacatttcaggagtttgtcttataggttgcataagaattatccctaatcacccgagacctggcaccgctttatggtttcaacagttaacgaaccgggacagacatggcgtggc

SEQ ID NO: 611865 - DNA, 334 bp, Homo sapiens
gagcctgacctgcagctctctctgatgtggcaaagcagaacttagcattctgttgattttaaattgttgaggtcaaaacttagatgtcagctggacgcggtggctcacacctgtaatcccggcactttgggagaccgtggcaggcggatcacttgaggccaggagttcaagaccagcctgaccaacatggagaaactccatctctactaaaaatacaaaattagctgggcttggtggtgcatccctgtaatcccagctacttgggatgctgaggcaggagaactgcttgaacctgggaagcggaggttgtggtgagtcaagattgcaccactgt

SEQ ID NO: 611866 - DNA, 3493 bp, Homo sapiens
cacaaagaaaaaagaaatacctgtagaagcgcatcgaaagctcctggaacagagttgtgtctcatatttgcaaagatgcagaaaaaataaacccgggacatccagctttcttttcctttcttctttgactattctgagaagctatgcgactaggagcacattttaggtaaacacgtggcttgagtagccataaggccactcttccctgtcgtgtgacccgcgcctgggcctttaagagatattggtgtttgaaaagggaggaatctgtttgccctcagatatttagttcaactgcctgcattgcttcctattttgttgtccaactctgtagtagttagcactggccttaccaacatgtaaagaaattttctttactgccccatgagtagttggaggcaaagagaaatttttaaagcgcagaaaaaggcctgcagggagatggaatttgttctgccagagaaacgagatgatagctgtatttaataaagttactgacctcttgtcaaaatttaaaacgcaaaagaagatgtttcaaaatgcagagaatgtcagaaaacaaaaactacagggaccagaccagtataatgtttagttttcattatactaacttttgtctagactggagttgattcactattttttctttaactcctcaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctgtaatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaaaaaaaaatatattttatttattt

SEQ ID NO: 611867 - DNA, 127 bp, Homo sapiens
ctaacatgctataagcatgcacttggccgtcgttgtacatttaacagctatgacgcatgcactgggcgccgttgtagactcgaccgctatgaccatgcactggcggtcgtattccacaagcggccat

SEQ ID NO: 611868 - DNA, 597 bp, Homo sapiens
cagacgtagtcaataacaaagtaatgaacaatttacatctatcattaaaaaagaaaacccacccagagtggagggtcagtatctgtaatcccggcactttgggaggctgagagtggaaagatcactcacgagtcagaagttcaagacctgggtaacatcgagatcttatctctacaacagaaatttaaaacttagctgagcgtgatgatcacatgccgtggcagtcctaggtacttggagagtgctgaagtggaaaggatgcacttaagcgcgtgagtaccaggcagaatcgagctgtgactgtaccactgcactccagaccgtgtgacagaatgagactccatttccaaaaaataaataaataagcaaaaataaaaacctgagcttggtcatcaaggacaaagatttaaagaaggtagaacaataactgtactttcttataatcagttaaattaaacctgcgggaatatgaccagttaatttccagcctgctttttctggtgatgaggcagtacaagaccagtccataaaattaagtgtcttcagggtgggtgagggatagacaggccaacaatttctacaaagaaggctgtctta

SEQ ID NO: 611869 - DNA, 791 bp, Homo sapiens
ggtctgctctctccggcatggcgtgtggtcgcccagtgatatcggggtactccgaaggagggggagtcatctggcgagaagtgtcacttagcctgcgtgtattcaagggtcctatgtcgaccagatattgtgaactttgttgacaccaacttgcgcaataaacaacagatagccctagtgcttgtcagtgaatgatcatcggtcatcaagacgtattgcatgaagttctctggaggttgctatggtatgagcctagtagagctcgaagtatccctaggacgattcgatggtggatgcggagtcacccggatctgagacaggggctgccattttggaaacatgtgatccgtgtaggccgattgtgtatgctaccaacccaaaaaacttggcgccagtgagcatcgtgagcagtgacacacaaacccaaaacaaggatacagccaatcttgtatctagccctaggcatggctcaagtccgtacctagcacatggtcgttgtctcacacacggtacttccgtgttgacgggaacgataccctgaacattccttttgagtcttccgtgagagactacaaggttaggcatgggttactaggaaaggcatgcacatagcaaacgggctaggatcagtctcccgtgtacaagaacttgttacacagcctgggaactgactagtctggaaaaggtgtgcctatttctcgtcatcaggcgcaattgacgatgcctgggagaagggcataatctgataactactcggttccaccgatactccggactggaaggggtgccga

SEQ ID NO: 611870 - DNA, 2916 bp, Homo sapiens
attcgcggccgcgtcgacgtgggggttcagagcctgctcgccccagcgtcctccaggcggttggcagcgccgccggaaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctgtaatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaaaaaaaaatatattttatttattt

SEQ ID NO: 611871 - DNA, 2862 bp, Homo sapiens
attcgcggccgcgtcgacgtgggggttcagagcctgctcgccccagcgtcctccaggcggttggcagcgccgccggaaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagctttgatctgactcacacctccacatatgacgtaatcaacccaaatttgacaccaattcactcttttctgcaaagggcatattttgaaacaagggacagcctgagggcggctgtaatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaaaaaaaaatatattttatttattt

SEQ ID NO: 611872 - DNA, 2981 bp, Homo sapiens
gcagaagtcccttgttctgagaccagttctgcaacttctggaagatgtggaagcaggaatttaagctgtgctttttctgctgaaatttataaggattcattttaggatttcttgaaagattcagaaaacttgagacgaacaaaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctgtaatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaaaaaaaaatatattttatttattt

SEQ ID NO: 611873 - DNA, 195 bp, Homo sapiens
aagtacatatacgaactcgagctggtaccctgtggaggggatgaggttgcccctattagccgagccggaaggccgttattgactgccattctgcagtggtggatgatcctgttgctgccacctgtgatgcaccgtcctacatggcagaccgtggctgtgaacatgtctgtccggtaacctggctcggacggcctg

SEQ ID NO: 611874 - DNA, 203 bp, Homo sapiens
ttcatgacatttaatcctagtaataatgatctgtctaaggtcagttaggatcaccactttattttaagaatgtgaaatgtcagaataatagtggatagaattatttatttcagcttttatatatttcttggcggatgagatcgcaaaagctcaggttgcccagcccggcggagatacaatcttcgctaaaatcatgtcgacgc

SEQ ID NO: 611875 - DNA, 950 bp, Homo sapiens
tgccaccgcaaccccgccatggagctggacgtcgcatgcgcgccctgctcttcggcgccgctgggctgctgctcctgctcctgcccctctccatcttcctccttcttcaggacacctgcggcccctgcgagccggcactcctgcccgcacccatgcccccgctgggctgccatgctggagcgagacccagagacgcgtgcggctgctgccctatgtgcgcccgcgtgcgattggcgagcctgtgcgggggtggcggcgccggccagggggtcactgcgcgccgggcatggagtgcgtgacagagcccgcacacgagaggcggacaacgggtacaagcccgggcgccagccacgcctggcggcatccagggctgctaacgcggccagctgatgccgtgtgcacagaagccgctaccccgcgtgctagccgggccacgacagaaaggagaagccaccctaagccccgagacgggcctaggccaacctggcgcccgccggcacaagccccagcaagaggccccgagcaacaccgcaggccccacccaaagggcccactaaaacccaagagcgtcacgcccaacgcgtcacacaccactgctcacagccaacgggcatccgctgtcccaccacagatgaacagcccccaccacaagtgccaccactcactgagaaaatggccccaccattagagctggaccccaaaggcagataacctctggacaacacggactcacatcacccacgtccgataaaccaccccccgtcaaaaccattgatcccctcaacctacttgagaacacgcaccaggttaaacctcaacagatcgctcccctctactcccgaactatccaccacagcggaacccaaacatctcacaaacaaatggcatcgaaccagcggcacaaccctttggacccgttccaataatctctcgcgaatgaacaacaacca

SEQ ID NO: 611876 - DNA, 481 bp, Homo sapiens
tatctatactgacgcaattaaaaaataggctgggtattgtggctcatacctgtaatcccagatcttgtgggaggcggaggtgggaggatcacatgaggcctggagtttgagaccagcctgggcaacatagcaagaccccatctctaaaaaagcagaaacaaattagctgggcatggtggcgtgtgcctgtacttccagctactcaggaggctgaggtgggaggatcgcttgagctcaggaggcttgagaccagcctgggcaacacagtgagacttcttctcaacaaaaaatacaaaacgtcagctgggcatggtggccagcgcctgtaatcccagctacttgggcggctgaggcaggaggatcacttgggcccagagttgaaggctgcagtgagctatgatcatgcccctgctaggccacagagcaagagcttatctctaaaaaaaattaaaaataaaaataataaatagcaaaggaggag

SEQ ID NO: 611877 - DNA, 476 bp, Homo sapiens
  misc_feature (110)..(110): n is a, c, g, or t
  misc_feature (469)..(470): n is a, c, g, or t
  misc_feature (472)..(472): n is a, c, g, or t
ccccttcctttgttgttattgttgttttgagacaaggtatcactcgatcactgaagctggatacagtggcaagatcatagctcactgtaacctcaaactcctgggcacangggatcctcgcatctcagcctcccaagtagcttggaccacaggaaagtaccaccatgcccagctaatgttttttcattttttgtgcagacgaggttttgctatgttgtccaggctggtctcagactactggccagaagcgatcttacctcctcagcctcccaaagcactggaattacagagtaacatctaattttaatattcacattcctattttaatattcatattcgatgatggcacttagcaacatcctcctatatccatattaaaacctgttttccaagattgtgtctaatatgaaggtgtaaaattgctttgttttcactccttcttgaatgaataaatttgatagtaaccaannanaaaa

SEQ ID NO: 611878 - DNA, 116 bp, Homo sapiens
atgctgcggtcgctctacagatccccctcgggagcgtgactaatgcttgtcaaaccaaaggaactttgcaaaataatatgcactgcttaagcgcaagactgtaccaattataccat

SEQ ID NO: 611879 - DNA, 414 bp, Homo sapiens
gttgccctctacgaaaaatacaaaaattagctgggcgtgatggcaggcgcctgtaatcccggctactcgggaggctgaagcaggagaatctatttgaacctgcagaggtggaggttgcagtgagccgagactgcgccactgcactccagcctgggtgacagagcgaaacgctgtctcaaaaaaaaaaaaaaaaaaatccccatttagttttaccgagaaggcgataaaacctgataggcccattcaaatcatctgacatgaggcttctacttctgaagggaggtctgacacaggttaaccgatttcaggtttttctacacaggttttgtgactgttgattgatctaaaaaagctggtttcaaccaaaacacttgtgatgtcggatgtggacgctccgggttttaaggctataac

SEQ ID NO: 611880 - DNA, 176 bp, Homo sapiens
  misc_feature (38)..(38): n is a, c, g, or t
  misc_feature (77)..(77): n is a, c, g, or t
  misc_feature (84)..(85): n is a, c, g, or t
accgcacctggccctagaacctcattacatcttaactnggaatcttgcaatcaacttcacactggcctccaagttancccactnnagtctctcctcatcccaaggatcgccagagagaatcttccaaaacactggacttccgtgacccagtccctgccaaccggcttcctgaactt

SEQ ID NO: 611881 - DNA, 453 bp, Homo sapiens
  misc_feature (446)..(447): n is a, c, g, or t
  misc_feature (449)..(449): n is a, c, g, or t
gaggcagatggatcacgtgaagtcaggagttccagaccagcctggccaacatggcgaaaccctgtctctactaaaaatacaaaaattagccggacgtgtgcctgtaatcccaagtagcttggaccacaggaaagtaccaccatgcccagctaatgttttttcattttttgtgcagacgaggttttgctatgttgtccaggctggtctcagactactggccagaagcgatcttacctcctcagcctcccaaagcactggaattacagagtaacatctaattttaatattcacattcctattttaatattcatattcgatgatggcacttagcaacatcctcctatatccatattaaaacctgttttccaagattgtgtctaatatgaaggtgtaaaattgctttgttttcactccttcttgaatgaataaatttgatagtaaccaannanaaaa

SEQ ID NO: 611882 - DNA, 520 bp, Homo sapiens
agtgtatcatgattacttgtgtttcctctcttatttcagtaagcagactacaaggtaagacgacgacccagagacagctacaatgttcccaattaactgcgcacaaagtctttatgcaggcagatgatatctcacataatatgatatccatggatccgaaagggagggagtaaaacaaagaccagctacaggggagggcggaaggagaagggcatgtcaatgtacaaagaattcgggtgtcttccagggcaagacacaaaggtttccgtgaggtgatgaggtgagtggggccatgagcaccctcctgagagaggacaggctccactgtcgggcttgtaggtctttgcaaagtaaaaacaggactgaagccagcacgtctgtttggttagtcggtgtccccccaccccccacagctgctccaaagtctttccatccagtcccacgaatatacagagcactactgatcagtatcccatatttgagaacggacgaattacgagaaacacacaaagaaaacggg

SEQ ID NO: 611883 - DNA, 1381 bp, Homo sapiens
gggtgtaccgtctcagccccatttctgatcaacagggtgaatggcagaacaggccctggcccttggtcccagccagctctctgtgtggcgcccttagagacctctgtgcgcctcagtttccgtactctgctctttggctaaattcgcagacccttgtcacgaagatggctcgaacgccccttagagcctcgtcctccactctgcaactcccaataacagaacaatttgataggatgcttactcgtagactggagtggtggtggttaagtcaagtttactagggaatttgagcaagaatcattgctccgacgctacaaggaagcatagggataatacaccagacacaatagcgagcgagtcgagcactccaaggagtctaccccgcgaagagaaagggtcaccgaaccatattaacccgcttgcgcacccatgggtgtcccctgaggtcagaggcggttcgccacgcctaaatttgccgccggctccggttgttttggccctactcggccgcggggcttggacgggattgtcaacacgcccattcgccaccgtctgaaacaggggagcatcggccatgggagcacgctctctgttatcgacaaggaggactcccctcgaatcactggtgggagagcgtgaggaatccccatctgagggcgactaaatagttcctgctctacagtaaaaactttgtccaatgtccctgtttaggggcgatggatttctaaaagttcctaggtccatttcgttcttctcatgtcgaggtcaagggagcgccatacctcagggggacactcgtggagctatgtcgcttacccaaccattattgtggggggcctatccagtggggacaatgtaacaccttggtgagacccatggatgtgtgtataatgcccgcagggagttcccttggaggtgtgtgctattaccaccatttggggggaggtccatttactttcccacatggaccgtttaccttatgggcgcgtgacaattttacacgtgtattgacgcctttgtggggatcccaactacctttaaacaatgtgctcagaatcgccccacaggggctcgtattatggggcaggcaaaccgctgtcgagtacacatgggaagatttggtgaacatgaaattgccccctggagcatctacctctaaagagacatcaatttgggtcaaaccccaaaacttaatcgttttcaaaaacagcaaaggccccaagacacagcttcagtgtcaaacctatgcattcagcacgacaatcccaccaacagagaatgtcataaacacccctggaaacgcccggcaaacaggagacggtggcaagcgccctttgcacacagaacaaccaccacattatcccacctcaagctagtcaac

SEQ ID NO: 611884 - DNA, 740 bp, Homo sapiens
gattccattgatggctcgatgtaacacgataaatctcgataccataggtgcagcacacaccacctgtccgacaacaggccttcaggataacgggataatgcctcatatattcacctcagaataggtgttctctctcttcgcatggacttggtcatgcatccttgtgactccgatcgtcctaggtgcttagcccgcgtacctcctccaattgaggagggcatcgtggtcgccgaataggtcatcaccccggctaaatcccgtataatgtcccactcctaaacatgtccgtatcagtcgtcagtcatggacgtaatcagatcacgcgtgagtctcacgcatcagtcataacttggaaagcaaaccggagaacccaagagtaattcagagcagctgcttattacgatgttttactgggatctctagttttaccgcgtcgcgttacaaggcctcagagtacttgcgagtctaccttcaccatttccgacgggatctacggctcaacatggtatggtagccactaggctttccagcggacttcacgtcgattagttggctcacacctttcctcagctatctgcttcatccgccaacgtaatagtttcaggtttacatccaagacagtcactttggcttcgaagccgccgctgaatactggcatttctgtagatgtggttttgactatttctgtatgtctccatctattgcatgagggtcttaacaaaaacacatgtagaacaaat

SEQ ID NO: 611885 - DNA, 370 bp, Homo sapiens
tgccgtctgtgatacaaacgctctgtgactggttaaaaccctgacgaggatatgcgaggacgtgcccgttgaggaataattggtgtaacaggccctggcatttggagcttagactagtctggatgtacggagaactgagcctagactggaaaggaaccagaccaggccctcggtcttggcagggagggccctttggacaggaggagctccagggtgtcagaatttgattggagttgagttcgagaagtaagagggatgtaggggcagggagttcctaggcctcactgaggaatagagaatggggaagaatgctgagaccgcattctgggaaacgtccactgcctgcagtctgggactcaggatcctagat

SEQ ID NO: 611886 - DNA, 159 bp, Homo sapiens
ctccgttatataccttccccctctaacccttaactagtggtctagaccctccgctatataccttccccctctaacccttaactagtggtctagaccctccgctatataccttccccctctaacccttaactagtggtctagaccctccgcgtcgacgcg

SEQ ID NO: 611887 - DNA, 447 bp, Homo sapiens
  misc_feature (8)..(8): n is a, c, g, or t
  misc_feature (34)..(34): n is a, c, g, or t
  misc_feature (442)..(442): n is a, c, g, or t
  misc_feature (444)..(444): n is a, c, g, or t
  misc_feature (446)..(446): n is a, c, g, or t
ctgaacangggaaaacaaaggcctgcctattttnaatccacctagtagtaaatgtcaaaacttcctgaactggaacaaaatgtgccttatccttttcctcacccaaaatgcccaatgaaataacagtatacggattaaaatttaaaaagcagccccaggcgccgcggctcacggctgtaatccccagcactttgggaggctgaggcgggcagattgcctgagcctcaggagtttgaaacccagcttgggcaacacagtgaaaccctgtctctactaaaatatcaaaaacattagccgggcatggcagcatgtgcctgtagtcccagctactcgggaggctgaggcaggagaattgcttgaacctgggagacggaggctgtagtgagccgagaattggctactgcactccagcctaggctacggagcgagactccatcaccanantna

SEQ ID NO: 611888 - DNA, 121 bp, Homo sapiens
ccggctcatttagttcaactaaatactaccgtatggcccaccataattacccccatactctttacactactccccatatctaacaacgtaaaaataaaatgacagtttgaactgaaatgag

SEQ ID NO: 611889 - DNA, 421 bp, Homo sapiens
ttcatagcaggtgggcacagagaactattcaaattttccatttattcttgtgataggttttttcaggcactgtatttttaaaaaaagtttatccattttatttaatgattagacttgtggcctaatgttgttcataatattcttttttatgtctataggatctatagttatgtcccctctttcattccttgtaataataaggtttttttttcctctcatcagtctcgtgaagagtttatctagttaagttaatttaagaatctctccagaaccgctcttgactttgttatttttctctattacatctctgttttctacttcattgattacacattttattaatttgtttttcttctaccttcttcaagtgaaagtttagatcaatgattttaaatcttcttttctaatgcatttaaaggta

SEQ ID NO: 611890 - DNA, 101 bp, Homo sapiens
attttggtagtttgcgtagagataagtttggccatgttgcctaggctggtcatgaagtcttgggctcaagcagtcctcctgcctcagccttgggtctccat

SEQ ID NO: 611891 - DNA, 106 bp, Homo sapiens
accggctttgcccttttgggctttccaaaaggctttttgggcgccctcataggaggaccccccgcagggcccggccccgggttcccgggcgaacccccgggcacga

SEQ ID NO: 611892 - DNA, 153 bp, Homo sapiens
atggtagcaatatgcagagtattgccaaccagaggaagcttacctgaagcctttatatccagattctttgttgggacttcattacatgggtatgtttgttgaatcagtgccatgatgtccaatcatttcagctcttgttccagtattttggtc

SEQ ID NO: 611893 - DNA, 177 bp, Homo sapiens
  misc_feature (10)..(10): n is a, c, g, or t
actacatgcnctattacaagctttataactttatttctgatgtcgttcagtgtctaaaatgtttcacatgctctctgccttagaaagggttaagagttgataccacataatttacaccattctttttttggtaagcggaaacagggtcttcctctgtccccatgcgtggattgccag

SEQ ID NO: 611894 - DNA, 1359 bp, Homo sapiens
atggacgacattttcactcagtgccgggagggcaacgcggtggcggtgcgcttgtggctggacaacacagagaacgacctcaatcagggggatgatcatggcttctcccccttgcactgggcctgccgagaaggccgctctgctgtggttgaaatgctgatcatgagaggagcacgtatcaatgtgatgaatcgtggggatgatacccccctgcacctggcagccagtcatggacaccgtgacatcgtacagaagctgttgcaatacaaggctgacatcaatgcagtgaatgagcatgggaatgtgccccttcactatgcctgtttctggggtcaagaccaggtggcagaggacctggtggctaacggggctcttgtcagcatctgtaacaagtatggagagatgcctgttgacaaagccaaggcaccccttagagagcttctccgagaacgggcagagaagatgggccagaatctcaaccgtattccatacaaggacacattctggaaggggaccactcgtactcggccccgaaatgggaccctgaacaaacactccggtattgacttcaaacagctcaactttctggcaaagctcaacgagaatcattctggagagctatggaaaggccgctggcagagcaatgacattgttgtgaaggtgctgaaggttcgagactggagtacaaggaaaagcagggacttcaatgaagagtgtccccggctcaggattttctcacatccaaacgtgcttccagtgctaggagcttgccaggctccaccagctccccacccaacccttatcacacactggatgccatatggatctctctacaatgtactacatgaaggcaccaatttcgttgtggaccagagccaagctgtaaagtttgctttggacatggcaagaggcatggcttttctacacacactagagcctctcatacctcgacatgcactaaatagccgtagtgtaatgatcgatgaagacatgactgctcgaatcagcatggctgatgtcaagttttctttccagtgcccagggcgcatgtatgcacctgcctgggtagcccctgaagccctgcagaagaagcctgaagacactaacagacgctcagcagacatgtggagctttgcagtgcttctgtgggaactggtgacacgagaggtgccctttgctgacctctctaatatggagatcggaatgaaggtggcactggaaggccttcggcctacaattccaccaggtatttccccacacgtgtgtaagctcatgaagatttgtatgaatgaagatcctgcaaagcgatccaagtttgacatgattgtgcctatccttgagaagatgcaggacaagtag

SEQ ID NO: 611895 - DNA, 161 bp, Homo sapiens
actagcgcgtatggtttgtttctctgggctgggagaacttactttctagagcgtttgttgacttgtgtgcctggggagcggtccatgatgacactcacaggaagccactgttcactgacacttggaagcggtcattgttaatatcacatggccactcaata

SEQ ID NO: 611896 - DNA, 343 bp, Homo sapiens
  misc_feature (47)..(47): n is a, c, g, or t
ctgtcaagtcggtccaactcagccctcaccctgacagattcggagcncgaaaacaagtccgacagtgagaatgagcaacctgcaagcaatcaaggccagtttaccctgcagcccttgccgccttcccataagcagcactttgcacagcatcatccatccatcacttttttcaacagaaactccctgaccaataaaaggaaccagagtccggccccgccgggtgctttgcccgccgagttgcaaaccacacccgagtccgtccagctgcaggacaactgggtccttggcagtaatgtacccctggaaagcaggcatttcctattcaaaacaggaacaggtacaa

SEQ ID NO: 611897 - DNA, 173 bp, Homo sapiens
ggccttactgatgaaaaattggggtattatgggaagtcagtcattaagaagaattatccctatagtttataaggatatattttatacatgtttatcattttaccaccttgtgaaaggtcatttttaaaaaagaccaagatggccgggcgtggctcacacctgtaattccagca

SEQ ID NO: 611898 - DNA, 105 bp, Homo sapiens
tcggtacccatcttgtgtctgttaaattctttgtatcatggcagacagtggctcatgcctgttatcccaggacttttggaggctgaggtgagaggatcgagatga

SEQ ID NO: 611899 - DNA, 155 bp, Homo sapiens
  misc_feature (47)..(47): n is a, c, g, or t
  misc_feature (116)..(116): n is a, c, g, or t
aactttgctgccagtccaagaggtgatccatcggccttttaccattngagcctgccacctcatgcctttgggcctgttaagctgtctcagaaaggattgcttggtccaccagagcnaaagagagcccgaggccttgaggagaggatttggcgcct

SEQ ID NO: 611900 - DNA, 220 bp, Homo sapiens
  misc_feature (71)..(71): n is a, c, g, or t
  misc_feature (220)..(220): n is a, c, g, or t
ggtgaataacttgctgaattgtgaaactctaggctgcccatatcacactgacattttgagggattcagaancagatggcaacatgctgggccccctgcctgttgccagaatgggccagaaaaaaggtgacatgttttgagggggggcatgggggtggcagcagctttctctcgccccaagcattaagagtctttacagagtcagaactgtttattacggn

SEQ ID NO: 611901 - DNA, 923 bp, Homo sapiens
  misc_feature (265)..(265): n is a, c, g, or t
gcagtgtgcggggcgctgtcggatctccgcagagcgatgccatgcagacatccattcttcctcagatctggggtagcggatccacaaagttcctgacactacttccatatttgcgctacaggagattcacgctacaaaagggaggccagtccgttctggtcttctcgtagattgccttgactcaggcatggccagcgtttcgcgcgatggttggacaccgtagtgctaagtccagtagagcgatggacctcagcatagcatgctngtcgtggcagggatgccacagcccacgtcacaggggagaaccccaagtgatactcgttccctgactgtactcgtctgacctacctgcctgagccatgttcacctgcccagcttgtccccgtgctgcctgcccaaagaccccagccatttggcctgtcaacccacccattggcctgtctgctgggtgctaacaaagctctcatcactccttcacttggtctgtctgtctctgtcttggtagttgccggtggacagcatggccgtgccagactcccagactgaggccaggtctaagcccccatcataccagcccccaggaccagtaagcccacgggcagccagggtccagagctagcccaggctggggatctcgactcagacaagatggtgacaattgccttgagtctgaggcatcctctgactgctttcctgccttgacccaactgcctcactatggtgaggagccgttcacaagtagtgttacacttcaatggtgaatgaaaatctgtaaaaaagaatgttaaagactgaacatttagagggacaacatgaaacgtgcagaaaatcctcaggtataacaaactgtgtgcatggggacccaacgccctgagttctggccatccgaaaagcacgtttgggagaaggaaagccctgctccc

SEQ ID NO: 611902 - DNA, 314 bp, Homo sapiens
tctagacggatccccactgctcaaaagatatggtaacatctggtatatgttattcacacaaatctcatctcctgtagtagatacgagatgactagaacagcactagctagcagaagcatgcttactacagaactaacttttactggtcttcaacatgttcattaagccattattcttcaatgagtacattacagaaaggcattgagataatctcttgacaattttactcagttagtaactattctttaagaagaatgatcgaggacaattatgagtgatactgaaaaatctcatcttagttcaaccttgtagct

SEQ ID NO: 611903 - DNA, 243 bp, Homo sapiens
ctggttccgttgctttttttgtaaccatttgtcttttaaattgtttatttctctgtaaccatttgttttttgattcttgcatgtttttacttctgtagaattattgcatttgagctccgctccccttccgaaccaaggtataaaagtaaatcaagccccttcctcggggccgagagaattttggaaagtcaagccttctcttggctgccggcttaaataaaggactcttaattcgtaaaaaaa

SEQ ID NO: 611904 - DNA, 193 bp, Homo sapiens
cgttatattttgtattttatgtagagatggggttttacatgtcgcccaggctggtctcaaactcctggactcaagcgatcctcctgcctcagtctcccaaagtgctgggattacaggcgtgggccactgcgcctagcctagttgttttaatgtattagtttttctcttgggctaaaggtattgactagagtgg

SEQ ID NO: 611905 - DNA, 755 bp, Homo sapiens
atgggacctcacgggagtagggcgaaaataataaatggaagagaatgaatttatgcagcagagagatgctcatggccatgggtgaaggacgagtactatgggtatccacatggtgagaaagaatactggcatgcagctggtgatgatctgtatcgtccttgcggagactgcccgggtaaagaactctggtttggtggcagcatcgcatatgtcgactctgaagtgcgctggattgtgtgtgctggtatggggttaagacgtcactgtaatggtaaggtccattcttcttagaggattggaccaggacatggccaaacaaaatggggtgaccacaatggaagaacatgcatcaagttccatacacgacagttcgtaccacttaaaccgtgacccaacatggaagcagggacacccaggccgactcagagtcgtaagctcagtcccagcagatagtgacggcaactcctcggaccggcaaaccaacaacaccacacacaccaccaccaacacccaccccgcggtgcgccgccctccgcccccctcgccagaccaccctccaccacaaccccccctccgcccagcggccgcccggggcccccagcaccggtcacgctcaaccggtgccccaatcgacgcccccaggaacaccctgcggccaaagcaaacacgggcgcggcaccccccccacataaaaaaaccgccggggcgcaaccgcggctccgcaccacccccaaaggcgcacgagccccacggac

SEQ ID NO: 611906 - DNA, 226 bp, Homo sapiens
gatctcgaggattcctgcaaggcgtttagtatgaggtccagtgcacataggcggactgagcactcgatgtcatccgtgtcgatgtccatccgtgtgtcccagaactgcctgctgtagaacacacttcctcctctcctgactctgtgaagtactcagtggtcctttttggattctaggcttgcacctcatactaaatattgaccctttcactgaccgcctctgcaca

SEQ ID NO: 611907 - DNA, 142 bp, Homo sapiens
gatcgagccggcccgagttatacaccatcacgaccatcatcactcactgtacaccaaaaacaagggaaaataatttaacttgttttcattaatctttcttaaacgtatatatagctcacacttacttcaatggtggtatcag

SEQ ID NO: 611908 - DNA, 1080 bp, Homo sapiens
cgagcttgtgtactggctcagccctgtctccccgaagcctgctgcgccctgctgccctgctgcccctcagtctgtgtgtgatgccctgcagccccccttgttgtgcctgctgtgcatgcttcccctgccctgctctgtgccctgctgccctgccatggtcctgtcctgctgcctgttgcccctgtaacctgctcctgtgctgcctgtgtgtgtgccacccttctgtgggtggtctgctgtgcctgcctcatcctgctgtgccccttctgattgtgattgctgctgcctgatcctgcatctgctgcttcctttgtgcctttgccatgcacccctgatggtgccctgcatgccttcctgctgtgattccttggtgccctgcttctggccaccttcccaattggaatgtgtgctctgagtgtctttctgtgtgtgcacttggggtcccaatcggtgtccactcctcaccttggtgctcacccatcggcggggtcttggcctgttgaggctgagcacctgtgctcagcaaaacaaatgcttgacttgtgctttgagatgctgggcagtcctctgatgttaggcatgtgatgaactgctgcatgaccccttacttccttgaactccacttgcaatatccttgaatgctggacccttgccctgcccaaggcctactgttgaacccaatggctgagaaccctgggaggaccggaccatgttggcctgcaggaatggctgatcaattgcagcttagattcccatcaggcagacttgcttgacacaaccccttggtgccccccttgttcccgtgaaactccccagtttgggaacaaattccactttcacacaacatgatgacttgcagactctgctacaaggtggggctcctgcccgcaatcaatgtggacagcggctttcgccgtggctggcattgctgtttccacccaaatacttccccttttaaggttgcagcgtgctcatgctcctaggaactcgttcaagaagcagaattctacatgtggcctcaatcccctaagaccagagggggtcgacaagtgcatcccggcaggtaaataccaaccgaag

SEQ ID NO: 611909 - DNA, 406 bp, Homo sapiens
cgtgaaacatctctgacagagatgtcttctcactctccagactgggtaggtatgatagctgcagtcagctcatactaggcggcggcggttatgtggtgtgagtgcggaaacggggcttcgaggtggtattattattaccgagcccattgacgagtactgtgtgctgtctcctcaaggaatttgatgggaagagcctggtctcatttaccaaggagggtctggtacgctgcctgaggattaggaggagaagaagaagatggaacagacgcaggcctcgtttgagtacctctgctagctcctgaaagacctcttagattcgaaggttgagaaggtgacaatctccaatagacttgtgtcttcaccttgctgctttgtgaccagcaccttcggctggacagcctatatg

SEQ ID NO: 611910 - DNA, 110 bp, Homo sapiens
gcagggcgggccgcgttggtctacgccgagtgacagagacgctcaggctgtgtttctcaggatggaccgcagtggggagacagcacgcaccagcggtggcagggagaccc

SEQ ID NO: 611911 - DNA, 214 bp, Homo sapiens
cgccgctgtcacgagcagggcatcagaactcaccatgatgaagaagtaccaggtctgaggcacgccgaactgccctgggaagacggctccatgtaccaggtcagcgagggcatagagcacagagtccagcagcagcaccctcagccccctggccacgtgatgccttgcaccacctcaggactctgttgaaagtaccgagcagcagggaaagaca

SEQ ID NO: 611912 - DNA, 763 bp, Homo sapiens
taggcccgttcaacgtcctgttacttaggcccctttgctttccggggatccatggttcccatttttcccgctcctttggatccttttccctctccagtgcattaatagccattctcgatggtggttctatgtgttctagccgctctttagtgttttcacgtgttccatcgcttgtccactaagtccatctccgtgtctagcatgtggtttcttggcaatatagctctccgtctgccacagttgcagttcagtgttgaatgtctctgctattgtgacgtttcggccaaggtttctgctcatgagtgtatatctgtgcctacatagtcccagttgcggtgtctcagttccagtccatgttcttagcatagctgttatatgagctatggcgtatgcctgtttacgcctcctgagtttttatacggctcgtgtccgtgagcacatcctaataccttgtctagagtgtctcgttcttcgctcatgctaatccctgcagcagtgtatctttttcttgagctaatgacgttttctggtattgcccgtgagtgtagttccttgatatctcattgccacagttctgcgtcccattccgttacccccgtaccctatgatttacgctatggctcacagtcccgtttagccactgctcacattacgagcttgctttgttctcggcttctctgtctcccttcctgcgcgcaagccctaaaacggaggcgcgcagtcacaatgtgtcatggtctccctcgtgccggattcctgcagc

SEQ ID NO: 611913 - DNA, 339 bp, Homo sapiens
cacagggtgggtccattctgcggctcacgttcgtgttctcatctctagactcacaacttcgtcctcctatggcgctccaccccgaacgcatagattagatagtagtgtacatctttctggcttaccaaacacgtttctagctttgccagtataaccccagccaatttacgatctctggccttcccagctagggacagtgttcacctcacaatgttaggaaccatgaggagatgatggcttaggctgatccctttttcatgaggtccggatggtgagaattacagtgatatataacagtgcttgcactcactagatgattgctgagccgggattgggctc

SEQ ID NO: 611914 - DNA, 1437 bp, Homo sapiens
  misc_feature (916)..(916): n is a, c, g, or t
caatcatttctagggggaaaattattgatggtgtcaggtttgtcataatgcatgagtacacgaaactgaagcagggacgagaagacttccgagtgccacataatgatctgacatatcaaacatgcaccccacgatttcgcatgctatttccagatgatgtcgcctgaattggtgtatcctgtagatgcgcgaatggccctcctcagatggggtcaggtggttcataatactaggattgatgcccctttggggttatatccaccagttgacccatcccatcaaggcttcattcttccagatcctatggattattctgctccaactcctatggtatctatccttgacaatggaggcaatgtcatattcatagacggttactgcgccaatgaggataactcatcatagaggcagcacggtttaaactaggtacgccaatgggaccgactttctaaaagaaacggtaggtcgcaaacctgtcttggagaacgtccgcgtaacgacattatggtgtctacctcaccggcattagccttgtagcctaaagacctagagtggttagacactttggttgggaggactaaatgtttttatacctttaaaggggcctgttgtcctccatggatgcacgctacaacggatggccctttttacttcatggctcaaacatgcttgtaggcgcgccaggcaatcctagaaataattgagaaactcagtgcactgtctcctagttaacttgaggcctgttaattttctctagagagtgcctctattctactttccatagagtaggggtacctacaattaaacttggggtcttgggaagagctaccctgcggttggggccattccatcggtggcccccaaggcttgaaatttcccaccagagggcaagcttttataagaaggaaggcggcgnaaaaatagacgctggggtaagcgccacttctggacttttgggaggacccccccgaggggtaaagcttaggcggagagaaaccacacgcacctcttggtaggtccaaaaccaattcagtcgggacatttcggaagggaacgataccccttggttttcaatttcctgatacggagcagccacttaaattggattcaaccacaacagcatctttacagatcccaaggcgccacattggtcgcgtgttcaaccagttggctcttagtaaattgcgccccgattcctttaacacttccaagggaggggccttcaaagcggccaccgggcaaggggattcggccttcggaagcccccaagtgacagagttgagaacacggtggggccagtttagagagccacacagcattctcaacggcccatattgtgaccttcgccaagactctgtggggcgcaatcaaggggaaggttgtaacacccctttggttctcggaggaacgaaagacaacgttagacagacgacgcaa

SEQ ID NO: 611915 - DNA, 140 bp, Homo sapiens
ccgccgctgccccagctgaggagaagaaagtagaagcaaagaaggaagaatctgaagaatccgaggatgacatgggctttggtctttttgactaaactgcttttgttaacatgtccaataaagagctgaacctgtgagta

SEQ ID NO: 611916 - DNA, 956 bp, Homo sapiens
gctcttttccggtggcgcctcggaggcggttcagctgcttcaagatgaaggctgaacatctccttcccagtcactggctgccagaatactcattgaagtggacgatgaaagcgcgaaacttcgtacttctctatgagaagcgtatggccacagatggttgctgctgactgctctgggtgaccgaatggaagggttatgtggtccgaatcagtgtgtgggaacgattaaacaatggtttccccatgtaacgcagggtgtcttgacccagtggctcgtgtccgtctgctaactgtacgtaaggggtcattcctgttgagcagaccaatgggagaactgtgagaagagaaacgagaaaatcagttcgtggttgcattgtggatgcaaatctgagcgtgctcaactgtggttatcgtaaacaaaaggagagaaggatattcctggactgactgatactagcagtgcctcgccgtcctggaggccctaaaagagctagcagaatccgcaaagcttttcaaatctctctaaagaacgatgatgtccgccagtatgttggtaacgaaagcccttagatcacagaaggtaagaaagctaggaccaaagctacccaagattcagcgtcttgttactccacgtgtcctgcagtcgcatacggcgggtattgctctgaagaagcagcgtaccaagacaaatacaggaagaggtctgcagaattatgctaaaacttttggccaaagagaatgaaggaggctaaggagaagccgccaggaacaacattggcgaagagacgccgaattttcctctctgcgaagcttctacttctaagttctgaatccagtcaggaactacgcatttgtggagtaacccacatcaattacacccgagtctggccaacaaaaaaacaaaacagagcaagaacaacattagggcgccctccactccacaagaagtttagacct

SEQ ID NO: 611917 - DNA, 105 bp, Homo sapiens
gatttgctggtgcagtacaactaggcttaatagggacatgatgaaatttccagatgttcactgagtgagccattggaaagtgatgaggcagacttggctaaaaaa

SEQ ID NO: 611918 - DNA, 744 bp, Homo sapiens
gacacgcgggttcaacatgcgtatcgaaaagtgtattctgttcgggggccatctatccgtggacacggcatgatgttcgtccggcaacgatggcaatggtgtgcagactatgcaaactctaaagtgtcatacatgaactttaaaagagaagcgcaatcctcgctaaagtgaggtggaccaaagcagttccggaaagcagctggtaaagagcttacagtggataagtgcagttcgaatttgatgaacgtagaattgaacctatcaagtaccagcgagagctatggaataaaagtattgatgcgatgaagagagttgaaggaaatctaaacgatgaagcgcgcaaatgctaatagtttataatcgaactagattgaagtaaatagataaacgagctgacagagaagtgtcagtgatatcatatgaagttaatgttaatagacatcccatcgttatggcgaggcacctcgttgtgaggcgaaagggaaacagttggaagagaaaatgggacagggagttacacagaggatgtggacagtggaagatgcgtccgttaacaaatctgctgtagaccgagtttgcttttactgtacagtttgaaagatgccgctttggatacttggggaactgtgtaaaattaattttatggtttgcataaggtcacttaaatgaaaagcgattatagacatctttctggattgacatctacataatatcagatatttacggatgttaggaattgggtta

SEQ ID NO: 611919 - DNA, 188 bp, Homo sapiens
cccccccccccctttttccccttttcagggggtttgggggggggttttaacccccctttccaaaacccggccccccctttatttgggggtttttttttttggggggccccccccccccgccccccctttgggtttttggggggggggggccccctttccccttggttttttttttattttttttttta

SEQ ID NO: 611920 - DNA, 638 bp, Homo sapiens
gagcaggaagtcgattatacacttccccacattgaaattgggaagaagaattatggagagcagttcaaggcataaggggctctggggaacaacataattttgctttaattctccagcttgttttcagtaagggtggaaggagaaagagaggaagtatagaatttacacacttcagctcgtactgccaagaaaagacagaaagcttgttgtaacaacccgtagacactgtgggagaactaaggagacccctggtgtagcaacagttttcctaaggaagacggattgtgaggcaggaaggtgtgaaaagaggaagtcgattatataattttggagtttctgctgaggaaacctgagtgaactcacttcagatgcatttggaatattttcataaaaaatatttgcttttggctgctccaggaactactggaagcaggaaacagtggtataattggaatacaccacactgacccattactcctcttggttactaggaggcatcagagatacatgttttgttgattttagttataaaaatgagataatcttgaatgtgaataaatttgcttccttgttcaaggagctacctcgtggataaaatagctatttaatgttaacttctttagagaataacacgattc

SEQ ID NO: 611921 - DNA, 462 bp, Homo sapiens
aatctttatgctaagggtggcatatgtgactgcttactatatctattggaataacaccattctagactcttttctgtcttaatagccccctatccaacatggtcataagtatcacagatgattccctatgtagtatagacaagggagaatactgtttaagtgcacaggtctagagtttgaatcctggctccaccatttgttgctacatatgaacttgggtagattatttaacccctttgagcttcactttcctcatctgtcagctggatacaatagcagttcttatattgagattctgtgcatgctttaagatgagataatgtgtaaagtacttactatggagatgaaaacatgtggaaagacccagtgtcaaaagaaagagcatgatctgtcactgtggtagtgcaggccctcatcattactagccaagactactgcgatgctttctccatcttcggttct

SEQ ID NO: 611922 - DNA, 428 bp, Homo sapiens
aggagtcggtagatagcagggagcgagaatagtcgggtcagggcatgagtgtggtttgagccaaaattggttctgtcctatttgcatcagtagtgcatatttggcaattcttaattcatgaagcagttcgggtgatgaaatggggataaaatagtgtcaaaccttatcccgttggtttgggtgaaacttgaaaatgaatagtatcggtggcaggtacttgttgagcaagggggagctgctgtttccctgtccctttattgatgggaaatatctagacaagttcccaaaccctctggcactggaggctggatggcacggagggttctttgtaacaccagctggggctggccttcttttaggagcttcagtgggtcctgaaaactttaatttgttggtttgtttcaggtagatgtggggtctttctgtgt

SEQ ID NO: 611923 - DNA, 191 bp, Homo sapiens
tccgtttagtgcaagtctataaatctcaatgtatgggaagcagcgtgcagtcttcactctgtggtcaaaggtcaaaagtcccaaagctgaagaacttggagtctattgtttgagggcagtaaagcaccgcagcacaggataaaagatgtaggctggaatactaagaccagtctagatttttccatgattcc

SEQ ID NO: 611924 - DNA, 955 bp, Homo sapiens
  misc_feature (1)..(1): n is a, c, g, or t
ntttcagatacacttgactctagtgactgggacagatagccactgtgtacctgcttcaaatcatcctgatcgttttctctttggaaggataagcgctgtagaaccatctcgctaccttcagcagaaatggtatcaaattaagacattaacaatgtcgcaccgtgtcagtatctatgcaaggttcagcagaggatgttttcatgatggtgtgccttactagccattaatcagaaaagatcgaagctggcgcttttcatctcaccctgctccttatattaaagcatctcctccaaattaatgtcttttgaaacttgcattgcttttgatcttaattgaatgcttactatttgtgaaccactgtaattatatgggaagaagatgtgggaaacacagtatgtgagccttgtttaaataaatttggagttggttttagggtacattgttgctcctttcgatgcaacctttgcgtttccccaataccactcaattctcgtgtgagtgtcgtatcagtctcatcctcaacacttccttatatcctcacactctactgccactattaccagttagcgagacttacgtagaactcgccatatattacgtgatatgcgccctctccgtccacccgtcgtgccctgtgccgtctctccccttttcctccggtgccattcaatctctcttcctcccttcacttctctctgtcccgtccccttcgttcgtactgagtgcttcttctcgacgtcccccggcattccctgttgactaccaacgcaccgtgcttcaaccgtgtgctctgcctctatacgctacgccgcacgcgcgccgatcgcgcggcggtggatgcgcgttgccaacacatgtcacccgctcgcgcctcgtgttactgtcgtcgtctcgccacgtgcactgctctcgcattctcttctgcgcgctcgtctccaccgccctcgcctctcct

SEQ ID NO: 611925 - DNA, 118 bp, Homo sapiens
tggaccatcgcgacgcttcatcaagtgtctcacccttctcccatgtgcacacacattcctttatgagggttaattggtctggtttgagagtctgtgctgttgatggaagcgtcgcgct

SEQ ID NO: 611926 - DNA, 202 bp, Homo sapiens
  misc_feature (22)..(22): n is a, c, g, or t
  misc_feature (40)..(40): n is a, c, g, or t
  misc_feature (83)..(83): n is a, c, g, or t
  misc_feature (97)..(97): n is a, c, g, or t
gacggtcgggagcgctcgaagnatctcggaccacccaaantgaaagtgcttaggaagttgaaaggcccagaggaggctccggnaaatggccggagcntggaccgaccatgctgctacgagaagagaatggctgttgcagtcggcgtcagagcagctccagtgctggggattcggacggagaacgctaggactcggcggctga

SEQ ID NO: 611927 - DNA, 186 bp, Homo sapiens
ttccccaaaaaaaggggagccccctgtcctgggcctgcaaaatttgggttttgcctgccagctgcactgatgttgcccctcatttttttgcccaacccttccctccccttggcaccagacccccaggacttttttaaactttgttgcaagtgcaataaatttgacccagtgccccccctggcccga

SEQ ID NO: 611928 - DNA, 304 bp, Homo sapiens
ggtaacatgacagactcttgtttagagtctcttgaaaacaaacaaaatgtaatcacagcactttgggaggccgaggcaggtgaaacgctgagcccagagtttgagaccagcctgggcaacatggcgagaccctgtctccacaagaaatacaaaaattaggcaggtgttatggtgcatgcctgtagtcccagctacttgagaggctgaagtgggaggattgcttgagcatgggaggtagaggctgcagtgagccacgatcgcaccactgcactccagcctcatcaacagagagaaacctcctctt

SEQ ID NO: 611929 - DNA, 240 bp, Homo sapiens
gggaatgggattacgggtcgccactattactggttgactaattcttatacttttataccaaatggggactaacgatatgggccagactagccttgatgtcctgacctaaagtgatctgtgcgtctgggctgcccaaagtgctggggccacatgcgggagcctacgcacgcgctgagaatgaagctgttcattaggagatagattagagtcaaacggtaggaatgctttctatgaatgtga

SEQ ID NO: 611930 - DNA, 938 bp, Homo sapiens
cgggcttgcatcctcattactattgtgcctagcaaactcaaactacgaagcgcactcacgagtcgcgatcagtaatcctctctcaaggacttcaaactctagctcccaactaatagcgtatgtgatgacttctagcaagcctcgtctgaacctcgaccgttaccccccactattaacctactgggagaaactcgtctgtgctagtaagcacgttctcctgatcaaatatcactctcctacttacaggactcatcatagctagtctacggccctatactccctctacatatttaccagagactacaatgggtggtcaactcacccaccagtagttaatcaacagtaaaaccctgcattcgacgcgagaaatacaaccctcactggtgtcagacaccgatcccgccatactccctcctaatcccctcaatccccggacatcaattaccgggattatgctctcaaagaaagaagaagaacaggaaggaaaaacacaatgtgtggcggaccgggtgtgtcaccgtggaaaaaggatttacaaaggatatcaggggggggcgcgggcccccaagagtcaacacaggggagcttgggaaaggcaggtgctcccggcaaaaaagccgggataaaaagggggaggtgatccccgacacaaaaagaaatcgccccgggcttgcccaggcgtgtgcccaacaccccggaggcggtgagcacagccaaacggggctccaacagggggccaccagggggcgaacaacatgcccgcgggggacgcaatttacggacctgcattggactggaggtaccggaatgatgtggacatagtatagacttgtgaacacaagatagcagtgtggaacatagtgtgcagcacagaaacagggcaccgccggcacaacacacgattatgcagcaagagcaagcaggaacagagacacgaa

SEQ ID NO: 611931 - DNA, 244 bp, Homo sapiens
ctgaatccatagatgtctgaatttaactcagaaatctcctccaaggccgggcacagtggctcatgcctgtaatcccagcactttgggaggatcacttgaggtcatgagtctgagaccagcctggccatcatggcaaaaccctatctctactaaaaatacaaaagttagctgggtgtggtggcgtgcacctgcattctcagcgacttgggatgctgaggcagaagaatcgcttaaacctgggagg

SEQ ID NO: 611932 - DNA, 350 bp, Homo sapiens
caccgacgaggaaaaacgccgcttatcgaagccatagtaccgttccctctactccctgtcaaaaaaagacgcccggtgcttaatgtgaaatagccgccgcccatgaactgaggctaatatcagaaaggtggcttatggttttttgctcctcatcttttatggtgaataccataacactgtgatttgtttgtttttgtttctgcttttttgagactgagacttgctctgtcgcccaggctggagtgcagcgccgccatctcggctcactgcaacctctgcctcccgggttcaagcagttctcctgcctcagcctcccgagtagctgggattacaggcgtgcgccaccatac

SEQ ID NO: 611933 - DNA, 302 bp, Homo sapiens
gcatggtggcgggcgcctgtggttccagctaactgggcggctgaggcaggagaatggcgtgggcctgggaggtggagcttgcagtgagccgagatatcgccactgcactccagcctgggtgacagagcgagactccatctcaaaaaaaaaaaaaaaaaaagaattattttgacgcggaagaatagagaggaggccttgaaggaacccagcaagtgagaaaggcccaggaaaagaaagagctgaaaatgtggagaaagccccaagagtttagaaccagtgtggattaccgggagaaaagaaac

SEQ ID NO: 611934 - DNA, 276 bp, Homo sapiens
  misc_feature (276)..(276): n is a, c, g, or t
gcaccaggcgcgcctcaacattgtggcggagtggcaacaacgccgctacaggcgagcggaaggagaaagtctagctagtttcggcttcagtgagcctctagatcgtagcgcggccagacctttcgcaggactggttgcacactctagaaagaatattagaagtccgcttggctctacgaacccatcatcgtaacaggtcttgaatgcattctcgtacttcttccactaggccttttttaattttttttcccctaaatgtaaacctgcgaacctatn

SEQ ID NO: 611935 - DNA, 403 bp, Homo sapiens
  misc_feature (172)..(172): n is a, c, g, or t
  misc_feature (219)..(219): n is a, c, g, or t
tattaaataaatatagtagtatataaaaaagctaatttattatgattaagtatgttttattactgagatataagtttggtttagtataatataaattaatatatgtgatttactatataaagaaaattaaaagcaaaagctatatgatcgtctcaatagatgcagataaagntgttgataaaatcaaacattctttcataataaatatcctcaattgantaggcattgaaggaatgtaccttaaaataataagagccatttatgagaaacccacagcaaacatcatgttgaacagacaagagctggaaccattccccttgagaacaggaacaaggcaaggacgcccactctcaccactcttattcaacatagtactggaagtcctaaccagacgaatcaggca

SEQ ID NO: 611936 - DNA, 988 bp, Homo sapiens
  misc_feature (510)..(510): n is a, c, g, or t
tccagtcctttggttttttggaaaaggggtcggtattgtttggcaaaaaaaacccgggaaaaaggcccggggggaaaccccggccttagtggtcccccgcttcactctctcaactgtagggcctcctgttgtgattgagcacagtggggcacacaccccatctccccaacctgttttccaggggtctcccgtggcgccatggggtgtggggttgtggagagtgtggagacacatgtgggcggttgggccgagcccttcgcttcttcattctccgtgatgtgtgtgagaccatctggactttcccgaggggtgttttttctcaagtattttgttgcgttgatctccggagtctcccactctcgggtcccccgcctccgccggggcccccgcgggcgtgcagaagaagccaggggaaaatcgtgcggcgcgcggcataacagagtgtgggctgtgagtatcccagtgggcggaactttcttagcgaaccaagcggtgttcggcggcgcaccnagtgccaaaaaaaccagagcggttgccgacactgtgtgacagtttgttcgtggtgcgcggcggggcgactcttctccccaacccgagaaagttccggggaacaaggaaagaattcccacgtttgtataggggcttatccccgagtggcccatagtggtctcccgtgcccaacgacgagccgccaattttccacggttgggggaaaaacactctcaagcgggccagtggtgtccccccgggatattacagaggtgctcctcccgtggctgttaacacgaggacggggtcttattgggaggccctctccccaaggccccggggggcctttgtttgccttcccaggaaaggcccattttgaggaaccccccccggcttttttgcctggccccccctcttttgtaagggggttgcgccctgcgcttggctcctttggggacgccctcgggtgcacgttgttttgcgccccaggtcttggaaa

SEQ ID NO: 611937 - DNA, 293 bp, Homo sapiens
gccatcggcccatctggagggtcttgggaaggaacagccccgtgaaagccactgtgtccactggagggatgtcatgaagacttcgttcattacacaaggcccctgggaggaacttgctgtctggtcttggtaccaagaatagctgaacttctgatcaacgggactgcttttgtctctagcagacattaatcgtgtaatagcgcatttcctctgtctgcactggctgctagaagcctttgaaccaaatctggacaaaaggcattaagggatacatttccagcctttctgaatcc

SEQ ID NO: 611938 - DNA, 132 bp, Homo sapiens
agacggcattcttgcgtgctgtctgaaggagctcatcaatttcctcttgaatttctggggctacataaggtacttggtagagcagagagaggcttgggttcctcctttcttcaatcacgtggagatgtgtca

SEQ ID NO: 611939 - DNA, 346 bp, Homo sapiens
cgctctcttacttctgatgtctgagtatccccgtcacgcccaccatggatctctgtgtcgttgacttggagtaagcctggtctcttgacctctgcaacagtgctctttcactgtgagatgccggtctatggaagctcaccttctgatctctgctaagtcactctctggctgcaattaacctattgagactgcggaaatcatccatactggtttcaaaacatttttttctttgatttcaagatatgtctgctgctatattacagatctaccaaagaaaatactgcgcggtgctgtattcccttcagatccttgacctacaacatttcagtatgagagaggccaattt

SEQ ID NO: 611940 - DNA, 349 bp, Homo sapiens
agtaaaaggacgagagtggacacatgaactcgctgatcgctcagctaccgaaatgtcatggcagaggctccgtcttggcttcactgtctcccctcagaaaagccagtctgagatcctcctcaagtcttggaccaaaggaaagacagacaggtgctgcggacgacatccctcagcctgcagtcaggcaccaggaccccgagcctctcctcgtggtgaagccgacacacagcagccgtgagggtggctgccgagaagttccccaggctgcctccaaaacccacggcctgctccaggccgtcagaccccaggcacaagacaaacgtcctgcggtagccgcgtagtcagatcg

SEQ ID NO: 611941 - DNA, 190 bp, Homo sapiens
aggcaaaccccagccctgtagtctgatctgcgcacttgggaatgcccatcccccactgtgcgggcactccagcctcacttgcgcacatctgtcttcaaaatgtggaggaatgggtttctcagcacctgtatacgcccacggctttcttatatccctgtctcctgcccttttgcatcctatatgcaacaat

SEQ ID NO: 611942 - DNA, 122 bp, Homo sapiens
cgcttcgcttctgccgcttcctgcttctgcctacgatagcccttatgaaacttaagggtcgaaggtggatttagcagtaaactgagagtagagtgcttagttgaacagcggtcttggtgagg

SEQ ID NO: 611943 - DNA, 267 bp, Homo sapiens
caaccgtgttctccagcaacatccctctcctttattttgaggttattaaagggcactgcttgggcctgtagaaccaggccagaacctccttctgtatggcagctaacagttagggctccagtatcccaggaggcccttatccacatccatcagctcataggagagtcttgcatattgagacacacacctgggcactacagtcctgtgctctctctttttccccacaagcaggacctgatacaggagtactcagccaaggtacaaaat

SEQ ID NO: 611944 - DNA, 478 bp, Homo sapiens
aatcgtgtgatgacacataagcctcatagatagttatgaagagaaggctcttttggccgagcatggtggctcatgcttgtaatcccagcattatgggaggccgaggcaggtatatcacttgaggccaggagttcgagaccagcttggccaaaatggagaaacccagtctctactaaaaatacaaaaaaaaattagctgggtgtggtggtggacacctgtaatctgagctactcaggaagctgaggcaggagaattacgtgaacctgggaggcagaggttgcagtgagctgagatggcgccactgcactccagccggggtgacaaagtgagatgccgtcttaagaaaaaaaaaagaattctcggtcttggtctcttttagggggcgggggctgtaaaggcactagaaccataaatactatgtctgtgcagccctgtcaccgtatttaggcacttgagtggaagagcactgaaactaggt

SEQ ID NO: 611945 - DNA, 188 bp, Homo sapiens
agttatcaaattatcctccaaaaattttgggcctttatctgtggggaaccaagtgacgctgctcttcagcatagacactacctttatcccatcatttagtacaaactaggtttggttcacttcttgggtgtcttattactgttcttcatctgagaatttgttgagcttaatgttcgagctatagtaag

SEQ ID NO: 611946 - DNA, 429 bp, Homo sapiens
ctggcccgcctgtgtagcatgctatcaccaagcactcgcccaagaatgcctgtcattgtcttagtcgccggtctcggtatgaaagaccggcgtcactgccattgacatcctcaccacctgtgcagcagagcatccaagcggcagaggttctggcacatgcaccgagtaaggatctgattgccgtacctggatgaagctaagtgacagcacgctcaaggaaacgctgctaaatggggtgggctacctgcatgaggggctcagccccatggagcgacgcctggtggagcagctcttcagctcaggggctatccaggtggtggtggcttctcggagtctctgctggggcatgaacgtggctgcccacctggtaatcatcatggatacccagtactacaatggcaagatccacgcctatgtggattaccccat

SEQ ID NO: 611947 - DNA, 289 bp, Homo sapiens
  misc_feature (32)..(32): n is a, c, g, or t
  misc_feature (87)..(87): n is a, c, g, or t
  misc_feature (89)..(89): n is a, c, g, or t
  misc_feature (113)..(113): n is a, c, g, or t
  misc_feature (157)..(157): n is a, c, g, or t
  misc_feature (182)..(182): n is a, c, g, or t
tggtatgaggtgaaatagtgtatagtttgttnggagaatttacttatgtttataaagagaatgttgatggtgtggtgtagaagttgntntgtatccatctaggtgtgtagagntgccagcagggagctcacagaaggggagggagcaccaggccagntgagctgcacccacagtcccgagantgggatcccccaccccaacagtgattttggaaaaaaaaatgaaagttctgttcgtttatccattgcgatctggggagccccatctcgatatttccaatcctggctac

SEQ ID NO: 611948 - DNA, 133 bp, Homo sapiens
gaaagcaaagatatcccaagttattaatgaatcagacattttttactgtggatatttctccatcctaaaaaaagtggcaaccaaggaaactatatagatgcaacttactagagtgatgatgtgaaagaaatgg

SEQ ID NO: 611949 - DNA, 297 bp, Homo sapiens
ggggcccccctggggggggaaaaattgggggttttttttggggggggggattcccagcctccggggccccccaaatcccaggggggggcttgggaagaatcatgggggggcctttaaaactttttgttttggccgggaaaggggccccccattaatccccagggaaattttttttaaacaaaggggtttttttttttcggggtttaaaaaaccccgggggtccccccgggggggaaagggggttttgacccgcaaggggcaaaccctgaaaaaaaaagggttttttttcccccccca

SEQ ID NO: 611950 - DNA, 347 bp, Homo sapiens
  misc_feature (9)..(9): n is a, c, g, or t
  misc_feature (28)..(28): n is a, c, g, or t
  misc_feature (220)..(220): n is a, c, g, or t
  misc_feature (241)..(241): n is a, c, g, or t
aggctcgtnggttttaaaaacataattnccttgctacccactaagagtcccagttctctccacgtaccaaggagtcactgctgctgattcacgtgtggccatcagagcagtggaactaggcctcatctgtgccacaggagcacagcctggaagagatacatggcctgaaaatggtaatgggagcaccaagatctccaggatgtccctgagccacgcactngcgaggtacctgaaaagagtnatctccaattatacgatgacaccgtgagcactgtatggttcacgactctcagcactttacagttcacgacttttcagccttgcagggagttttccacccttgctct

SEQ ID NO: 611951 - DNA, 694 bp, Homo sapiens
  misc_feature (112)..(112): n is a, c, g, or t
accctagacctaggcatcttaatctctgggaaggggtacacaatcaaatgtaagaaggtttctttagtatttttaaggcctgaacagtttagacactgctgtgtaagagtanaatgatcaggtgcctagtatcagcatagcgatccaactttatattatcactaggaaaataaagggttggagcctctgtgtaactttgttgaaacatctgctcctgttattagatctgtgaaacagattgaacattcggttattatcaccttaagagtgcaacacctatagattttgaaaatgtattcatttttctgtaggcatagttaaaaagattttgtaaatgttataaatcagtttcttgataagcggttttcttagataacttttgttatactgacatgattcactgattttctaaatataaatggttcagctgttagttatttttaaactaatgacctgtgttatacttcatatttgtaatgggcttgtatgatgtattaggtttttttgaatcccgtgtccttcaagtgctttctatctttgagaggaagaaattgaccacctggactatggagctgtgcgtaacagctttgagagtgtatttaaagattgagtctatacgcctttaagtcagtgaattggaaacttattacatgtatttaatgattttcctgaaatataataaattgtttccttt

SEQ ID NO: 611952 - DNA, 129 bp, Homo sapiens
ggcgcaggatagtatatcgtgagaggcaggcgcaggtatatctgggtacggtgtgcaaacgtacgctcgacacccagaggggatgacagtcctgaggcctgtcgggctagtcgggggggtaccgagctc

SEQ ID NO: 611953 - DNA, 402 bp, Homo sapiens
  misc_feature (4)..(4): n is a, c, g, or t
  misc_feature (71)..(71): n is a, c, g, or t
  misc_feature (134)..(134): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (151)..(151): n is a, c, g, or t
  misc_feature (154)..(154): n is a, c, g, or t
  misc_feature (160)..(160): n is a, c, g, or t
  misc_feature (280)..(280): n is a, c, g, or t
  misc_feature (303)..(303): n is a, c, g, or t
  misc_feature (316)..(317): n is a, c, g, or t
  misc_feature (322)..(322): n is a, c, g, or t
  misc_feature (333)..(334): n is a, c, g, or t
  misc_feature (338)..(338): n is a, c, g, or t
  misc_feature (378)..(379): n is a, c, g, or t
  misc_feature (393)..(393): n is a, c, g, or t
agcnaagtgctctatacctttatacaataccaatgtgcttgagtctcccgttaagaggctgaaaactgggntggcatatgcaagactgggtgcgagattcaatggaatgtcaaatgaaacttagaatttattantgtttttncntantttntantctttnagcaatggccccataaatatagactacaactttacatatgctaagcaatagatacttgcctttccccaccaaaatacttgggttaaaaaaaaattgacagcatttataccaccttcttcncttccactcttcttcctttttanaccattgctagtnnttttngaacatttgannttcngttttttccgggcagcttctctaccatcaccatcttgttnntgagagcttttttnaaaaggtgc

SEQ ID NO: 611954 - DNA, 668 bp, Homo sapiens
tcggaggaagagggcggcgactttgttggtgactgagcggagcccggtgacaggatggctgggcacagattggtgttggtattaggagatctgcacattccacaccagagcaccagtttgccagctaaattcaaaaaactcctgctgccaggattcagcacattctctgcacaggagacctttgcaccaaagagagctatgactatctcaagactctgcctgttgatgctcatattgcgagaggagactttcatgataatctgaattatccagatcagaaagttgcgactgttggacagttccttggcctgatccatgtacatcaagatattccatgagcagatatgctcagcttagccctgctgcagtggcattttgatgggtgcattctaatctaggaacacacacacatagttgaagcatttagacatcacaatccattctacactaatccaggttctgccacttgcgcatataatgcccttcacaccaacattattccaatatatccgttaatggacaaccagggctctacagtggtcacttatgcgattcaacctcctgcacttgacgcgacaagatgaccgctccggttctcacggacctttaaccccatgccatagttcctccactcccggctcttcttgcactcgccccgtggccccgcc

SEQ ID NO: 611955 - DNA, 429 bp, Homo sapiens
tcgctgaccagcgcgtcttcggtaatttccactgaaactgcccacgggcctggccaagaacttccaccaggcggtcgccataggcggcttcctttatgtggtgctggaaatattgatggtcatcggcagttcaaaacccaccttctgccatttctgatactggcgcacggcctgggatgccacccacacatccacgtccggcatcagcctggcgtgcgccagccattgcaggaactcccacggcgaatgcaccgtgccctggctgtcccgggcgcgcatcagcgcctcgcacccggtgcataaaccggtacgggtggagacctggggttgaaactcaagatagaactcgtaatcgctgatctgctggatgcggttcaactcagcggcctggcgggccaatgtctggtgggtggcgactcaggtggtgtg

SEQ ID NO: 611956 - DNA, 225 bp, Homo sapiens
caagagggtcttgcttcatgcaggctggagtgagtgtgtcctactcactgcagcctccttgaactccgaggctcagatgattctcctgcctcagcctcctgaggagctgggacttcaggggtacacaccatgcccagctgtttttttttttttttttttttttttttttttttttttttttttgggaaaagtgttgggggaaaaagggggggggaaaaggggggc

SEQ ID NO: 611957 - DNA, 245 bp, Homo sapiens
gagctcggtacccatccttccctcttttacgttgtggatgttgtaaacacacacacactcccccccccccccaaacttattttttttttgttgagaaaggagacactctcttttaggcttgagtgcggagggctgagcattgctcactgcaaactcaaactcctgggctcgggcgaaattttcaactcaacctcccccatggatggggttatatgcatgcgtctccatacccggctgttttttat

SEQ ID NO: 611958 - DNA, 717 bp, Homo sapiens
  misc_feature (598)..(598): n is a, c, g, or t
  misc_feature (679)..(679): n is a, c, g, or t
  misc_feature (683)..(683): n is a, c, g, or t
  misc_feature (717)..(717): n is a, c, g, or t
ccgggctgcaggaattggcacgagtcagcactggtacggcaaagctgtgtctcttctgtcactgccacattgaaaggagggcagtcttcagaggccatcagatcagcattgggttcaggtatgagatccacacgaaggtgcatgggctttggggccagatgtctctgaattaatcactggctctaccttcattagctgtgtttttagacaaatctaccagcctttccctcctcagaaagaaacgggggtgtcaaacacaatgttcagggctactatgaagaacacagcatatgcaacagtctggctcagagtaggccactgataagttgtagcatttttattagattataaattatctcttgcttctatccacccttctgcatctcatgcctggaccactgcagaatcacctgccaagtctacctgcccatagtcttggccttcccattcatcctgcaatgcagccaaagaaatgttgtccaaagcccagacacagtcatgccacttttttgcttaaatccccataatagttccaaagggccataggattcactgtgcaagagaatatgaagagatgggcaccaccagagctgagaanacctagtcttttaaatactttgcaaggacatgccctatgggctacgccaaacttgccacaatcatatcttcttacatagantctntgattcccatccattgagcacttattccagggcn

SEQ ID NO: 611959 - DNA, 345 bp, Homo sapiens
  misc_feature (9)..(9): n is a, c, g, or t
ttgattctnaggatccgtgtagatttatcgggcacagtaggaggcgagcgcctaaaggctgaccgttttgctgtgctggggtctatggagtgagctggagagacaggcgttggatcagatacggagcctggagtagctggctgcggagcttggagaatacactgtcaagattgccctcctggaataggcgtggtggcgcagggaggatgaagttgagagagtggcagtacagggacctgaagaagcccaggcatgacatggtgagagatcaccggggtactgcccctggtgatgacagcatccctcgtccccgccaccccgctgcttaacatcggcggtaccgag

SEQ ID NO: 611960 - DNA, 734 bp, Homo sapiens
  misc_feature (521)..(521): n is a, c, g, or t
gcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtaccaagctctcggactctaacaaggagaacgcgctgcacagctacagcacccagaagggccccctgaaggcaggggagcatgcgggcgggctctgaggtcgatcagccggggtggccctcggaaggcggacgggcagcgtcaggcctggagctacgtggagcgtctcgccgctgacccagagctgtccccgcagtgggcccgggaccccagcccggcactccgtgaacggctggacaagcaggaggagcttggagcgggagctggaccaggcgctcctgaggagctggtagcaacgtggtttgaggccatcatgacaagggcaggancccccaagagggtgccttgactggttgaaggggggccgttgccggggccttggggtgccccccctgactgaggaccagcaaaaccggcttagtgaggagatcgagaagaagtggcaggagctggagaagctgcccctgcgggagaataagcgggtgccctcactgccctgtcaaccaaagccgggagacggccgagggcccccaagtgaggca

SEQ ID NO: 611961 - DNA, 312 bp, Homo sapiens
  misc_feature (104)..(104): n is a, c, g, or t
ttaaggatctcgtgaggtacaaagcagacagtctggcaaaagtagatgaatcctaagaactgatcagaaaataaactagcaacgttaggaattaaaaagtgggngcaggtgcagtagcttatgcctgtaatcttaggatttgggagggcgagcgcgctgatcatctgaggttgggagtttgacaccaacctgaccaatatggagaaaccccatctcaaccgaaaatacaaaattagctgggtatggtggcgcatgcctgtaatcccagctacttgggaggctgaggcaggagaatggcatgaacctggcagg

SEQ ID NO: 611962 - DNA, 132 bp, Homo sapiens
ttgttctaactgaagttctttttaatgagaggattagagaccagattaaggaattacaggcgccattttcctacgatttggtcacaccaccaaaaaaggcccaccggttaccttcttcattggtttgggagt

SEQ ID NO: 611963 - DNA, 270 bp, Homo sapiens
  misc_feature (117)..(117): n is a, c, g, or t
  misc_feature (155)..(156): n is a, c, g, or t
  misc_feature (162)..(162): n is a, c, g, or t
  misc_feature (164)..(164): n is a, c, g, or t
  misc_feature (167)..(167): n is a, c, g, or t
  misc_feature (257)..(257): n is a, c, g, or t
tcgcagaaggaggaacggggactttccatcccctgaaccaaggcatgttaacacttggctccagcatgttgtcatcattcaaccagaaatcgcacaaatgctactgtgccggggtgnagccaattttcttaagtaagtgctgacttccttaacanntatctntnttntggctgtagggtggctcagtggaatccattttgttaacaccgacaattagttgtttcacacccagtggtaagccagaagggcatgctctngggtctgcccatt

SEQ ID NO: 611964 - DNA, 164 bp, Homo sapiens
ccactttgtcaacagacataatcacttattgctttttttggtttttgtttgtctgagacagacgtctcactctgcttaaccacggctggagtgcagtggctcagtcatggctcactgcaacctcaaactcctgggctcaagtgtttgacaaacggtgcatgtgg

SEQ ID NO: 611965 - DNA, 663 bp, Homo sapiens
  misc_feature (45)..(45): n is a, c, g, or t
  misc_feature (47)..(47): n is a, c, g, or t
  misc_feature (54)..(55): n is a, c, g, or t
  misc_feature (59)..(59): n is a, c, g, or t
  misc_feature (61)..(63): n is a, c, g, or t
  misc_feature (65)..(65): n is a, c, g, or t
  misc_feature (93)..(93): n is a, c, g, or t
  misc_feature (177)..(177): n is a, c, g, or t
  misc_feature (258)..(258): n is a, c, g, or t
  misc_feature (328)..(328): n is a, c, g, or t
tggtggtatcgcgcgtaacaatgcttacttcagagaagctcgaanantgtattnnaaancnnnancgggtgttgaccgagtggctggaagcantgttagtgtattaggcttaaagttaatcttcttcaaatgataaatctttaattaaaatatctaaaaaatataaagccaactctntgtagtctggctttatttttgcgcaaaatatatacaaattgaaatatcttttttagcacttaaatatttaaaaagtggtancttaattaataaaacaaaaagaaatgaggatcacgttatgaaaaaactaatggtgagcatttcggttgtntttttcatcttaactacaggatgtgagatgagaacaacaagtaaacagcaaccttcaaatgaacgggcgatgagtattgctggttctccggtttatgaaaaagactacaaaattcccgatttacaagccaataatcatgagcaatctaattattaattgatggatagaatgtcccacatatagcactttaaatgtactcagtgcagataagcctgcttattataaaaagtaggttagaaataaaaaagctcccaatgtagggagcttattttatgaatctagattaagaaactttatcgcaggttttgcaccgtaatctggtgaaatactgaaaa

SEQ ID NO: 611966 - DNA, 255 bp, Homo sapiens
  misc_feature (2)..(2): n is a, c, g, or t
  misc_feature (94)..(94): n is a, c, g, or t
  misc_feature (133)..(133): n is a, c, g, or t
  misc_feature (156)..(156): n is a, c, g, or t
  misc_feature (168)..(168): n is a, c, g, or t
  misc_feature (183)..(183): n is a, c, g, or t
  misc_feature (208)..(208): n is a, c, g, or t
  misc_feature (240)..(240): n is a, c, g, or t
tngagttgtctgtaataatcttgaaaggcccaagggcctgtccccatcctgacttaaaggcatctgcttccctgtttcatatcacatgtacagnagcaaacctgttctcatggcatgtaacatccctgtgcangagagcgcttgtatatgcatttngctattttcttnaattcattttaattntacaggttggaattctaattttttnaaattttattggaactcacattttaaaaaganataaaatttaaaata

SEQ ID NO: 611967 - DNA, 222 bp, Homo sapiens
aactggtgcaacagcagaatgggaatgcttaccttgaaaactaatatcccaaggctacagatggtcagcactgtttgcttaaggtgcggtgtggggtatagattccagagcatagtaaatttgccagaaaccttagcaaagagaagttaacactagtgtggggggtatggagctgctgaggctggcataagaactgcctcattcatgttattttcacctgaa

SEQ ID NO: 611968 - DNA, 247 bp, Homo sapiens
ggaagacgactccatgcagcaactactgaagaaaggaccagactttaacggggagttttgattggcccaccttgcttggactcgtgaatctggagaagagctgtagaatggatagtattgtctgtatttggagactttaatttctgtgtgagaccaaaggaggagagatttttttttttcaaaattaaatttgttgtggtcataatcttatgaacccctcttgtgagtttttttgcaacccacctag

SEQ ID NO: 611969 - DNA, 267 bp, Homo sapiens
aacaggcaaacagctcatatacatggaacatacatataacccaagaaacactccccagtgtacagatcaacacacacgcatgcacaagccaagccatatactacgcacatacgtgagcacacaaatgaacgtctagtcactcattttctcagctgcacccagaacagggctgggctcatctagggcaaggagatctccgtggttccaactggaccaggccatgatatacccactctactgttgcacccccattacctggacctctag

SEQ ID NO: 611970 - DNA, 254 bp, Homo sapiens
tgtatgccggacaagcagggtcgctgatgcctgaaggtccaggtgactatcatgcacaggctgggcagcccgggcaccagagcccgagcagccggaggcgaccagcactacctgccaactacgttgccgaccagcgccacctccctggcctcggacagcaccttcgacagcggccaagggctcctaccgtgtactcaagactcgcagaagcaagccaagcagagctggtgatgctttttttcccctttgccgga

SEQ ID NO: 611971 - DNA, 357 bp, Homo sapiens
  misc_feature (20)..(20): n is a, c, g, or t
  misc_feature (159)..(159): n is a, c, g, or t
  misc_feature (325)..(325): n is a, c, g, or t
tgagatggagtctcgatctntcacccaggctggagtgcagtggcgtggtctcagctcactgcaacctccgcctcctgggttcaagcaattcccctgcctcagcctcccgagtagctgggattacaggtgcctgccaccacgccaggctaattttttgtntttttagtagagatgggtttcaccatgttggctaggctggtcttgaacttctgaccttgtgatctgcccgcctcggcctcccaaagtgttgggattgcaggcgtgacagccgcgctggcaaatacgtactacattttaacaccagttttattattacacacaccgntaaaaaggcctggggtttacaatcacataatc

SEQ ID NO: 611972 - DNA, 272 bp, Homo sapiens
gtaaagaacaggttattaagacagccctatgggaattttcaatagatatagagtcacgactgtctaagtgtgttgaaggaatagaatatcgatgcgagccaatgagagtattgaaaggagatctcaggatgatatatctcttattttctctaaagacagaacagcagtgatgatacaagtgagaatatatgattttctcttagttaaaagttcgagagatcattaagttatctaaaacaggctggtatggtggtgatatcagtatagtgaca

SEQ ID NO: 611973 - DNA, 145 bp, Homo sapiens
tgctaggattacaggcgtaagccaccacacccagccttatttttttttaaggaacagtttatatggatttatatttgtttcaataagccacttattcttgtttatttaaacagcacacttgaattcactatgtggtactcctgaa

SEQ ID NO: 611974 - DNA, 469 bp, Homo sapiens
ctatggtctagtcgccaaggctggagtgcagtggtgtgatcacagactcactgctgccttacctcctgggctccagtgatcctcccacctcagactctagtggctaggaccacaggcatgtgccatcacgcctggctaattaacaaacaattttttttgtacgagatggggtctcactatgttgcccagactgctcttgaacaatcttcccacctcggcctcccaaaatgctgcgattacaggtgtaagccactgcgcccggtctgccagtgtttaactaatactaagacaagggttatgggtctgggaggaagagcccagtggtaaagcgccctgtcacatctgcccgtgtgacctctcggtgattgtgccagccttgacctctgggctgagacagtgggtcgggctctccactgtggagacgccttgcctagctcccaacaatgttctgtactccacttagagggtt

SEQ ID NO: 611975 - DNA, 791 bp, Homo sapiens
cctgccgcccatgctcccagcctgatggctttctcaacctgctgtcaataaaatggcctgcccctgaccctgcccccgctgcccctgcagccctgcctggacacccctgtgtgctgcatgctgatgctgggctgcatgactgtgtgcctgatgttgctgtggctgcctgtggctgctgcatgttgacctgatggtgacctgatgtgctccccatgagctgcactgtgtggcctgggctggtcctgcaagccctggcttgagatgctgctgccatggtgtgcagtgctgtgtgcttgcaaggtgtgctctgccttgtctgctgttctgactacaatgacctgagaagtattgtcatctgccaatgaacaatgaatgtgttgggcctgcttgtacctggcttgcttgcatggcctccatcctggctgtaccttggtcgtatgggttgttccttgataaagaaggtgttaccaatgactgtctgacacctcccttgcagatgtgctgtcatcaccaaatgtcaatttgtgcgtggccttcaccaacacctcggatcttgggcagcggatctgggattgtcgccgactacgtcattccagcccaggagagaacgtcttttttgttggtcaccaacctgattgtgaccccaaccagctggcagaactgtctttgtgctgagaatgaaggcattcctgatggcgcgtgctccaatgacagcgactgccacgctggggaagcggtacagctgaaaacggagtggatgaccggcgctgctgcggagagaaactttggct

SEQ ID NO: 611976 - DNA, 469 bp, Homo sapiens
tcttggtggagaacttgatagaggagagaccagacagaaacctttctttcttagcaggccttccggcactcagaacccatggaaattaggaagagttgttccgacaagaaaatgcagaggattcagttcttatgaatctgaatttctgattacgcccaatttttaaaacttggaattagttgaccttttacagcgttaacctctatttcttaatttttatcttgtgacataaaagaaaatctctaacgaattgtgagaaaaacaagcctgtgtccctaaaaaatctgaaatgtaaaaagacatgcggtattattagttgcaagctgggctaacaaacattgaaaggtcccggtttattatgcacatcgatttgtaattattatattgaaatgtcaccctaaacaagatgtattcataacttttccagacatatccttttgtataacccttttccttcaccaaaaaaaaa

SEQ ID NO: 611977 - DNA, 303 bp, Homo sapiens
  misc_feature (220)..(220): n is a, c, g, or t
ctgatcttgaactcctggcctcaagtgattctcctgcctcagactcccgaagtgctgggagtgaaggctttgcatctggcctcagaggcttttctttctgtgaaattcagaactcccagaacagtgatgtcccttggagactgttttcatccatcgtcttgcctactctttggtcctgtttatttgcaactcatgttcttcaacgctgggcatttttttnatttattgctttgatttcttcctatttgctttctctctctctctctagaattctactcttggacttttctggattggcactca

SEQ ID NO: 611978 - DNA, 1175 bp, Homo sapiens
ccactacgtgttcggccatgaaggaccgcacccaggtgctgcgcacgcgaaggaacagtgacgataaggaggaggtggtgcacgtcgaccgcgaccacttcatggatgagttcttcgagcaggaggaggagatccggggctgcattgagaagctgtcggaggacgtggagcaggtgaagaagcagcacagcgccatcttggccgcccccaaccccgatgagaggacgaagcaggagctggaggacctgacggccgacatcaagaagacggccaacaaagtgcgctccaagttgaaagccatagagcagagcattgagcaggaggagggctcaaccgctcctcggccgatcttgcgcatccgcaaaacgcagcattccaccctatcccgaaagttcgtggaggtgatgacggaatacaacgccacgcagtccaaataccgcgaccgctgcaaggaccgcatccagcggcagctcgagatcaccggccgcaccaccacgaatgaagagctggaggacatgttggagagcgggaagttgcccatcttcaccgatgatatcaaaatggactcgcagatgaccaagcaggccctgaacgaaatcgagacgcggcataacgagatcattaagctggaaacgagcatccgagagctgcacgacatgttcgtggacatggccatgcttgtggagagccagggggagatgatcgaccgcatcgagtacaacgtggagcactcggtggattacgtggaacgcgccgtatccgacaccaagaaagccgttaagtaccaaagcaaagccaggaggaagaagattatcatcatcatttgctgcgtggtgctgggggtggttttggcctcctccattgggtgcactttgggcctataggggtgtccgtccccctcccccattaatgcactaaatttaatcgacgggccccccattatttcactaattaaatgaccgtttccccccaatatcccccattttgcgctaatttatgacggacccctcccaagaccccccattttgccctaatttataaaaaaacccccccccccccagccccatagccgccccccagctctgtaacccccccccccccggtgtggtcctgtgctgtatttgctacgaaacccattggcacaaaaaatttttttttaatttaaaaacgaattc

SEQ ID NO: 611979 - DNA, 264 bp, Homo sapiens
tcgatgtgatgtatacaatctccttagatgttcctaggtgctgatgcagtggctcatgcccatcattccagcacttggggtgggccgaggtgggcaaatcacttgaggtcagaagcccgagacttgcctagccaacacggcaaaaccccgtctctaccaaaaatacaaaaattagctgggtgtggtggtgggcgcctgtaattccagctactcaggaggctgaggcaggagaatcgcttgaaccctgtttgtggaggtagcact

SEQ ID NO: 611980 - DNA, 634 bp, Homo sapiens
  misc_feature (79)..(79): n is a, c, g, or t
  misc_feature (105)..(105): n is a, c, g, or t
  misc_feature (109)..(109): n is a, c, g, or t
  misc_feature (130)..(130): n is a, c, g, or t
  misc_feature (176)..(176): n is a, c, g, or t
  misc_feature (189)..(189): n is a, c, g, or t
  misc_feature (282)..(282): n is a, c, g, or t
  misc_feature (303)..(303): n is a, c, g, or t
  misc_feature (321)..(321): n is a, c, g, or t
  misc_feature (323)..(323): n is a, c, g, or t
  misc_feature (329)..(329): n is a, c, g, or t
  misc_feature (333)..(333): n is a, c, g, or t
  misc_feature (380)..(380): n is a, c, g, or t
  misc_feature (394)..(394): n is a, c, g, or t
  misc_feature (424)..(425): n is a, c, g, or t
  misc_feature (432)..(432): n is a, c, g, or t
  misc_feature (448)..(448): n is a, c, g, or t
  misc_feature (450)..(450): n is a, c, g, or t
  misc_feature (478)..(478): n is a, c, g, or t
  misc_feature (493)..(493): n is a, c, g, or t
  misc_feature (498)..(498): n is a, c, g, or t
tgcaggtttgctttaaaatccagtagttcttaatgttaccaaataaccatataactcccaaatgcagcaaaggtgaacnttcttcatagtgcactttcacctcantganattgaagctgctccttttggntatttttccacttcaatgtgaagcagattgctgggatttcattagnggtttcattacgnggctttttaaaagaaaaaatagttttgatttcttccacagttcacagttctcagacgagactttttttttttgtaaattatacagttcagggntgttttgaaaaaccaaatgcnctttagtagatgaaatcncncaatgnaacngtaataaataagcatctacatccttagaagataaaacaaaaacattncattagacagtacngtaaatacaaacataaacaatccatttggnntgggggnggcgtaattggccttngntcccgttggggaccgttgggggggaaangacgggcctggttcngggcntttaccggcattgggccggcacggggccgggcacatggtatgtgctcaatatatatttgctaagtgctaaatgaatgtgttggttcctatgctcaaacaactctgctttcatagctaacattcacagaaattctat

SEQ ID NO: 611981 - DNA, 406 bp, Homo sapiens
taatgcaaggatgtttcaacatcataaaacacataaatgtaatccaacattatcagaatgaaagagaaaaacaattctcaatagacacacacacacaaatacactgggataaaattaaatattttagattttttaaagtcttagtaaattatgaatagaagggaatttccttatcttatttctagactcactatctagtatttttacctcaacccaactaaatcagggtataatcgtcaccatttcactgccaaatttattgggcaattattattttagtctcttagcagcatttgacatggaaaatctctcccttctttctgtaatactttcttccctggggttttgtgactctccatgcccttggtttttcctcctagatgaatagtcatccattctcattctc

SEQ ID NO: 611982 - DNA, 258 bp, Homo sapiens
tttttatttttcccaagggaaattaaaatttattttttccccctcccccccaaattaaaaggttcaaaaaataaaaaaggccccctgggcccggttttttttttattccgggccccccctaaaaaccggggggaactttttgggggggggtccccgggccgggaaaattttttcccaaaaagggaaaaaagttttttttttttttttaagggaatttcccccccccccaaaaaaaccttttttaaaggacccccccca

SEQ ID NO: 611983 - DNA, 213 bp, Homo sapiens
aaggaacacacatgtaattaccacgtgacccatgtattccacgcgtacgtatacacccaagaataatatacactccacattaaaaacgtgaacgtgaaatgttcatagtagagagttttctataaaagccacacaataaaaaccaccctagtgctgagcacggtggcgtcacgtctgtagtcctagcacctcgggaggccgaggcgggtggat

SEQ ID NO: 611984 - DNA, 293 bp, Homo sapiens
  misc_feature (267)..(267): n is a, c, g, or t
  misc_feature (277)..(277): n is a, c, g, or t
ggtcgctccaggaattgggtactaatgcttggaatctgtgcctgttatctccatgcaaagactttggaggtggggctaaagtttttggaaatgggattttcctggattatcggggtgggctttaggtgtaccccaggtaaccctttaagggaaagttggggggtgggccctgtggcccacgcctgtaatcccggccctttggggggctggggcgggtgggttgcttgggctcgggggtttgggaccgggcggggcaaattggtgggncccccccccnccccccccttttttta

SEQ ID NO: 611985 - DNA, 411 bp, Homo sapiens
ctgcctcaacctcccaaagtgctgaggttacaggcataagccacagcaccctgcctaaaatctccttaaaaacaaaaattgaaaataactttggatcatccaaagtaggtgagtagccatttacctatcctttcttaaacacattatctatctcttctccctcctttctctctgcaggttctagttgtactttaaagtctctgatgcttaacataaaaaattctgggattcaaacagatttgctagccactatgaaacagccccaccttgtgtgcctgaacaaagagaataacaatcaacaatgttcctgggtgtcctcgaatagaagaggtatttcaaattggagagaaaagcagatctagtcttctgaccttcttctaaaacaatcaccgtcattcaagtcaacccaac

SEQ ID NO: 611986 - DNA, 1038 bp, Homo sapiens
cacccaatcacaaacacacagcccgggcgggcacaccgagctgttcttgaacaaatcccagcatggcagttctgcaggtcattacactggcatctcatcaaccaggcagtccaagcgcagctcgcatcatcaaacttacgccccgacccggaggaaaaaagagaaaaaacaaaaaaaaaaaaaaaaaaaaaaaagaaaaaaaaacgaaagaagaaaaagaacaagaaaaaaaaagagaaaagaaaaaaaaaaagagagaaggaggagagacgagacacacgaggaagagagagagacaagaagagaggaggaggagaagagaggaaagaagaacaaacaagacagaagaagcagaggagaagcgagagacaaagagagacaggagcacgggagacgggaggaagcgaaggagagagagagaagaggaagcggagcgggggggagaggaggaggagggaaggaggagggaggaagggcggcgcggcaggaaccgggaggggggggagaggagcggaggaggagggcggaggcgaggggggagagagaaggaggagaagaagagagaaagagaagggacagggaagagcaagggaggaaggaaaagagaatagagacaagaagaggataagagaaagagagagagacaggagagaaaggaaggaaaaaaaagagagaggagcagaggagagagagaaaggaggaacacaagagagaaaggaaggaacagaccagaggaaaggacaacgaagcaacgagaccagcagataaagacagcaaagaacaacgaacaagcaacagagacgacacagcgggcgcgagcgcgccagaaaaaggaacgagagcacgagagacgagaagaaagacaaaggggagacagacagaaagaggaaaaagaaaacgacagacaagcggggcaggaagagaggacggagaagagcgacagaaaggcagcgaggaaagacaagagagaacgaaacagagaaagaagccggacggaccagaaggcaacgcaaaggaagcacgacgagccagcaaacc

SEQ ID NO: 611987 - DNA, 1203 bp, Homo sapiens
gcagcgggctctcgtgtactgccagcaatgaacgctgaaggctcacgcgtggacggagtcgatccacttcggcctcatcaacctgagggtagccagtacctagacggccgagagcgtccgggttcagagggtgagacgcgtccgcgcaagcacgccttgaagaatgaaatcacgatctgtgatggctgggagcaggccccctgtaccgcgggcggtgccgagctgtcggtgcgtgtgcctcgtctcgagcacaccatgaggtacagcttacacatgtgccggtcggcacaaaggagtactggcgaaccgatgaacgcatgacggacgccgtcaggaggggtggctcccagggtggccgcgaatgtgtccggttatatccatcgagtcgatgggcgccaccgaacagaccgcgatcagcattggatccgtatcggaaggattcccagtagaggcgcaagcgcaggcctgcctagcggtatcgtgtcggtggcacaccgaagggtagcgcggcccttggttgctcgcttgtccggtcggcaccgatccggggtgctaccaccgcccagtcgcgaaggaaggggatagggaacacgtttcgactagccactgggtgcgatagctaacccacctacaggggctacaaagcattgctagcggagacgcttcactcccactgtttagactgtggttgacgtaatcagagtcggacaacctttagaatgggcggacagacggggcaccaggggtcgtaacttgaacgaattctgtcccgataggaggactcagcggtaagcggtaagcccctttggggggggcggtccagacatacggacttcaaattacgaactcataccggtgggttctcccggatgtgcaacccgatgggcggctctaacaaaagaccgttgtgcagaacatctgacccggaagccttaccaggttttttcccttgacttgccagcggacagtgggcggcgttgcgtgtgggactgcagccctctggggatcgaccttggcccattgggtgactatcgagcagcatgggagggttgccctgcctccctgtggccaaggggttggaagcctttcccgagttgaccctgtgggaagggggcccgttttaccgtgggcgacctgttcgggggtgccccccagccggggaacggcttccaaagggccgtgtggccaaatgggccacccaaa

SEQ ID NO: 611988 - DNA, 1071 bp, Homo sapiens
  misc_feature (280)..(280): n is a, c, g, or t
  misc_feature (1068)..(1068): n is a, c, g, or t
  misc_feature (1071)..(1071): n is a, c, g, or t
gcacgtgacagcgtaggtgatgacagagcgagacactgtctcttaaaaaaaaaaaaaaaaaggtttcccagtttggaatttggtattggctagaagcatttttttggaaatggctatatagatgcctggtcatggtcacagtgggcccagtatcaccattttaaaaagctcactgggtagctggggcgggtttctattcctgagaaattccagaaaggcctcagaataaaattccgttagttataatccccaattttccttaccagagggatggtaggcnttagtcactcctggggaaggggccacgaggacaaattcagcagatgtcaacagaaaaaaaggcctttggctatgaaaaggtattcactacctttcatatctctggaatactggaaatggtttaattagatggccaccaataggggatccaagggagtggtggggacacgggttggcgctggatatattctttataacacggtttattaaaatgggctcaacgctggcattcagcttcacctcagctcttctggtcagccaggagcccggggtcctgggaaactggtgagcaagggttacttatttccatactggtgcatggtgtcagcccgattaaccccactgcttgaatgggccattaataagcacttattcttataaaaggggggatgtttggccttaaaatcttagtggctagggtgtatttaactttgggctggacatgctgcagacagaagcacggccgcgacagtgaggaaacattcccaacgtaaaataaccgaggggccacagaatggcatcacaagagcgggggcaacatcacaatatgcaaaatcgcgcacaaaacaacataaggaaagagagagaggaaaatgaaaagagaggactgagagcacaaggatacaccggtacaatagggagggataaaaaagaaataggcaaggaggaacaaaacaataagcgggggaacgacaacacagaggcggagcacgtgaagacacagactacacagacaatgcgacagcagctggagtcgcggcccacgtcgatttcacccgtacaagaggnggn

SEQ ID NO: 611989 - DNA, 283 bp, Homo sapiens
cagagatgatgccactgcactccagcctgggcgacagagcatgactccatctcaaaaaaaaaaaaaaaaaaggctgttgaattcgggcagcgcttttaaaatcccgggcccgggtgatttcgataactcgggggcacctgggttacggcctttcttaggcccgtgcaataaccgctcttcctcacatttagcattgggccaattgtctctaacttctccttacccaggttttacaggggccggtgtaaagagccttcacccatggggaaccatgtacaacctg

SEQ ID NO: 611990 - DNA, 827 bp, Homo sapiens
gtcacatggcaggacccgtctctacaaaaaaaaaaatacaaaaattagccaagtgtaggtaggtgtgtgccttagtcccagctactggggagagctgcagctgaaaggcattgaatagagcctgggcaacgctcaacggctgccgctgagctcatgactcactgctcacgggtactccaggccctggcacagacaaaacaccaacaatgtctacaaacaaactacacaatacacatgccacacttcatgtgagcaccactgccacgccacaaccctctcagcagctctagaacgcctcctagcgcgcactaggcgctcagcacaaccgtgccaaccttgcacactcgcccgcgggcacataacactctccacaagctacacactcgctaagagcaagacacaccaacaacacctgaggtaacacgcacatacgtacaactacacaatcaggcgcgacactaccgatataatcaccatcaatacagcttcacgcgaacaacctcagatacaccataagagcgcaccatcctctaatcacaccccactgggacccaactacctacaggagcagcagcgaagactaccacgcacaagaaacacataacaaccgtgagtctaaaccggcaggcacaactggcagcccagacggaacccttcccgaaggatacgaccttgacgcacgacgagactaaccaccataaaagcagcgacaacaggaccaattagctctaacaacaccccagcaaagttatcacactaaactcccactcgagcccacataggccactaccgcgccctactcacagccccacaccggcacgagggcc

SEQ ID NO: 611991 - DNA, 298 bp, Homo sapiens
agttaggcgtggtctgattgttcagtgggaagacataaacctccccaggaacaatgatggctatggggagacaaaaaggtctatgctgggcggcaagaaacttgccctttttaaacactatcatcctcccctaaaaatatggttcctagacttgaagatgaaggcaatgaccaacatttcccacttttaaacttctgacacgttaatagtaataccaagtatttgagcactgtatagtgaagcacagtggataggtattcctactcccatttcacccctgtgggcacacattatggag

SEQ ID NO: 611992 - DNA, 318 bp, Homo sapiens
  misc_feature (55)..(55): n is a, c, g, or t
  misc_feature (248)..(248): n is a, c, g, or t
  misc_feature (254)..(254): n is a, c, g, or t
  misc_feature (284)..(284): n is a, c, g, or t
ccttgtctctactaaaaatacaaaaattagccgggcatggtgtcacgtgtctgtnatcccagctactcgggaggctgaggcagaaaaattgcttgaacctgggaggcagaggttgcagacagctgagatcactccattgcactccagcctgggcaacaagagcaaaactttgtctacaagtcctcctacgctgacaggtcctcactcacctgaatcttttacgccagcagcgtctcttcactgacgtncttctncatgccggaaataggaccttcccttgccancgggcagtgctggctgcatgcagtcgttactttt

SEQ ID NO: 611993 - DNA, 232 bp, Homo sapiens
caggaggcagatctccgatgcttccgccagcaggagaatcctcccctgccccttggctcaaaggtggtggttctggctggtggctgttcagtgatgtgtgttgatcctctatcctggtgagcctccatgtgtctaccatgatccgggatggcacggagtgaaccagtgagctgtgcccatgctgcacctgatctggcagctcctggagcatgacacaggagcagtttggtga

SEQ ID NO: 611994 - DNA, 146 bp, Homo sapiens
cttataatgcacccgagcaattaatttagtcccttaaggagtggaataccaccaaacaaagaactaactggaaacagggagataacagccatagaggcaacacagtcacatcacctcattataaataatcaaccagccacaaataa

SEQ ID NO: 611995 - DNA, 436 bp, Homo sapiens
  misc_feature (284)..(284): n is a, c, g, or t
  misc_feature (354)..(354): n is a, c, g, or t
  misc_feature (404)..(404): n is a, c, g, or t
taagagacagggtctccccctttcacccaggctaccaggctggtgtgcagtggccgtgatcatagcttactgcggcctcaaactcctgagctcaagcaatcctaccacctcaacctcccaagtatctgagattacaggtatgcaccaccatgcctgcctaatttttaaaatttttttagagatggggtctcactgtgttgcccaaattggtctcaaactcctgggtctcaagtgatcctcccgcctcagcctcccaaaggcactggggattacagggcacgagncacggcacccagcctaaagcaatgttagggtttcaaggaaaaaccttaaggataggcccattagtttttnatgttttcctttattattattggcaattctggcaaaattttttgtatttnagccagtatttatgttcccggtttttattaaa

SEQ ID NO: 611996 - DNA, 110 bp, Homo sapiens
tagggctgtgggctgacctgtggtgagactggaaatctgccactgctgcacttctccaacctgcatgtcacaggtgtggtctggccctgctgaggcggtgcgttgctgat

SEQ ID NO: 611997 - DNA, 412 bp, Homo sapiens
tcatgcttgtaatctcagcactttaggaggccgaggcgggtggggcacctgaggtcaggagttcgagatcaccctgaccaacatggtgaaaacccgtctttactaaaaatacaattagccagatgtagtggcgcctgtaattccagctacttgggaggctgaggcaagagaatcgctagaacctgggaggaggtggttgcagtgacccgagatcgggccattgcactccagctttgggaacagagcgagacttcattttacccctcgtggagagaagtgtttatagcatgttgggcggcttggcccacggggctctagactagagcaagcttatggatgccgcccgaatatgagcgcatttgccacttagccctatagagagtcggattacaattcactggccgtaggtttc

SEQ ID NO: 611998 - DNA, 189 bp, Homo sapiens
gggttttttagccattttaccgggggggggggcccctttttttccttttcccccggttccccccccaggggaggggcaatgttttcccccccaaatcctttttgccgccccccggttccctttggtcaccccaggtttttttccgcttttggggcccgggtttccctttaaaaaaaaggggggttttta

SEQ ID NO: 611999 - DNA, 252 bp, Homo sapiens
tgagacagattgtgctgtgagctgtagtaccagctacaaggtgggaggattgcttaggctgggtgattgaggatgcaatgagctgtgattgtgccaccacactccagcctgggcaatacagcaagactgtctcaaaaaaaaaaaaaaaaacccaaaaaaattcaaaattgtattgattgatccccaatgtgccttttctaaaaaaagttggccaaattttttctctgggaatctgctgagcattgtcctctg

SEQ ID NO: 612000 - DNA, 269 bp, Homo sapiens
agaggatacaagcatagaggccacggactatgacagttgtgctactctgaagtctcgtacaacaaccagattgagacccttcttattcctgaaggtctctagaaagaacccagctcgcacatgccgctgacttagagactcagccacccagagtggagcagctggttactactggattgaccctaaccaaggatgcactagggatgctatcaaagctatactgtgatttctctactgggcgaatcctgtttccgtggcctctatgagtg

SEQ ID NO: 612001 - DNA, 145 bp, Homo sapiens
tttgtccttgtaactctatttttttgggtttactttaagttttttaacctgggtttttgcaaaggtttttgcttttaggatttttgtccgtttttttattattgccaaaaattaaaaaccaatggttggaaaattaaaaaaaaaa

SEQ ID NO: 612002 - DNA, 174 bp, Homo sapiens
ctagagtatccccacaccgcaacacccacatggattcataagctggcccggtggtgcagacgctgtaagtgtcagttccggaccgtggtatttttctcagccatgaccagtcgccgtattacccgcacagccattccccattcgcgacctggggagatctttggtccgcacgtt

SEQ ID NO: 612003 - DNA, 781 bp, Homo sapiens
gggcctcagccaggccccacagtttgggttaaaagtccagctgccatcttttctgtctataacgcatacaatggaaaaggctttgtcagatcgggtatccccagggctggggctgccagacatttttcctttaactcatgaaagacttgctgttattgggttccccattccaaaggttccggtccacgccccctttgtgacctcatacaaaggcttggctaatactgcaaagtttgggatgaacagtctacaaaaccccacagcccctgagaattccctcacctgccttctgcccttaggctccggtagattgcaaatgacctgctttctttctgttcccgggcggcatcggacccgtcggagagtaaatcccaagtaaggtacctgccgttggcagatttgagctttcttcttggacacctaatacccacacccagcctgcacatttcttaaaacctcattaaagggagtgtcctctgggccctgagggacacagtcaagggatgaattttttttataatcttagtgtgaaggtccacatatgatgcaaaataacaatggctgcatgaacgtgatcccaacttgttcccacaagggtcaggtggctaacttcataggatattctacctggctctgtctgccctcctacctagtggtgaacagagtgctggcaaatgtttaacaaccagatctccagaagcaaaaaacaaaacaaaggcctgatttgtagcatctgtcagtatctgcagtataagcactcccattgtgtccagaatttatc

SEQ ID NO: 612004 - DNA, 130 bp, Homo sapiens
cgcattacacatttatttgaaaaaagttcccccactgatgcctttgtaccattgttgtgaagcagaagtccatatatgtgtgggtctatttctagatactgttccattgatctgttatgtctgtcttgat

SEQ ID NO: 612005 - DNA, 808 bp, Homo sapiens
  misc_feature (808)..(808): n is a, c, g, or t
cagataaaattaattaaccacattatctctatattctattaatgaaacttaggaattgactctctctcatctttgccagaataataaggcattaccatgcttgaagtaactttagtggagggctacacattttcctgtttagtcttgctgccattagacaatccatatggaaaaatatttggtactgtcaagaggaagttgtcttcaagactgtgacattgtggccaccaatgggagtccactctcagctagaggaattccttaagtcatttgtgatgctggagatgatagcatgtatccatgctaaatctcacatttttttatcgacctatagggcgcacttgcctccaatatgaaacaggttattccttatacacctattttatcaaggtattctgtggattacctcatatgttatctttacatggtttaagggtatattctcctttcccacttctgttcaattttataataaaataaataaatagtcgattatgacgatctaatgccttactaatcagtacccttcttatatctatttttctccataccctaatatagtttactcacgtttgctcatcacttactataagagcacaccgcctcaatgctctttgttaacattcgtacctctctcccttttccatccatacaatgtactgatacacactgcaacttagtatttaacctgtcctcatgcctcgtcggccgtatgctcgtttagtatttccctttttgactcatccttcctgacatcttctttatactccccacatataatcatcagctccgcatctaaagatcaccn

SEQ ID NO: 612006 - DNA, 152 bp, Homo sapiens
atggaaccactctgtaatgactaattcgagggaatttagggggctatctcttaatggtttgataatttgggtttaacccatgacttaatttaacttagtgggtatactggtcccagtcccattactgatttttattccttctgtgataacat

SEQ ID NO: 612007 - DNA, 687 bp, Homo sapiens
ctacccaaagttatttgagtggaatagaccttgggattaattgacctcccaaggttacccacctgtcccagctgagaaagaggaagcacatccgggtgctgtctctctttgataaggaatagctacagggctcctggtgctgatggacttgggcatacaggtggactgctacatatgcctcggaggtgtgtggaggactccatcacggtgggcataggtgcggcaccaggggaagatcatgtaacgtcggggacgtccgcatcgtaacacagaagcatatccaggattggggaccattcgatctgatgatagagggcagtccctgcaatgacctctccatcgtaaaccctgctcccaagggtctctacgagggcactggccgtctcttctctgagttctaccgcctcctgcatgctgctcggcccaagtgagggagatgctcgccccttcttctggctctttgacaattttgtggccatgggcgttattgaccagagggacatctcacaatttctccgagttcaaccctgttatgattgttgccaaagaattgtcgctgcacacaggcccgctaattctagggtaccttcccggttttgacggccttgcatcactgtaatgatagctggactgaggatttttgggctggcggtaccaagtcagaagtgagacatatacagtcatacc

SEQ ID NO: 612008 - DNA, 184 bp, Homo sapiens
actgtccggcagttcctactgggataccagccccggggtaaacccaggatagaatatggcaacggctgactcccgagggattctggtaccgggcccaggtcttcccaaccgtgaatggactgtttagatggtttacggatcactaccaggatcctgtaccaggcatcacccctagtagtatttt

SEQ ID NO: 612009 - DNA, 959 bp, Homo sapiens
gcacaccttctacaatgagctgcgtgtggctcccgaggagcaccccgtgctgctgagcgaggtcccccctggaatgcccaagggccaatcgcgagaagatgaccgccagatcatgttagagaccttcaacagccccagctcatgtacgttgctatccaggctgtgctatctcctgctacgcctctggaccgttaccaccatggcatcgtgagtggactcccggttgactgggtcatccatcactgatgcccaatctacgagggggtatgcccatcccccatggccactccctgcgtcatgggagccatgcgactgtaccagagggaccttgaactgacttaccttcactgaagagtccttcacctgagcgcgtgatacagtgttcaccatgcacgggcgagcgggaaatgtcgtgcgtgacgggttaaggagaagctgtgctacggttctgtccttggtacttcgtagcaaggagatggccacggcttgcgttcgcatgctcctccgctgggagacagagctacgagctgcctgacggcacaggtcgatcagccacttggcaaatgagcggttcccgcatgcgcctgaggcactcttccagccttccttcctgggcactggagtcctgtggcatccacgaagactaccttgcaattcccatcatgaagctgtgactgtggtacatcccgcaaaagaccttgtactgccaacacatgtgcttgtctggcggtaccacctatgttaccgcgtggcatttgccgaccggcatggccgagggagatcactggccctgggggcccggccgatgaatgatccagatccttgctcctcctgagcgcagtctcccgtgtggatcgggcgggtccatcctgggctcggctgtccccctccagagatgttgggtctgcagccggggtatgaggattcggccctcattgtcccggaatggtttaggggga

SEQ ID NO: 612010 - DNA, 610 bp, Homo sapiens
  misc_feature (247)..(247): n is a, c, g, or t
aaagacagaagtggacggtcgttccaggggtagaggaggcatgaaggatgaccgtcgacacagatattctgcggacaaaaggggtggatttaatacctttagagacagggaaaattatgacagaggttactctagcctgcttaaaagagattttgttttttaagcggggggatgcgttaacagtgctgcagattacaccaatgggagctttgtaagttcttttgagtcagtttgtatacagaccacntctaggcctgttaatccaacaaaaaccaaccataatggttttgttagtattcagaatcccccaatgtatgaaaaaatttttaatattagcccatgccaacaggggtatgcatttcttgctaaacgcagaggcacaatccctgttttacccaccccatattttttatcgctattacccatctacacctcattcctaatcttatattctcggcggtcaatattatatatcactcaactatcaaattgttattctattccttcatcttcttacttctcattttaatgctcctattctctcacaataattctcttctcgcttctcacatctgtttacacccctctctcctgctttaattttaacaaa

SEQ ID NO: 612011 - DNA, 458 bp, Homo sapiens
tgtgatctagaggtcccggtgggagagggggtctctcgaatttcagggaatggaaatcatacagagtatggttctcggaccataacagaactaaattaaaaatcaataacaaaaagatatctgaaaaacccacaaatactgggaaataaagcacccggcctccaaataacagaagggtcaaagaagaaatcacagggaaaatgggaaaacactttaaacggaatgataacaaaaacaacatatcccagggggatgtagctaaggggatgcgggagtgaacgggcaactctaaatgtggtaaagcaaggagaagggttacgaatcatctcaatcccggcggtgaaacattaatccggtaaaataacgatttcagtagaacatgggaacaaaaaaaacaaattaccttaaaaaggggggggtgggggtgtgccaggaacgttaaggcatgaaacttagca

SEQ ID NO: 612012 - DNA, 409 bp, Homo sapiens
gtcagtaggcagagactagaggatcaggaaagtggcagaaggacaggaatgtggtctgaaggacctgggtattatctatgtgccttccctacatagacgtgctgtcatcctctggtgaccccagtgtagcggtccaagaatcctggagacccccaggtctatgcacatcctttacccttgtactactgcagaggagaaaaagagacacacacacagaatggagcccatcagttctttggctttgcatttcaactaacacagggccctctagtcctactctctcagggggtctggcctctattgtctccttctcttgaccatcagagaccttgtccttgctgaattcaccctgaaggacaatcaaggctggtatgagcacagtggaaggctgaagataggggttggcaag

SEQ ID NO: 612013 - DNA, 379 bp, Homo sapiens
aattggttatttctcactgaagtcctaaaaattcttttttaaaaattcatttgagcttagtgcctttattatcatgcattttagacttgatcatcatcagtgttccctggcacaggtatcttataatatatagaaatgaaatgattttttaaactctgtaaaaattttctttttttttttttcttttgataaggcgtcttgctcttgtcgctcaggctggagtgcaatggcgcgatctttgctcactgcaacctccgcctcccaggttccaacaattctcctgcccccacctcctgagtagctgggattacaggcaccctcccccatgctgccaagttgtagctatagctacaaataaaaaaaaaccttgttttccaga

SEQ ID NO: 612014 - DNA, 974 bp, Homo sapiens
caagctcctgcgaagggctaactcgggacgtgaacaggtggccatgactgcttgcaacggttgccgacctcgtacatagttccgcacggagtccccgagaaagccaggcatgacccgggacaacccggttcaagcaccaaggaccagcgacttgtggccacccgaccgctgccggtgcccagcaactgcccggaagccatgatcagcgtcatcgccaatccggataatgccaccatccccatcacagcagaagcttgttcaagaagcatggagtgtacaaccccaacgaaatcttcggcgtgacgaccctggacatcgtcagagccaacacctttgtctcgcagagctgaagggtttggatccgagctcgagtcaacgtccctgtcattggtggccatgctgggaagaccagtcatccccctgagtctctcagtgcacccctcaaggtggactttcctccaggaccagctgacagcactcactgggtcggatccaggagggccggcacggaggtggtcaaggctgaaacgccggagcaggctcttgccaccgctctccagtggcgtatgcgcggcgacccgctttagtcttctcccttgtggactgcaatgaactggaaaggaaggtgtatgtggaatagattccttcgttaagtcacaggaaacggaatgtacctacttctccacacacgctgctgcgttgggagaagagggcatcgagaagaaccatgggcatgcggacaaagtgctcgctgcttgttgagcgagaagactgatctcggatgccatccccgagctgaaggcctccatcaagaagggggaagtatttcgtgagagaccactgaagtgagccgctgtgacgggaggccagtttccttaatttatgaaggcatcatgtcactgcaagccgtgcagataaactttgtatttaattgctttggtgatgattactatacgacaggtcatgccttccaa

SEQ ID NO: 612015 - DNA, 437 bp, Homo sapiens
ggaggacaagagcagcccacagatgtgcaagtgaacttttctagagaacacatcactctgacaggccacatcagtctatgtagccctttctgaacacctaaaagaagtctaaactagcagtcgggaggctcagactgcataacgtaactctgatccaccaggaaagttccagaaactacttcagtagaaaggtagatcggaaaaccctctgaaacaagaacatgtacaaggagcttcggaggcaaatccccgatcacaagccagtcctccaggcggtgcagtgcagagacacgtcaaatctctcgttgagaaagcggctgcggattcgtaagcatatcctcccaagataagccgagattaggccctgataagcaggtcctatcagatagtctaatcagcatatcaccatacggctgggaacaccaatgtcatctcct

SEQ ID NO: 612016 - DNA, 680 bp, Homo sapiens
gatgtcctccttgctctcgccctactctttctggtgttagatcgagcaaccctctaaaagcagtttagagtggtaaaaaaaaaaaaaacacaccaaacgctcgcgccacaaaagggatgaaatttcttctggacatcctcctgcttctcccgttactgatcgtctgctccctagagtccttcgtgaacgctttttattcctaagaggagaacaatcacatcaccggcgaaatcgtgctgattccatgcgagctgccccatggcacatcgcggcgcactgactgcctatgaatttgctaaaccttaaaagcaacgctggttctctgggatataaatacagcactggccttgacaggaaacagctgccaaatgcaagggacctgggtgccaaggtttcatacctttggtggtaagactgcagcaaccgagaagatatttaccaggctctgcaccggacggctgacggccggaactttggcagaatgctaggtatcccagaacctacatgctgggcgtaaactaatacactccagattctgtgtgcatacaacaagacgcctccagatccgcaacgacttttgacggtcacatggtactttgccacaatttctggcactaccaccggccattccttccctgccaatggccgaagaaataccccgtgccatatcgccccagtgc

SEQ ID NO: 612017 - DNA, 115 bp, Homo sapiens
tggatgggttatcaattcacacagtaagaagcctgctctatgtgccaggttgatccctacttcttctgagtcccctgattgcctgtacctttgaaattatcaataaagtttaaaa

SEQ ID NO: 612018 - DNA, 123 bp, Homo sapiens
cttactatggaggatcagagcacagacactctcattaattgcagttaatgatgaaaagagtgcagcagtgcgcggtgctcatgcctgtaatcccagcactttgggaggccgaggcgggcggat

SEQ ID NO: 612019 - DNA, 1188 bp, Homo sapiens
tgttgttatgtgtggtgggtggggtggagaggggggggagaggggaggggggggagagtgaggagacatcgtgtgttcaaaaagagagaagagagggaggggggggggggagagagagagagatatgacagaagagagagagggggtggagaggggcggcgcgcggcagcgagaagagagcagaggcgggggaggccgcgcgaagagacgagagcaggcgcgcggggtgcgcctactctcgcgagcagagagagcgcgcgcgagagaagaggtcgtgtgtggggggaaagaaaagaagcaagtacgaagtaatctctcccacgcgcgagagagaagagagaaagagagagagagaagagagacgagagagtgatagatagcgtggaggggcggagaggagagggggaggcgggcaccagtgtgtgtggggcgacgcggccgcgaggagaagagaaacagcggtgggtggagcaaacaatagaggcgacgggaagagagagcagagagacccacactcgacaatagaaggcgtgcggagcgaaaaaaaaaaaaaacgagaacaagaactagtagagctgagacagccagagacgagacaacaaatagctgctgcgatgaagagagaggtgaaggaggaggaacaaaacaagagaggagagagatgagccgcggagcgacgagagaagaggagaaacaaggcgaggagagacgagacacgcacatcagagacgaggcacgcgcacagcgtgagccgaaaagcatacaaaacgcagcacgcgaccacaacagcagacgaagcgttgcacccaataacaagcaaagccgggcgaggaccaccacacacggagagagacacagctaaagaacgaacaaatcagacagagcgagtggcgtgagacaccaaaaacagaacagaaatgaagagcacaagaaagagaacgagaacaagaccaacacttaaaacaccaacgaactgaggagagcgaaccgcaggaggagagcaagacgacgagaaggagctgagacacggacacagaccgtcaaacaaaaacaagagtacgacaacaccagacggagacgatccaccaaccaccagcgatccgaggacaggacgaagacacaacaaccaggaggagcgaaaacagagaaacgacggagaagagagatggcggagaggaccaagagagc

SEQ ID NO: 612020 - DNA, 185 bp, Homo sapiens
gtgactccaggattacttattcgtgttgcactttccttcaagtattctcaagtcagtgtacaggtaagccctggttgctccacccactcccaggtagagcaaagagccttcatacatctcaagttgggggacaaaaaagggggaagggggggcacgaaggctcatcattcaaaataaaacaaaat

SEQ ID NO: 612021 - DNA, 355 bp, Homo sapiens
  misc_feature (22)..(22): n is a, c, g, or t
  misc_feature (129)..(129): n is a, c, g, or t
  misc_feature (132)..(132): n is a, c, g, or t
  misc_feature (210)..(210): n is a, c, g, or t
aggttcagactcttggagccanaagctacatgacccctaaacgatggagtttcgctcttgttgcccaagctggagtgcaatggtgccatctcagctcactgcaacctccacctcctgggttcaagcaantcncctgcctcagcctcccaagtagctagtattacaggcacctgccaccacagcaggctaatttttgtattttcggtaganacaggtttcaccatgctgaccaggctagtcttgaactcctgaccgggtgatctgcctgcctcggcctcaaagtgctggaattgcaggcgtgagccactgtgcctggccagttgtaactatttatcactgtctggactcataaaca

SEQ ID NO: 612022 - DNA, 1029 bp, Homo sapiens
gaatatttgctgacatgctctacaaccttagctgcaggctcttttcctcatttcagggaatgttcgtgcgtctcttgacccatccatcttgtcgtgtcgagctggtaagtctcctgcatatgtcccttctctactcactgtactgctttgaatatcgttggttcaataaaggaattgacaagtgcaccagcggtttgtcgtacacactagaaagggaagtagggccttactatcgtttgggttgggtttgcccttggattattctcacaggaagtgcaagtcctcatatatatatcaagtgagcgtagcgctttgtctctagtcctcttgcctgttattcagttattcaagcgccagatgaaggcaaagatccctggcaaacgcatatctcttccgagttgccgccttcttctccttggtggggcttcttaagcaacagagtcttccacatagacagtctacctgcagtcggacctgagcagcatctagttctgcagagaagcttcccttcaccgcatccgtcgacgtgccaaggtgaaggcttagtgcaggtcactgagtttgcctgcatccaaaggtggatgggcgggatttggcaagaagctgtgggcagcaacttttcccgtgtttcaactcccggcctgcctagggaagggaggacccggtctgccaaggggccctctgcgtattcccttctctctgatggaattgaaatttagtctctggtgcacgtgagggagaatgttcctgacaaccagtgtgtgaattttaacatcaccgtgagtctggaagacacacggtttacttgagtaatttagcattgccagtcctgtgctgagatggacacttgtttctctgggcattacctcacctgctccggctttaccctggatatggttggatcacggggttgcacagcactggcggtgaaaaacatggtggggaggtcagccgagctactagggtgtccagggctgtgcgaaacaaggcgggagagctgccaacagtcgccagcagcacacataacaa

SEQ ID NO: 612023 - DNA, 591 bp, Homo sapiens
accacagtaacaattattgggtaaatatggaaatcgcctgtcttaaagccctttaggtacaaaggccaagtgagagaaatgaaagcctctactcacacaagttatcatgattgcgcatggatatgttcagaatgagtattttcaaatccctttaacaaaagctgattgcagaacgaaaagcccaacagcagcaattaaattacgtttggaataaaatcatttggcctaattttcataacccgagatttcagagaataccaccacccatgccaggtgtaccagacaatccaattgtctgttttatccgtgtaggggccgctgtagtatacaccattcaggtttgcagagtgacacctgttaaccaccgagccagactgatcttgttctgcgcagttcccttcatagttgtcatgatctctgtcccacgtgctgaatttcattctttggtgactagcccaccgctgcacctcaggatgaaacttccccgcaagggaatctccagctgtccagaatatcccaatatcgctcgaaaatctctaatcctccttgattctcactctgtgatccgctcactctctcctcggtcaattc

SEQ ID NO: 612024 - DNA, 326 bp, Homo sapiens
  misc_feature (266)..(267): n is a, c, g, or t
  misc_feature (296)..(296): n is a, c, g, or t
actagaccacggtttggctcactgagcaaacaggtctgaaccagattgggctcaaatcttttttttctttttcttttgttgtttttggagatagggtctagctttgtagcccaggctggaatgcaggggcaggatcgcagctcacggcaaccagccaaccggggactaaactagtccagggttggctggcccgaattggaccaacccgggggctagtataggctagttaacctttcgtttatggctacaggttaatcacggcggtnnccggtgggggtgtggctaggcaaagcgtntggagctgcatggctgcgtgcttgatgctt

SEQ ID NO: 612025 - DNA, 388 bp, Homo sapiens
ggtcgacggtggaattagggctaggctgccagagaatgtgccaatgagcatcacccgtcatgtgtgagagagcagaagatggcctgtgagccagtgctctagaaaacatcatgtaggaggccggtcacggtggctcacgcctgtagtcccagcactttgggaggccgaggtggatggatcaggagatcgggaccatcctggccaacgtggtgaaattccacctctactgaaaatgcaagaattagctgggcgtggtggtgcgcgcctgtagtcctagctgctcgggaggctgaggcgggagaatcacttgaacctgggaggcagaggttgcagtgagtcacgattatgccactgtactctagcctaggcaataaagcaagactgtcac

SEQ ID NO: 612026 - DNA, 243 bp, Homo sapiens
gaagcctaatcagccccccctgttttcccctgaaaaatcctctttttttggggtttttctttcttttttttttgattttgccctgggcggtgacgtcacccctgtccaggatccccagggggggtgtccaatgcttttgaaattgtgttgaattgtatgctttttccctttttataaataaacctgtaaaaatgtttccaaaaaataattaaataaattaattcgaagaatttgtccggccca

SEQ ID NO: 612027 - DNA, 154 bp, Homo sapiens
tcgtcgaccgctgaacttgactgtctggaggaagcatataccacagaacattggctagtcaggatatacaaggtaagccaacaggaggctgcggaagcagccctggtgcttaaaaatgggccacatgtttctaacataagcggtcgacgggttc

SEQ ID NO: 612028 - DNA, 1400 bp, Homo sapiens
catgtcaagaattttctggaaattactccctttcacatggttgacacatcattaagttgacccagttctccatagctctatccactagcaatggtttgccagataccccaaaccatcactatgatcaacaatcacaatgtgcatacttttgacccatgtaatttacctcaaacagttagtcaattgcgtagcacagagtcactgccattgcacattcttggtttcaccaacctactctcagtattcccaatgcaccagtcaaccaactccaccatcaattcctatcattagtttagcaggcaaagaggcccataaatcacttctagaatccgtccggacactcaacgatacatagggaatcaacggcacacagcaacagttatcgacatggtcggatgatcagccactaacacaaaccgcaggagacgaggtgcatacacgcggacgtaggacctgacagccgacttgatgactagaccgaaaaacccaacgggaccacactacctaagagaccacaccacggcagggcatccaacaaaactccaccccatatagcgaccgtgaccacaaacctccggacgcgacccaccctccctccctacaacctcgacccacgaacaaaaccgaactcacatacaatcctccaccatgggccaccggaacaaccaagagcaccaccacgaccatagcatactccgggccacaagcacatcaaacctaataccacaaccgaacagctgcacatgcatcgcacaacgccatccaatatcccaccatgacattggcaatacataacgatcacgaaaactaggcacaaggcactcacggcacacatagggatctacccataacaatcggccgatcacttgtctacacagaatgaccacatccaactagccgcaactaacaccagagcgccgacccagctacagaatcacgaaaacaattatgcaccgcacccacagggacaaccgcccataagcgaacacgacacggaacacacatgtaaacacgaggacaccaacccaccacacgcgactaacacacaaccgacgacccacattaccgaacggctcaacaacaccagcacacaaaacaagaactggacacaacaccagtagaccatcaacgaacactggtacgccacaatgtaacgacacaagaacaagtaaacaccaaaacagacaagacacaataaccgacaacaatacacagaaaacaagtaagaacaaaaaaaataagccgagacacacacataaacgacaccaacaaaccatctcgaagcagcgacgtgacgacgacgaacacaaacacactggcataagtgtatagctgtgaagtcggccaaatgacagaagcacaaagcagcacgagcaatgtgcacgagacacacgcgcaga

SEQ ID NO: 612029 - DNA, 315 bp, Homo sapiens
  misc_feature (116)..(116): n is a, c, g, or t
  misc_feature (140)..(140): n is a, c, g, or t
  misc_feature (170)..(170): n is a, c, g, or t
  misc_feature (284)..(284): n is a, c, g, or t
  misc_feature (302)..(302): n is a, c, g, or t
  misc_feature (312)..(312): n is a, c, g, or t
gctggcggtaacgtccagcaccactaaatcatcatacggatgggcgcgcatccacaggaacaacgactcttcatcctgctcaaccgcttcatcgttgaagaaggctaacgcgcggntggcgtccagccgtcatagctcancaggctgcggcggctgtccaccacacctgncagcacaatctcaaagccggtacgtgccgaaagcgtgctctgctcacgggcgaacagttccagccaacgggaaccgatattgcccttaccgaacaataccaggccgatgcgttnttctgcgcggaagacggncttatgcagnccc

SEQ ID NO: 612030 - DNA, 210 bp, Homo sapiens
  misc_feature (162)..(162): n is a, c, g, or t
caccgaaaagcaccaatgattgaatgacatttctcaaaagaagatattccagtggccaagaaacatatgaaaaaaatggtcagcatcactaatcattaagcgaaacgcagatgagagccacaatgagataccatcttactcccacaagaatgggcattgatnaaaattcagagaaaaacatagacgttggtgtggatgcggtgcagatgg

SEQ ID NO: 612031 - DNA, 179 bp, Homo sapiens
ttggaggtggggttgagtgaactgagattgtgccactgttgtccaggctggtcttgaattcctggcctcaagagatccgctggctttggcctctccgagtgctgggattacaggtacaagccactactcgccggccagtttttttttttttttttttggaaacgggttttgcttttgtc

SEQ ID NO: 612032 - DNA, 185 bp, Homo sapiens
atcagaacagacagacagtgggatgtgagtgtggaccacatgtcagatccccttctgtagagttggacccctcgacccctcctgggccacatccagatcaacgccacaaattcctcaacgccccctacagtcctactggaaatgcctctcattggcacccctagccccacacaggctagctagga

SEQ ID NO: 612033 - DNA, 206 bp, Homo sapiens
tctgtttcatacgcagagagcggtttacttcactagaaagtgtactatgtaagcaagctagtcattaagatgtacaccaatcctttatctacatgaagtccgggagagatgttatctttaatccattcatatatcgtttgaggggatggatccaactttatttgcttcaacagtcccttgtgcaatccgaggagtgggaataagaa

SEQ ID NO: 612034 - DNA, 355 bp, Homo sapiens
cacttatctgtgagtatggtggtagcctttttattttattttattttgagagagggtctcactttgtcacccaagatggagtgcagtcatgtgatcagagctcactgaagccttcacgtactgtgctcaagcgattctcccacctcagtctcctgagtagcagggactgcaagtgcatgacaccatactagctaatttttgtaaagatggggtttcaccatgttgccctggctgatctccatctcctggactcaagagatccagcactttgggaggccgaggcggcagatcacgaggtcaggagatcgagaccatcctggctaacacagtgaaaccccgtctctactaaaaatac

SEQ ID NO: 612035 - DNA, 667 bp, Homo sapiens
  misc_feature (349)..(349): n is a, c, g, or t
tgagtcatggcacagcgtcgcactgtcgtagtcacgctgcttcattagtgagctctcaggttcagccgtgtcgacagtctgtctgtcaccgacataccgcccataagctatgcttgccgcccatattctacatgcagacgacgcagtgagcgcttgaggctgatagtcgtgcttgcagagttacgatgttgcctcgctgatgttggcgtgagtcaggctagatagaccatcgtgggtgtcctcacgtcggcacagtcaccgatggcgtagacgttgctgtggccgtccacctgcaggtgctcgttcactctcagagcaccgctgctggctagtctgctctcgcacgctntacggtaggcgaggctgttgatcgtgatgcgcgtgcatagaatcactaggttggtggccacctctgtgcctgtgtccgtctgcactctgatgtactctcgatactcattgagaggcagctcctccagattgctcaccggctcactcagcagcagctgcacgcccttccgaagcaggttctccttcacttcctgccggacggagggcaggagctccttgtcagcaatctctgctgccatctccactgcagccgagcctcctcccaccaccacgatgaaccgtgagcgctggacctcgccacccagcagcagcctcgtgc

SEQ ID NO: 612036 - DNA, 1212 bp, Homo sapiens
ggagagagagagaactagtctcgagttttttttttttcttattggcttcaaaaagctttattcccattgggtccaaggcttgtaaggatagttaaaaaagctgcctatgggcctggagggaaaggcttaggcaaaagcccatattcattttgcaaggggccctttcagaaagttcgcgtgggcctcaaaaggcttctatagctcggtgcttgagaagttgacgccttttcagaaaagaatacttgcgcccaagccccgaaacctctcggaggtccacaccgcagagcccgtgtgtggagagagtgtgtggctcagaggtgtgagctccaccccatattcttttcctgtgacactaagaagctttctccactgtctaccactcgaactcctatgagaggaaaaaagacgctgcaaaggatctacttcttcgacgaggaagcaggaacaagtcgctcccacacgacggagcaggacagctgagcagagaagtactcgccgcagtgcgacgagtgccacacgaaaaaaagccacgccaagaggagggccccatcattgacgcaagacgaatatccttccgcacaaaagaaaaaaatgacggaggcgtaaccgcccgtggcggtatcactacacgacagtcagttcttgtaatactacttatcactaccgccgcaagcaggagccccccccaagttgcgcaccaacgacgacgtcgttttacatacacaacgatcggaggcagcacgatgttactggagtagggggaggcagatgacttgcttatgtaatacaacccgacccgcccacccacgaacagcaatagcattcacttaaatcacttacttatgatttcacttacacagaacggccgctcgtgttttgtgctgggctagcttcttttcgttaacacagagattagtatcaaacaaaataagtgattcgaatactgtatcccgcacgtagggtttcgtgtcgaagacaacaacgaaacataagcaaaacgacaacttaatagtctaccgtccgggcacgcagggtgctactccgccccgacggacacgcacacatgataaatcgccaggactagtacacttagtactgaggaagaatgatattacctatacggttgtagaatgcggacaccgcaacatacatattcatcatcgcatttagatagaccagagcactcgactggaaccaaactaagactagcca

SEQ ID NO: 612037 - DNA, 131 bp, Homo sapiens
accatcgcttggttagaaaatctatcttcctctggaagaagtccttggcatcctcagcgtctcctcgtacatagtacccaggttcccacatcgatgagcacgtgttccacgatcatcgcagacttcccagg

SEQ ID NO: 612038 - DNA, 543 bp, Homo sapiens
  misc_feature (229)..(229): n is a, c, g, or t
  misc_feature (298)..(298): n is a, c, g, or t
  misc_feature (368)..(368): n is a, c, g, or t
ctgaagcaggccagcaatgttccctgactttaagaatattcctggatccatcggctaagctctattttagccccagccattgactgtaaatgttaaactctaaccaactttaatgtgatccatcatcagtcacctaaattttcagggacttctattattacattttcagaggtaactgacctcagaagagatttattctagttctaaacttgactgtaaacatttaacnaatacccaagcaagtactaggcaccatgcactgtttttgctactggggatactgtgggagaacaagacnacattcctgccatctcagagcttacattctagagaaagaggtaaaataagaaatttacttgtggtgaagngatctacatactatggagtaaaataaagctgagagggggaacagggaatgacacgtggcagtggagttatggttttcaataatgtgctcacaagaggcctcactgggcaggtgacatttcagaaagacttgtagctcaagagatacagccgtcagatgatcagttgcgctacgtc

SEQ ID NO: 612039 - DNA, 107 bp, Homo sapiens
tcgttctagaggatccctccaagctccctaccagctccagagtggtggtttccagagccagaggaggatttagaagtggaggaagtggagggaccggagggtcctga

SEQ ID NO: 612040 - DNA, 564 bp, Homo sapiens
agggccactactcccattcatggattaatgggttagtagactaatgggttatcaggagatgaaactggtggctttatgctttataagaagaggaagagatggctgggcacagtggctcatgcctgtaatcccagcactttgggaggacaaggcaggtggatcacctgaggtcaagagttcaagaccaggcaggccaacatgatgtaaccccatctctattaaaaatacaaaattagccgggtgtggcggcacacgcctgtagtcccagctacttgggagggtgagacaggagaatcgcgtgaacccaggaggcataggctgcagtgagccgagagtgctactgcactccagcctgggcgagacagagtgagacaccatctcagaaaaaaaaaaaaaaaagaagaagaagaggaagagaggcctgaactagcatgatcaacctccttgccatgttacaccccatgccacagagtccctaccagcaaagagggctggcacaaatgcggcccctcaaccttggacttttcagccctcataactgttagaaataaattctttcccttt

SEQ ID NO: 612041 - DNA, 576 bp, Homo sapiens
cacgacacggaacgagcggcgacgccgagactcgcacgacgaagcgcgcgcgagcgaccatcgaacacccttgggacacgccccagagctcgaaagacgatccgacagggccgcgcgccattgacgcgggacacgcgaattcgggcataagggtggggggaggcacagataaagatattttctacggggaggctgcgtttaacataacacgtcaacatcacccaggaaaagagcacgacggaggagacgaacagcacgcgacgaggacagccccggaagcagcagacacgcgcccacccacagaggccccccaccccacgggacgcagagcaacagtcaggcgaggcgcacacccgaggccggccacgcgcccaaagaccaacgcaagcgcgcccgagggcgcgcccccgagagcgccgacaagaacccgacacggaggaacaccgccaaggacacagcgaggcagagcaggcgccagaagcgcccggcagcgcgcgcaaccaaattatggaaacccagacgaaaagaaaccagaaacaaaggatgaaggcaagaacaacagagcgcgaccgggct

SEQ ID NO: 612042 - DNA, 110 bp, Homo sapiens
ggcaatgtggtagtttacataaactaagtgaagagcccctgattcctcatcatcattcatcctcgaaaaaagtttgatcatgatgcttcaaattccaagggaaatatgaa

SEQ ID NO: 612043 - DNA, 379 bp, Homo sapiens
gaaaaactgaacatttcaagaaataccacaataccaaaaaaagcatttggtatagtttatctcctcaccagttgtgagccttttggttgtttccaccttttgggtactgtgaatagtgttgctgtgaaggattcacaaatacacatctgtttgaatacgtggttttatttcttcactgtatattcctaggagtggaattgctgtgtcatatgataatttctctgtctttgtgaggaaacattgaactgcttttcacaaaagctgtaccattttactttcccagcggcgtatgagggttccaatttgtccacatccttgccatacttattttttgttttttttcattataggcaccctcccgccctccacccctcccaaa

SEQ ID NO: 612044 - DNA, 952 bp, Homo sapiens
agagcacccttctcatgagctcatcttcatcttcacaggtacgaaaatcgttgtcgctcttaatggttatgacatctggaaggttatcccaaggaaaatatctgaacctgggtcttccacaaagaagtgatgaagatacgtgcggctgtccatcgtttcgaggatacatggcaacgactctcctgtgctcaggaaaccaggtctggagatatgatgatactaccccatattatggatcacgagctatccgagattaactagacgaagacttcccaggaacttggtgactaaagtagatgctgtctatgagaaaaatggttatatctattttttgcaacggacccatacagttcgaatacagcatctgggaacgtaatgcgtatatgttgcgcgtacagtgccatgcatagatgccactttgtgtggtgtcaagtggtctttttgaacaacctggtgatctaaatcctgaagagcatttggggtaatacttccagaagtgcggggtaggggaagaagagctatcaggagaaagcttggttgctgtgaaccaagcttcagtaagttatctgtagaatatgtagtatctatatgactattgcgtggtggaaccgacttgaagaatgttgcgagtcactgaactggaggcctcctaaagaggcatctgatcttgctgctgtacaaaagccatggtggatgatacttccatcacccaaatgggggcctgggcgtcaagagagctattggacattttttgtcagggactacacgggctaaggagagacaggggtatgagaaatttttcacggtaacatggacaaggcctcgccgagcgcctatataaaccagcagtggaaatgcgtctcaaaataatgggggagaggaggtctccacacaaataaagaagggaaatgatgggcgtttggacacatcatatcgagagaaaggagcacat

SEQ ID NO: 612045 - DNA, 319 bp, Homo sapiens
  misc_feature (57)..(57): n is a, c, g, or t
caaaaggctaacttgaaaggtttggggccttgttccccaaagggtccccagggactntgcagtgtccttggcaaatcccccctgtactcaatgccctacatttttttttgtggtctctcccctggcttgcttcatggcccctgaaccaatccctttgtatgctatgctccccctgtgatggaaaacaaaatgagtataactttttttatatccatattcagcctatataaagaatattttatgcatttatgacgggcttactactccagggcatttgtcattagttttcatgttaatacaggccatttattttttggta

SEQ ID NO: 612046 - DNA, 241 bp, Homo sapiens
acccccctgtgcaattgagagagctcaacgtcttcatctgattgtcatatacaagttcaccccaccagctggtctaatgtctcgtgggtgcgtaaatggaaaatctgttcaccacatgtagtgtctacgtagatagtctatcctgcccagggtaagaccactcttgttcctgcaaggttccgatctagctatccccattcgctgcccgtcatactgtaggacagtgtacagacttgcgagg

SEQ ID NO: 612047 - DNA, 1209 bp, Homo sapiens
  misc_feature (747)..(747): n is a, c, g, or t
  misc_feature (750)..(750): n is a, c, g, or t
  misc_feature (756)..(757): n is a, c, g, or t
  misc_feature (763)..(764): n is a, c, g, or t
  misc_feature (793)..(793): n is a, c, g, or t
  misc_feature (797)..(797): n is a, c, g, or t
  misc_feature (806)..(806): n is a, c, g, or t
  misc_feature (817)..(817): n is a, c, g, or t
gtgcgagagttcaaacactaggctagtagaggctggtgttaatcgagaggggttggtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtctgcgccgctgacccgtcgcagggcgagatgagcgcggacgcagcgtgccgtgggctgcccctgcccctggctctgctgcctggagaagggtccgaacggctacggcttccacctgcacggggagaagggcaagttgggccagtacatccggcttggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgcgtggtggtcgacccctgagacggaccgagcagttgcagaagctcggctgtccaggtccgagaggagctgcttgcgcgcccaggaagcgccggggcaggccgaagcctgccggccgtcgccgaggttgcatgggggctggcaacgaaaattgagcctcgcgaggccgacaagagccacccggagcagcgcgagcttcggcctcggctctgtaccatgaagaagggccccantgnctatgnnttcaanntgcacagcgacaattccaagccaggccanttcntccggtcantggacccagantccccggctgaggcttcaggggctccggtggcccaggatcgcattgtggaggtgaacggggtctgcattggaggggaaagcagatgggggaccgtggtgtccgcatcagggtggcgggtgacgagaaccaagctggtggtggtggacagggaaactgacgagttcttccagaacatgcagagtgatcccactctcaggagcacctgattggtccctgcctgttccttcaccaaatgcggagatacagtaaggagaacgagtaggtgaacgccttgcgaggcggcttggcagaggcccaagccaagccctgtaaatcggcttcatgacccaggagtcgttcatcccagacggccccaaaaggcatcaatgccttgttactcttctagaccgac

SEQ ID NO: 612048 - DNA, 411 bp, Homo sapiens
  misc_feature (29)..(29): n is a, c, g, or t
  misc_feature (45)..(45): n is a, c, g, or t
  misc_feature (56)..(56): n is a, c, g, or t
  misc_feature (234)..(234): n is a, c, g, or t
  misc_feature (352)..(353): n is a, c, g, or t
  misc_feature (361)..(362): n is a, c, g, or t
cccttccttaaaaaacttctttctgaaancgtggaatttaaaccnctccgcccaantcccaaagtgctgtcccggacctgcagggtagcttaacggctgaagatgtaattctcgacaaaaggtgacaccccgcgatgtagtcaagggccgaacacgttggttttcttccctggccttttgggagagtcgcagctgagggaagcgcttgatcctcggtgagatgggggttgatgncgtatttgcccctttgggagtgggaagcgagtaccggaggccgcgggggttcagcaccttggggttgcgggagaagtcatgtgcagggtgccgtcgtcgctgacggtacggacacttnnttcagggnnttgtcccacagtgtgagcagaacactcggctcatgtcagacgttgtctt

SEQ ID NO: 612049 - DNA, 606 bp, Homo sapiens
tgacggtgcttccatgtcccgcggcctgccttgcctctgtacccgtgaggggtggcaggagctgagtctccccttcctcctgtgcctcccttcccccaccaacagctgctatgggggggctaaattatctctattttgtaagaggatctatatttgtagggttcggggccagccgggtccctatgtctgtgtataaactgtacagacgtgaaaaacaaaaaaaaaaaaaaaaaaaaaaaaaaaggccaaatccggctaacccgcgtttttgttagaggggtggccccccatggggggcggcgcttaaataaagccaggccgactggcgggtgcttaaacacccggctagcacagtgggacaactgggctcgcgtgtgagcccttgtgacaaggccccccatccacctgtggtgggtgtgaccaatcctgggccagacactaccactcacggagcattttcagcgccgccagggggtgatttattagacttcacgagcgtgctataagtggtggttaccgcatacggtgactatggctgcctggcgtaaacatttgggatcatcagcgtttgccttcggacagctcttctcacggtgggcctggtac

SEQ ID NO: 612050 - DNA, 448 bp, Homo sapiens
ctctcatacaaagtcatgtgattgcagagcccgcatcctgtccatacaagcctagcaagccactcagcctctcatcctgtctcctctcaaagtggggataatcgcagccgtgcagcgttgttgaaagaatacataaaagccgggcacggtggctcacacctgtaatctcagcactttgggaggatcacttgagcccaggagttcgagaccagcctaaacaagagtgagactaacccccgatctctacaaaaaaaaaaaaacaaaaaacaaactagccaggcatggtgacagtgtggtctcatttactcgggaggctgaggcaggaggatggcttgagcccaggaggtcaaggctgcagagagccatgatggtaccactgcactccagcctgggcaacaaaacgagaccttgcctcaaaaaaaataaagcatctaggccgggcgcaaaa

SEQ ID NO: 612051 - DNA, 141 bp, Homo sapiens
  misc_feature (37)..(37): n is a, c, g, or t
ggctgatggggggtgcctgtagctgccagctacctgnaatgctgaggcgggagaatgcttgaacctgggaggcagaggctccagtgagcccaagatgcgccattgcacccagccagggcaacaagactgaaattccacgtt

SEQ ID NO: 612052 - DNA, 110 bp, Homo sapiens
gtctttttttattccccgttccggacgctgcatcccgcaatctgcggcatgacctcacgcatcagatcgagaaacttacgcaaccgcgtcggatagtagcgcgcccaggg

SEQ ID NO: 612053 - DNA, 1631 bp, Homo sapiens
ggcacgagggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggaccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaac

SEQ ID NO: 612054 - DNA, 85 bp, Homo sapiens
aaaaaagttttaatgtattggagaagttttaaaaacccagaaaaacgctttttttttttaataaagaagaaatttaaaatcaaaa

SEQ ID NO: 612055 - DNA, 1926 bp, Homo sapiens
  misc_feature (443)..(443): n is a, c, g, or t
  misc_feature (446)..(446): n is a, c, g, or t
  misc_feature (456)..(457): n is a, c, g, or t
  misc_feature (482)..(483): n is a, c, g, or t
  misc_feature (491)..(491): n is a, c, g, or t
  misc_feature (501)..(502): n is a, c, g, or t
ggcacgagggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttggtaattggcgcgagcgggtgcgcgcatgcgcgggacggctggcnggncacgtggcgnnggcgcagggcggcgccgcgcggganngctccccnagtgccctgnnaggcctgcttggctggacggacccccttgcctctggtacccacagtgtgaccaaggtctggtggccaccatgtggctcttgctgccgtcaccatcctccctttagcattgagcagccccggaggggctagcctgagggctgacctgccagagttcgccaccatcggcgctgcttagtggctctcccttgcagcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggaccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaac

SEQ ID NO: 612056 - DNA, 147 bp, Homo sapiens
aaaatctcgtataattatttaagacaagaaaacttccacgggtataatgtacaacgtaccttagagaccatgtgatatgtatacatagtctgaaaagtctttgtatttattcttgggaaataaggactacacactcaagggtaccga

SEQ ID NO: 612057 - DNA, 893 bp, Homo sapiens
  misc_feature (216)..(216): n is a, c, g, or t
tattggaccatcctggggtgttccccacaaagggggattgggcagggtcataggacaatagtggagggagggtcaccaaattaaccaagtgtaaacaagggctcctcgtggttttccctaggcaggaggacctcgtgccggcctctccgcaggtgtttgtggtgtctcccgtgggtatactgaagaattagggagtgtggtgagtgactctataanggagcattgcgtgccttcaagctctcgtggttctaaaaaagagccactattttgtgccaccgcccctttaaactccctattatacacccgtgagagtgtggcaccacaagccacgtagtgttctcagaagaagccacgaggggttgggggggatagaggctcaatagaactcaaaacgaggggtccccaagagggcgcagacagaagacaatattgttctctgatatgagatctacccgacgaacacacacacagaagaggtgtataaaaaagtgtcgctctctcgatgtgtctctataacagtgtacttgtctctataacgaacgagggaaccccacgaggagaacacccatctccgcgagaattttctcgcatacaagagctgcttattatcccccccacaacctattttttcgcccgccctatattatacactattaaatctccaccacagaaaaagaccccgggcaacaattggtggtctcacaactctgatgtgggggcccccccaaatattctctcaaaaatatagcaaaccccgttgagtagtgggggtgattaacaacacccgttccccacgaagagaagcaggaggcgttgttgtggagttgtcgccaccagagtagcacaagaaaggaaggggggccatacctctaatacgaaagtagtttttccgc

SEQ ID NO: 612058 - DNA, 495 bp, Homo sapiens
  misc_feature (53)..(53): n is a, c, g, or t
  misc_feature (104)..(104): n is a, c, g, or t
  misc_feature (397)..(397): n is a, c, g, or t
  misc_feature (416)..(416): n is a, c, g, or t
  misc_feature (437)..(437): n is a, c, g, or t
  misc_feature (450)..(450): n is a, c, g, or t
  misc_feature (467)..(467): n is a, c, g, or t
gtctaatgtgggagacaaatagggatcaccaggctaatggggggcgtcaagcntttctctccctcctatcttggcctgttcttttttgttttttgagacggagntacatcctgttgcccagggtggagtgcagtggcatgatcttggctcactgcaacttccacctctgggatcaagggattctcctgcctcagcctcttgagtagctgggattacaggcgcccaccaccacagcctgctaatttttgtatttttagtagagatggggtttcaccatgttggccaggctggtctcaaactcctggactcgaagtgatccgcccaccttggcctcccaaagcgttggggattataggcatgagccatgtgcctgggtccaccttgggcctgtttttgntttttcttttccttggggnttcagcaatttcaaatttctnagttggttatttnggttggaagcagttagncccaacccccagttttaggggggaaagg

SEQ ID NO: 612059 - DNA, 243 bp, Homo sapiens
gcacatgtcactactggggaggtgttcctgctctaagcttcccacggaatgaggcgccctcctttaccctatcctgatcaatcacctacctccttccgttgaagcactattatttattccttccgcttgtctgcctgcagcagtacctactgtcaacatagtgtaaatggttcctcaaaagcttaccagtgtggacttggtgttagccacgcttgtttactcatacagtacgttgtcctgttt

SEQ ID NO: 612060 - DNA, 1054 bp, Homo sapiens
  misc_feature (3)..(3): n is a, c, g, or t
  misc_feature (47)..(47): n is a, c, g, or t
  misc_feature (142)..(142): n is a, c, g, or t
  misc_feature (329)..(329): n is a, c, g, or t
  misc_feature (378)..(378): n is a, c, g, or t
  misc_feature (381)..(381): n is a, c, g, or t
  misc_feature (654)..(654): n is a, c, g, or t
  misc_feature (810)..(810): n is a, c, g, or t
  misc_feature (815)..(815): n is a, c, g, or t
  misc_feature (889)..(889): n is a, c, g, or t
  misc_feature (928)..(928): n is a, c, g, or t
  misc_feature (947)..(947): n is a, c, g, or t
  misc_feature (989)..(989): n is a, c, g, or t
aanaagagaatctccaagaagaagactcatgtgaagaaatgcacccncaatgcagtgttcaatgagctgcttgtctttgatattccttgtgagggccttgaagatataagtgttgaatttttggttttggattctgaaaggnggtcccgaaatgaggtaatcgggcagttagtcttgcgtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattntctttctttctatattggattgcaagcttgggaaatcaagctacctttntgntcgtcgtgctgctgctagaaatggattgaattagtagaccagaaagtaacttcaaatgtgtattatgataatttccctatttattagaagagttggataaactttcataagatattcaatatctccttcagattaccagtgatataactaagaatagtcagacattgtatgaatactgtgccagaatcccaacatataaatgtgacaatctcattggaacatgtcacacaaaagtaatgtgattaccatttgataaacgaaaagtatgccttngccttgtgaaaacttatccacttaatcttacggttgggacaatcaactcttcgtctaaattcaaagatacttaaaaaaatgttcgtccagtttgatttattaaatctgtcatgtgcaaatgttcgcctgcatatacaatatctggtcatttcactntggtntgtgattactttgatgcatcttgttcataagaagtactcaccattcattttatatggaccgtgaaccacgttangacatatatttataaaaggcttcattttgtaacccttgngcatgaaataatacttttncgtcctcctaacgtcacaatgtgagtcaacctttcgtaaaanataacctcacatatacactattgcctcgattattcaattcctttacaaacctcaagttgactcgt

SEQ ID NO: 612061 - DNA, 262 bp, Homo sapiens
  misc_feature (171)..(171): n is a, c, g, or t
actcctgggtactctatatgatgtataccccgggggccgaattcctctgtatactggctgatcccaccacgatgacttgtatctcaatgcagcagcttctgtggctgatcaatgggaaaagagagcctacccatgccacagtatggcggaagaacttttctgcgtgtgggncacctggtgctgattgggggccctgatgatggtgttattactccctggcagtccagcttctttggtttctatgatgcaaatgagaccgtcc

SEQ ID NO: 612062 - DNA, 356 bp, Homo sapiens
  misc_feature (297)..(297): n is a, c, g, or t
cccaggctggccaacatatgctcacaggaagaacaattcctacacataagtgcttgcttcagcagcacacataaaaataaatgaaatgggccgggcacaatggctcatgcctgtaatcccagcactttgggaggccgaggtgggtggatcacctaaggttgggagttcaagatcagcctgaccaacatggagaaatcccatctctactaaaagtacaaaaattatctgggcgtggtggcgggcgcctgtattcccaactacttgggagtctgaggcaggagaatagcgtgaacctgngaggcagagcttgcagtgagcctagatcgcgtcactgcactccagcctgggcgacagag

SEQ ID NO: 612063 - DNA, 346 bp, Homo sapiens
ggagtttgagaccagcctgaccaacatggtgaaacccagtctctactaaaaaaaaaaaaaaaaaaaattaggcaagcgtggtggtgtgcatctttaatcccagttacttaggaggctgaggcaagagaatcacttgaacccaggaggcggaggttgcagtaagccgagattgtgccactgcactccaacctggtcaacaaagcaagactctgtctcaaaaaaaaaaaaaaaaaaagctacaataaagctcttgtccatgctttcccctcacttcctttgccttctgaccaatgctgctgcttcctcatgtgactctgcatggcctctcatgccccttcctcttggc

SEQ ID NO: 612064 - DNA, 535 bp, Homo sapiens
  misc_feature (36)..(36): n is a, c, g, or t
  misc_feature (65)..(65): n is a, c, g, or t
  misc_feature (428)..(428): n is a, c, g, or t
  misc_feature (452)..(452): n is a, c, g, or t
  misc_feature (456)..(456): n is a, c, g, or t
cctcaggtgatctgcctgccgtggcctcccaaagtnctgggattgtaggcctgagccaccacgcncagccaaaggttttatgacttacttcagaagataagtctgaccactttttactgtttctactgccatcctctcacctggattaatattgcctcctaattaatctcctcatctttgtttcttgatggtatgttctcaacactgagccagaatgatccttttaagaggaaaattagataatgccacttctcttcctaaaaccttccagtgccttctagctatcaaaatatagctataggcactacggaatattggctgtgatagtcaggattgagacagctaaatcataagtcctatctggattgcttatttgtggatatctccttagcttacattcttacctagtcttgcagatacttcctcanttttaccaaatctcctcatcactntctntttatgcagccctcccacttacccacccactccagtcgtctgaactttttgtccttttcctccttcgcattccatactc

SEQ ID NO: 612065 - DNA, 199 bp, Homo sapiens
gtttggttcttacgctaggaggcagtgtcctgaagcttggaaactaggcatatggtaacaaagctgtagctggtggatcctgacccttccttccagcacacccaaagaatggtgtctggtctccaagctagactaggtggtcttcgcttcgatgctctccatttgggttgccatgtactctagccgtcggctaaatttt

SEQ ID NO: 612066 - DNA, 120 bp, Homo sapiens
aacatcatactgatcctaagataagtttaccaagaaggcgttagagacaagcacggatggctcacgccatgtatcctggcactattaagaggccaaggcgggcagatcattagaggtcag

SEQ ID NO: 612067 - DNA, 1111 bp, Homo sapiens
ccacgcgtccggtccagaatattttacctttaaaaaaatgtcattggcaccataaataaggactttcacagcttttaaacagtctctcacagtccttatttatggtgccaatgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgacattgatccaagagtttagtgatttcaaaagccttggtctcaggagaagatcaaactttcatactgggcagtggttcactttaaaaacacacacatacacacacaaaacaattttttaagaaatcctaataagtaacaatagccaaaatgcttctggtcttggagtcatgagaaccatcaggttcttgcatatggtctagacttgcatctagagctacgtggtacaattcttttagggcatgtgttacattctgggacaccttgttcacatgtcacttctcatctaatctgcaacgtaggctcttgacaaaaccactaaaattgtacaaaaaacaacacaaacagacaaactactaaaaaaaaaggactggcacacaacaactacccaggggcacaccaaccgacaccgaccgcgacaagggaccaaagcgaactaaaaaccaccacgcagcaaacacatgtgcgaacaagcggactgagacaaccctgtgaccagaaacacacagtagacgaccacaccgcagaccagcgcacgacctaaccactacaaacaa

SEQ ID NO: 612068 - DNA, 938 bp, Homo sapiens
  misc_feature (938)..(938): n is a, c, g, or t
aaagactttttactatggttgaatgtagggacataggtcagggttatttacaggaacataggcaccagtgcctgcaaccctgaagaaagtgtatctcctctcatcaaccactaactgccatagatcatcagggagggctgggggagagggctcatgagccccttcccgttcagggcaggatgtggacgggctccatcttatagagaccttgtgcagagtcacaaaggctgatgactgtggcatggccaggaaacagtgttccacagacacttcactcttcttacatcatttacccccactgttccataatgttcttagatccttgaagtgggtactgttagaagtcccacttagactgagcacttagtggtcatgtcttcttactatgactgttttaagctctagttacttctgcccacttaaaagaaggaggaggaggagtttctttgacaaaagctgactgtagcattcacctatgggcccaaaacataacaggcagtttgttgtctttttattttaatggagatttgaagttgcaaagttctgtctcctcttcaatgtggcctgtggcccccacggtttacatttgatagtgttgatgtgcactggctcatttccatttcctcttttcttcagtagttcgtgtgtctgttttaatttctatttggcgtttgttcatggatggacatatagaagttattggaattgggtacctgtcatggggctgcgaactctggtctgtgttggcgaggtttgaactggcctgtcgagagtggatttttgggcggtgaaaaggttaaagggcatatgaaggagggtcgggaaaggtgaaagggggggtccagggaaaggggggtatttgagaaaaagacgggtggtaagggggcagtacagggaaggagggggaaaaaaagggggtggtagaaaagatccacacn

SEQ ID NO: 612069 - DNA, 1086 bp, Homo sapiens
tagtgtacctcgtagcgtcgtataggagggtctgtgacaccgctaacgtgaaccgtcgagtgcttggcgcgcgtctcagagactggcgagatgtgcggttcgtaacttaagcgcagttgctgagacgtgtggctgctggggtcggtggtgtgtgccgggacgcttaacaccgggtgtggaggcaggggccggatggccgtagggagaattcgcagctgaatctggtgtccaacccgatggagacaaggcgggagtgtggcatcacgtctcattgcgttccataccagtatctggtcgacaggtcgcaatggggtacaacatcactccctggcacagaggtcgcatgctaggttccagacgtaggtcccgatgggtcctcaaccagaaattccacggaatatgagtcattagtggagtagtcgtgtgtcccattagcatctgaaggatcttgctccctattacagtgcattctatggtaggataaagcaatggttgcaagtactagttcgcttgctaagatgaagatctcagtatgttaattgctacaaggtagtcttgtgacgtgaacaagttgttattcaagcaggctcatatgtgagttgggaagtatcgaatggaaaatgaagtggtgtgcactgtgggcaatgggatattagtgggtgatgcatcgaaggatgagttggtgaaccaggtgcacaggtgaatcaacatatttgtcgaattaaagacggggattgcgggttttgcacatgagtgttccagacgcaaatgcaggctattcgacgagggcacgactggactaacagttgtaattcaatggcaatgatcgtggctgttgcataatcagcgactttcagatatcgagtatgaaggggctgtgaaagaagaacggagtgggagctcggaggatgataaacgggactggtttacgagtggccaaatagcagcctttggaaaaacgttcagactatgttcttagcgactttgttgggcctagatggacagctgtgtgttactgcggaatttcctgggttggtttccccgggaaatgggtccccccaaaattgggaagccggtaaaaatttt

SEQ ID NO: 612070 - DNA, 740 bp, Homo sapiens
cacatgattggccgagcgtacacattgacagcaggcgcggagaaagcgctggacactcacaccctctcgccagaatggaccagagtccactgtactggctgctcatcttactagggctgaggccacagaggtgaaagctggtgcagatgccctagcattatagctctaaggtgtataccttttagtcgatgctgtggccgctacaacgtggccaaagggaagaacagtgacaaatgagcagagttggtgtagtaccatagtaacaaaagatcgctgcgactggtgcaaagccaattgacttattcgatatatacagaaacattgtggctaaacttgttcatgaagatggcaatgacacacaatgaagaatgctgtgaaggacacatagcactgctagtgtactgcaacgctctatagtcacagaaggctacgagaagagaagaggggagctaacccagcgtgaagctacaaaggagcgaggatagctgatgatgccagaaccgctgaaccaaaaatgcagactatacctgagaccaaccctgatgaaatcgcacaggttcgtatcacatgagtgcaaacggacacacatgcacaggcgcccatatctgcgatgcaatgaagttggaacggctgtcagttcaagtataggatggcaacactctgagagagggattatagagtatcgaatgagtgaattagttcaagactatactgctcatacacttgtcacgtctctaggc

SEQ ID NO: 612071 - DNA, 800 bp, Homo sapiens
gaaacgatggtaggtagtactgctcctactcagtatgcccatgagctagagtactgaactacctaggagctacaaagcaatccacctagtctcagactacccaaagtagccgggattacaggtagtagagccactggcacctggcagttactacacaataactataagcacctagtagggatttaggaataggtaagcaattagaattagatatattatagatactagtacccctaataaatcctactaccctaagatataaaataagccctataatagcaaatgagaacaggattaatttccaagtaatagtaggcataagtagagtaagggggaaagggtaagcaattaaaattaggagccagaagataataggctaagaggcctacatgaatataagtggctaatatagtaaggccctaaggtaattatatatcatactatctaagaaggaaagtaaagagtagtattagagacagaaagaaataaatataaaggataccattatgaactaacatatataagaataagatatggagaaatagaatctgtaaaggagtctaaagcagaaggaacggagactacttaagtagaactaacataggtacatagaaaattgagagatagatggtaggctaaagccagggtctttaagtaatggaaattgcagaatagataataagatctgtaaagaagggagaattgataaggtaccttatggtatggatgatgaatgtaaaagaagtaaggataagaatgactctagattaagatttataataatggtatgggaaattata

SEQ ID NO: 612072 - DNA, 218 bp, Homo sapiens
ttctggctcggtacccttattaaaggtgcgaggtctctggaaagggcccgcggcatcgacgtcatggcgatggataagaccggcaccctcaccactggccggatggccgtagtcgcggtgtgggatgaatctggacgtgtggtgaacatttctgacaacccacccgcacttgctgttacagcagcgcttgaagtggggtcggagcacctgatttcgcg

SEQ ID NO: 612073 - DNA, 228 bp, Homo sapiens
  misc_feature (4)..(4): n is a, c, g, or t
ccgncccccactcttaggtatgtagagctaatctgtccctaagtaagtttcttccgctcctttgtatcttcctttctggtctttcctcctacctttgtctctggtgtttgggatttttttttttttttttttttttttttttttttttttttttttttttttttttttttttttttttttttttttttttttttttttttggtggttcccactcattttttcacaaaa

SEQ ID NO: 612074 - DNA, 336 bp, Homo sapiens
  misc_feature (57)..(57): n is a, c, g, or t
gagatggggtcttgctctgttgcctgggctggagtgcagtggcgtgaacacggctcnactgcagctttggccgcctaggctctagaaattctcccgccttgccctcccgagtatctgggaccacgggtgcatgccaccatgcccagccaagtttttaattttttttttgtagagaggaggtcttattgtgttgcccaggctggtcttgaactcctgggcttgagtgatcctcctgcttcggcttcccaaagtgctgggattataggcgtgagccaccactccagtccctgactctgtttttgatgtttaactgctgatgactcctctttttttttc

SEQ ID NO: 612075 - DNA, 1176 bp, Homo sapiens
tgggagcaatctacaaacatcttttattagcaaaaggagtaagtgcagctaggggagaaagaggggctcctccttcccctcaaaggcatcacgtgccccttcccagggggcaggccagcagggaacaagaggaccccgagggttgcaagcaggcgtggaatcagacaaaaggtgatccgggttccgggaagcatggaccgtgccagacattgtgagctcctcatattcatccagagccgccgggaacggggcggggtgtgaagccaggagattacacaggcgcgctggtctggcctcaagagagaaccgggacacttcgggccccctggagaccaggttcacgggacggggggcaaatatcacatctgggtgggtctctgagagtccaagggtggtttggcccctgggtctcctagaaagaaggagtcctgtgggacatcgtcgcattagccgtggagtggcttcattcgaaatcttactttactccaccaaatccaccattctcgagaaggtgccagaagccaggggaaagggggcaggatagccacgcagggcccgggcagacagtatagggggcatcccttcactagcccaagtctctcggccacatctccacggtatgctagctgggaaagtaactccagcacgaagaactcctgggcccacgggggcagcgtacacaccagagggacaaaagggggcatattgaaaagacaccctagaagagatacaggcgcccaccagggggtcacacacggcgagacgccggagcgacccaccacatgcgagcgacgccaccacacacgtcatgctggcgcgccccacacgagtgactactagccccacggagccgacccctatcaaacccggggggcacaacccgcagagaaaaaggggaagcagagcgaaagcatacttccccagccggtccagcgacggggtgaacccccccgggcggcgggcggcgacacccaccagaaggaacgcacaagtgaggaagaagcaacacccgcacagaagaggggcgccacaccacccacaggcggcaacgcgcacacaccggagatccaaaaccagagacgacagaccgcgagccaccgacgcgataggaccaatcagacaccaaccaacgcaacaggcgaccagcaggacgaacatacggccagcaaagacgcg

SEQ ID NO: 612076 - DNA, 853 bp, Homo sapiens
atccctcgggtcgcgcgcgcactgctcgcctgcctgctggcgtctacgctgttgtcgctgctcgtgttcccgcgcggggtcgcgcggtgccgggaccagcggggactgggactgagtgcctcccggctgccgcgctaccaccccggcgaggacgcggggcgcgtgtgccgcttcgtgacgcacgtctccgactgtgggacgctctggccacacatctccacgctggaggcggtgcgcggcggcccttcgccgacgtcctctcgctcagagacgtggcccccggagcgcgggcagcgggtgccctattatctacctgagcccgctgcagctctccgtgagcaacctgcaggagaatccatatgctacacatgaccatgactttggcacagaacaaattcgtgcaagacacatggaatttgatccacaaagtccccttttgtgttcacataatgctgtcaggaactgtgaccaacggtgaatgcaacagaaatgcatattgcacaacgcatccgaattccatacgacaccctgagatgaacaacctgggcttccagccatactaggcatctttgctacgtagcaatatagccaaatattatggggtcccaggaccaaccaattggttggaccaaagctcgttgacccagagggaatttttataatgtcacagctcaagtgacagccgaactgtggtgaacttaggcacactttttacagtttcttagcactgctcatacccacttaaacacggctaactgttctcttgcaacagtgtcccgaatttagacgtttctgcacatgctatctcttgacgtgtaattgctgcccccactagtgccattctgatccgaca

SEQ ID NO: 612077 - DNA, 234 bp, Homo sapiens
agatggtgcagccgctaattaaaggttcgattctgttcaacgatctgtacaaggtcctagcgtgatcgtgagtctgcagaccgtgagctcaagttcgcgaggtcggtcttgctcatctacttgccatacatcttcctctctcttggttcaccggcacaacggcagctaagcatgaagattagacgtgcccttatcatatctacaagacgctgtctctgttgctctctcacagat

SEQ ID NO: 612078 - DNA, 673 bp, Homo sapiens
aacaagggcttcacagacagcaggcgtcttggctgcccacaagataatggctagctccccagcacatggacctggaccacagatttctgctctcaggaagatgggggtgaagttgacaccccacaacaaggagacggtgcagcacagtgatgtgctcttcctggctgtgaagaccacacatcatccccttcatcctggatgaaataggcgccgacattgaggacagacacatatgtggtgtcctgcgcggaccggcgtcaccatcagactccattgagaagaagctgtcagcgtttcaggccagcccccagggtcatccgcatgcatgaccaacacatccagatcgtggtgcggagagggggccaccgatgtatgccacaggcacgcacgcccaggatggaggacgggaggctcatggagacagctgactgagacagacgtggagctactgacaacggaaggatggaagaggacctagattgatgccgatcacggggactcagtgagcaagagagacccgtctacggagactgcaagtaccatggactgaccaggagcaggtgtcaacagccgccatcaagaagaccatcctggacaaggtgaagctggaatccccagacagggaccgaactagaacccatactggacacaccagacagtcccccaaaactgg

SEQ ID NO: 612079 - DNA, 815 bp, Homo sapiens
  misc_feature (589)..(589): n is a, c, g, or t
aacttgaatagcccttcctctggactagcttacttgaagctccatgggtagaccctaaccttggaagttggtagccagtgccatgctctcgtctccacgcagaagttgtcatggacccagctttggcggcgcagtatgagcacgacgttagagggttgctcagacgaacctgctctcccggatgaggatgatgacctgtgagaatgaaggctggagcccagcgtcacgaagtctagttcaataggcagtgtcctgtgatgtcagcggtgcagcgtgtgtgcctagctcattattatctagctacagcggaacatgtgcttacaatctgtgtggatgctgagggagatgaggtgggcttcggaggtgaatgtggagtgttagacaatataactgcagtcgtttggacctgggatatttagctgtgtcttggaacgcagtggattccttgagtttcatatataagagtgcgtgcagtcaacatcacaatattcaggggtgaaatcttgttgtgactgtcgattcccattcctttttcggtctaagaactcacgaagtaacggtggcattcccaagggagggcaaccctggnccaacggccgaaccccaccccttgcgtccgccgccgcccgcgccaaaaagattcagaaaccatcgttgggcggacgacactcgtacagtggactactggggcgcacccctggagaacagtgcccgcgtgtgtgttttcttccaacataaccgcgcggccccagccttcccacacacgcggtgtctcggcgctccggatcaactgccccgactcatttacccccgtg

SEQ ID NO: 612080 - DNA, 347 bp, Homo sapiens
tccaaagcaaacacacagatctcgaagtcgggatcgaagcagactcaccacagccgggatcgaaacgtcatataacgcacaggagcaacagtcgggacagagcaacaagatagaaaatccaaggagaaagaaaagaggggctctgatgatcccccccgtagtgtgacgtccggtagtcgagaaaagcagagtgaagaccacaaacactgaatcgacggaaagtgatactaagaatgaggtcaaggggaccagtgaagacataaaatctgaaggtgacactcagtccaattaaaacggatctgataagacctcagatcagacagaggtaaagtgtatggtatctcact

SEQ ID NO: 612081 - DNA, 1541 bp, Homo sapiens
  misc_feature (303)..(303): n is a, c, g, or t
tatggcgcattattgactacgagaccagacagacagttggcagacgagtcgagctattgattcggggccgtggacgctgggagctagcatatagtacccctgctcctgctcctgatacgctcccgaaccggatcctccgaggcagggcgtgcttcagagtggtcgaacaaattgaccctgcgtggtcgtccaggggccgtggcgataatgtaatcaactcttctgtcatcacctgaactcactccactcagtacatcgtgaccgcattgcgacggccgtgactgaataccactctagatgatncggtgaccgcctataatcgagcggattgcccccggactagtaaggccacaaaaatacatgggtgtactcgaacttcattcatccccccctcgtgcgtacgtctcttaagcttgccatgggctcaagcgatttcctgcgtattgaggtagcaacggcctgaagagccgtattcgagcggtggatagtaggctttaactcgatcctttgttatgcaagtgccaaacgaagttaacccacactccgcttgggactgcactgcaccgtgagaaatacctgataccacaggtactctcactggtctttctattcagtcccttagtgacaccgggtagtttctgcgtctgcatagtcctttatcgcgtgtggccactcaacggaggttgtgcacttcacccttagtcaactttactgtcaccccttactgaggagagaaggctctcccttggcacattcaaagccacgagaatacgccaggcattcggccccgccgtgctttgtacagctgcctgcgacctcgttggttttcggtacaacatcgtacgttaggcgcaggtgcgcggtatagtaataactctcgttcactttttcgttccgcgaaactcccatgcaccccatcgcctgggggaactcccgcacataaacttcgttactaaagacgaagggacacgcgcggaggacgccttgcgagagcgacccagattcatgttccatattccgaaaccaccgccgcttagggcaagagaagcgccattaaacccctggattttctcaagttaagccccacggaaacgctcattctctggtggcagttccttgtccggcggatcccacccccgtggaagagagttcaacatgattggtctattccccctaggcgaaagggcgttccttggaacattggggtaggtcccccgaaaaattgggcctggaaggtgtggaccgtagcgtttcccttgggaacttcccaagagcgccccttaactccccgttaacttatccggggagagtttggggcggtccctggcacagcttggatgaaatccctccaaaattgggcgtttcccataaaagagtttccagaccggtgggtcgccagccccccacggaaaaactttgcaacgggttggagcccgaaaaatttgggtcgcgacgcggcgggccggcgctattgggcagcctgcgcgcgcccatagcagaagtgggttccctacaaataggttccccggcgggacgtatac

SEQ ID NO: 612082 - DNA, 234 bp, Homo sapiens
atcgacgggcgctctcactcagatgtcatgagaccagttgactatgatccaaagacatctgatccttgcaaggaggcgggacttaagtttgctactggggacattatccagattatcaacaagggtgacagcaattggtggcagggacgggtggaagggctcctccaaggagtcagcaggattattcccttccccttagctgcaggatggcgagtggcaagtatggctcattca

SEQ ID NO: 612083 - DNA, 443 bp, Homo sapiens
gattctggataaacagatggctgctcaccatctctgagatcctgttcctcaacaagcaggatccgctcgctgagaaagtccttcctggaaaatcgaatattgaggactactttccagcgtgcgctcggtacactactcctgaaagatgctactcccgagcccggagacgacccacgcgtgacccgagccaagtacttcattcgagatgagtttctgaggatcagcactgccagtggtgatgggcgtcactactgctactctcattacaactgagctgtggacaatgagaatatccgacgagtgtaccacgactgccgtgacatcattcagcgcatgcaccttcgtcagtacgagctgctctaagaagggaacccccaaatataattaagagccttaagcacaattaattaaaagtgaaacgtagttgtacaagcagttcatca

SEQ ID NO: 612084 - DNA, 357 bp, Homo sapiens
  misc_feature (12)..(12): n is a, c, g, or t
  misc_feature (36)..(36): n is a, c, g, or t
  misc_feature (47)..(47): n is a, c, g, or t
ttcccccagggnttttttccttgaatctttcacggncaaccaaggantcagggacacgtgtgaaggcacggggcacgtcaacagagacactcaagggacacatggggacacacattcctgcaaacacacacacagatgcccagacaggcatacgggtgaacacacagagacatggatgggtacacactcagaaatgcagacactcacagggatgcacaaacacacgggccacacacatgcaagatgacgccaacgtgcacgcaggcacatgggtagacctagagtgtgcatggacacctttgggaacaggcagacacagaccaaggccctccgacacccagaggacacacacatgca

SEQ ID NO: 612085 - DNA, 130 bp, Homo sapiens
gctgaaaagccatctttgcattgttcctcatccgcctccttgcccgccgcagtcgcctccgccgcgcgcctcctccgccgccggggactccggcaggtttaatcggcagagttccctgaactctcggttt

SEQ ID NO: 612086 - DNA, 150 bp, Homo sapiens
caggcttaagcaatccccctatcctcagtcacctaagtagctgggactacatgtgcacctcaccacacctggcaaatttactcagtctggtctgaactcctaagttcaattgatgctccttccttggccttccgaagttctggtattaca

SEQ ID NO: 612087 - DNA, 328 bp, Homo sapiens
  misc_feature (101)..(101): n is a, c, g, or t
  misc_feature (125)..(125): n is a, c, g, or t
  misc_feature (133)..(133): n is a, c, g, or t
  misc_feature (138)..(138): n is a, c, g, or t
  misc_feature (164)..(164): n is a, c, g, or t
  misc_feature (258)..(258): n is a, c, g, or t
  misc_feature (269)..(269): n is a, c, g, or t
  misc_feature (288)..(288): n is a, c, g, or t
  misc_feature (323)..(323): n is a, c, g, or t
gctactaaaaatacaaaaattagccgagcgtggtagcaggcgcctgtaatcccagatactcaggaggctgaggcaggagaatcgcttgaaattggaagatngaggttgcagtgagccaagatcanggccactncactncagcctggggcaaaagaccaaaactncatcttcaacaacaacaacaaaaaaggagccgggtgcagtggctcacgcctgttattcccagacatttagggagggccaagggcggggacaggntcattgaggtncagggagattcgaggaccntcctcggggtttaacacgggttgaaaacccccttnttttt

SEQ ID NO: 612088 - DNA, 580 bp, Homo sapiens
  misc_feature (37)..(37): n is a, c, g, or t
  misc_feature (81)..(81): n is a, c, g, or t
  misc_feature (98)..(98): n is a, c, g, or t
  misc_feature (410)..(410): n is a, c, g, or t
  misc_feature (465)..(465): n is a, c, g, or t
taaatatctgcactcatcaaagggaatatagcaaatnttgatcatctgtcagcagttttgcatgtgacacctttatatganttattttcccaattttngctctatgtaatgggtcaccataaaactgtaagacttggcaaatgctatagaaaaggttcaggtttcagtattctctctgaaggcatcattcctgggcttccggcagcatcacacgcttccagtgcctgcggggtgagggtgtgtggcacagaggcaagcagctcctctcttctgtagggagctttgggttttcagagggtgcagggaaggcagtttttacaggttaccgttaaaacagaggtttccgttccagtgttccttatgatgcctccccatttttaaaaaggaaaagaggattcttatgggaaaantggggaatgtaatgtggggttctgttcagagcttcctacagagcaccagttgccntttaagttttccttttaaaaggatggtaaaaattattggtattaattaccagttttggtcccctaccaacaattggtatttttgcccaaggctttaggtggcaatttattggtta

SEQ ID NO: 612089 - DNA, 848 bp, Homo sapiens
ccacagcgctcgagtgaccgcggtgggtgatgcgtgccccatgtgggagcccgtagtcaactggagggccacaccaagcgtgtgtgcattgtggcctggcacaccacaggccagaacgtgctgctcagtgcaggttgtagacaacgtgatcatggtgtgggacgtggtgcactggggctggccatgctgacacatggttcccagattttgcacccagacacgatctacagtgtgtgactgagagccgacgatggaggcctcatttgtacctcctgccgtgacaatgctgcgtgcgcatcatcggagccccgcaaaggcactagttctgtagctgagcaagtgaccgtaccccacgaggggacccgagaccgtgctgtagcaagtgtaacgtaggtacaggatggggcaagatcctgaccacgggaattcagcggcatgagtagagccggcaggggtggcagcctgcttgcgtgaccagaaaacggctacctggaggcagcccgcttggtcccttgaaggaagcctgggacaaccaaggcaagacgggtgtccatgatgccactaactttagaccctagaaaccaaaatccgtctaccttctggaggggccaatgggttgaactgtctacaatcgcgggtagctatgaagaattcactatccgaaggaccccctattgccttgcaggtaatcatcgtaaaatggtaaacaggagccaaaggaatgaacccagatgtggacatttggggctaacgtgtgccataacggtgagccgtggtaggatacacacatgttagaatagcagagtataaaacctggacagtcagatgtgtgacccaattgccagaag

SEQ ID NO: 612090 - DNA, 968 bp, Homo sapiens
  misc_feature (110)..(110): n is a, c, g, or t
  misc_feature (830)..(830): n is a, c, g, or t
cgtgcaccttatatttttctacagagtcttttagcttccccagtaaaaatatccttttcgctgcgctcactacaacttaatcaaatttccgctgtcacacgacccaccgnttactcttttccgtatcaattgctcttaacatacatctgcaattctcccgttcacaataacaagtattgcgtgcgccaaaatctgttggccctttattgaaaatggcctcatcgccaccccttgggatcataatcccatggcccacaacattcttggtctctgcatgtattcatcactcatcatatcttctttccgcccccaaagtgcgctgcccctctggtgaacgtaataaaaaaggggggaatcacccacaaacggacgtccccaccaatctgtggaggcgcccccgtcacgcaaaattgatgtattgtgctgtacaattctcgccgcattgtatggaactattgattgcctctgtgctacaagacaggacctgatatgaccccccgcctcctgctgtcagccgcaattctaatacggtggggaacgtgctcatgacgcccgtgcgtctaaccccctctgataagagagggcaaattgcctagcgatttctctgcggagatgtgcacacactgtaagttaaattctcttgctccggcgtgcgggacaccaacgaaccgccttgtgcaggtactcgcccttttggtgcgaagaataaccactggccgcaacagatgtgcagctctcctgagtatagacgcgagccattgacagttgtatgacgcccgccgcccagtcttgtatcaccgcacgcgagtatttcccggcccgccttctanacaaagctgtgatacaggatttgattggtcaaaagagccacgcctatttcagggaagtcggagaacgcaatggggaacacgcagtgtcctcctcatcgggacaaaaaacaaaacccccttaaaacaacaaacaaaaca

SEQ ID NO: 612091 - DNA, 514 bp, Homo sapiens
aaaaacaaaatttaagggcttctaggagaaatgtaggagggaaggtgttactgggaaatatgatagaaggttaatttttattttattttatttttagagaaagggtcttgctctatcgcctaggctggactgcagtggtgcaatcacagttaactgcagcctcaacctccagggcttgagcaatattcccatctaatttttattttgtttaagaaatgcagtcttgctcttagcaaagctaaagtgcaatggtgtgatcatagcttactacagcctcaaccttctagactcaagtgatcctccagtcttagcctccccagtagctgggactacaggtgtgcactgcaacgtgtagctcatttttttatttttatttttagtagagacaaagtgtcactatgttgaccaggttggtggtgatctcctacactcaggtagttctctcacctcagccttccaaaatgctgggattacaggtgtgagctgccacacctggctgagggggtaattttta

SEQ ID NO: 612092 - DNA, 459 bp, Homo sapiens
tcctcgtagcagttggggtagtactcgacctggtgctcgacgccacctggacgcaggcgacgtagcgcaaccagtcaacacggtgctgaaaccagctgcgatcagcagcaggtgacgcttggaaaccgccttacgggaagaaagcatagatgtgatctctgttaagtttgacttgcccagcacggcccaccgccgcctgagtcccttccaagctcgctagacagccaacgatcaagaccgctgaccgctcgctgcgagcaattccttcaagatcgttgccgggtcggcccgctgttgcttgcggtagttgccaacatggtgaacgaacagtgtcgcgcgcgtcaccgggctcttgccgagcactggcttgcgatccaactcttccttgatccgttgaaactgcgcctggatcaccgcatcggtgtagcgcgtgccggtggccaggttgtcgatgtaaat

SEQ ID NO: 612093 - DNA, 877 bp, Homo sapiens
ggagatagcatggagtttacctcgtagacttcttccgattggccgaccggacctcagcacgcttacgcattccatacgtgcgcgcggaggtatttagctcactcgggccaggaagccagctggatcccgaggataacgcacgcgactgaagcgcgctggtggaggagggaactcgctgagtgattcaggctgtgagtgaatgctctgcttccatgtggaatgacaaatctggaccttagcgatgaatggcgtagggagagtctccgcagacccttgtagcgacccaggtagagaacagaaggttccgaattcaggattcagggagtcgcgcatatccgtgcatcttaatgccttccgaggtccctagaggtaccttttgtgcaaccccactctaggcgaataagcagactggggcgtgggccgacatgcaccaggtcagaaccagttcctaaacgatgtgaagaagtcctaaagggcgaagctctcaataggccacgattgaagagacggaggcaagtgagtgaccgggaaaccctgtggcaagaagagggaacccctttgcctcccgccaacatgtgaggcgggtgaaggaacgccgcacgaaggcccaaggatggacggggaagcgaccgcgagcaggacggtgacggttaaaccacaaccgcgcgaaaaggactagaagagataggggcacatgccccttgaacagctgcagtgagtatcacaaaggagaaccccacgcagcaggaacgcgcgcaagcagttgaacgtatcggggcaaaccccatgcgccggctgggaaagctcgacacaccacggacagaaagaacgggcgaacggcgacacccccccctacgaagaagagagaacgggcaca

SEQ ID NO: 612094 - DNA, 529 bp, Homo sapiens
ttggggctcattcagggtctggggaaattccgggcttctcctaaatcagggggaacggggcctccaggatcaggtcgggagcaggcccaaatatagtccgggatctgccgggattaggtgccaaggtctgagtcggggttccagatcaactccagaccccaggcgggatctggccccattggagttctgattcccctgggagctgggctcggggcccggggccagcatctatcctggtgtggcatcggtcctgagcgggtccgggggcaccatgcatagttagtgttcttggtgggcccaccaggggggggctgtccagagcggccaggtcttaactccccaagttccaggttcttagcggggggcttctttggaatctcgggcaaggctgaggacagatcttggcaggtgggagcgggacaggaagtccttgtggcatgtcgggcccaaagaacggtgacgggatttcctagttatctttccaagttgtttcaggaaactctccaaattgccaaggcttcagggaggc

SEQ ID NO: 612095 - DNA, 785 bp, Homo sapiens
ggacgctgcttttcttgctccactgggggtgcctcttcctgtggctgccgccgcctgcatcctgctcgccctgtctgggaatggggcctgccccggtgcttgtggccggcctggctggtgccccgcgaggcgcttaccgcacccgtagtgaccgccatggtgccagccaaccccaccaggatgaatgggctggcagagtgtgggactctgggcgagcaggccccgactgaaccctgagggctgagacgccctgcaggatcaggcaagataaccagggagttcgtgccacacgctggctacactgagaccatcaatagaggggccacgtcacgcacatcgcatcgccagggcagcatcacgattgcacagccagcatcaacacatcaggcaccgggcacacagtcaacacgtttaccaagacagagaacagatcttgcctttgatacattcagcggcttatccgcccaactgagatggagcccatcggataggaatggatgcatgccttgcgcaaaagttgacgccacagaagataaccccacacaacgagcctcagaagcatagagccttacacgtggccattgcaaccccacccaggaagcaatggagggcgcattgatgcccaaccgtagtaatcgcacgctccgaatggggctcctccccggggcggctactcgaggaggcgccccaacagctggaaacgagtatgtggaccgacacgagaaatccaacagaccactccaaagcacatcgacccaccccggcagtcgagcaccgcccgaaga

SEQ ID NO: 612096 - DNA, 214 bp, Homo sapiens
tagcaagaggctagcagtgaattcattctactcatactacacacccagattatggaatgtccagagcttctcgaagcaaaataagtgactttacgaagaggtataccataatctcaagctcgctctgccctcgccacactctgcacagctcacctgcccactcatctcttacagcccagcactactgagaacttctgtctggcaacagtgggac

SEQ ID NO: 612097 - DNA, 104 bp, Homo sapiens
gtccagcggagtgttacaactcaggtgagttttagctttattgggggagggggtgctctagaaccactctttacgccggcttcgtattcacattcagggggtgt

SEQ ID NO: 612098 - DNA, 164 bp, Homo sapiens
aaaaaaaaattttcccggggggggggggggggcccattttttttttttccccccctcgggggggtgggggggggggtttttttggcccccgggggcccgggcccctgtggccccttttttttttttggctttttgggcggggcgccggggggggattttgtcca

SEQ ID NO: 612099 - DNA, 1329 bp, Homo sapiens
gttttttttttttcatggttaataaaaacatttatttggcattttatacagaacaacctgaagtctccatcatgactgtgacagttacccaggggttttacaggtggtgttccaactcaacaggtggtggttctgggacgtgggttatccacacaaacacaggcaggagtttgtggaggaaagagtgggggcacagcaggaggtgtatcttaactcctttctcaaagaaaaagaagttaaagcattctcgtgagttgtgctgaaaaccgtggtgcaaagtggggctctcgtgaaacattgtgtacgtgtgagcttctcagggaacagggaggcaaaaagaatgttgtgataaattaaggcaggccaactttcttggaaggcaggggacacgaggaagcggaggctttacttatttttttaagtgcccctcagccccgagttaccgtgaataattccagaaggggagaaccaagtgttcgcaatctttgtgaaatctcaattctcccctgtgtgtctcaaacaacagaagggtgcataatataccccccgggagggaccacaagaacctcgtgacaacatttatctcagtgcgtggctccatatccccggggagtttctctaagtggccccccaaagagcccactttatctcacacaagacaatcggggagctagagagatgagggcgcgcgcttgagccgagcaagcggtccccgacaaaagggctccacgtgcggacctgcggctaaattcaacagtgggtcgcgcaacagcttcacaacaaacacaaccgttataggattccaagcacctttaaaaggccccacgctggaatctacaaaaacccccccagactagcaccgtgggggtcccgcacacacgaacttccttggctatgaaaagaggcggtcactacctcaggactaacgcgggaccccaaaacaagggggcgagaaagggctccgcaagaaaacacttcccctcctggcccttgaaacggctgctccacacccgagggtgttgtcagcaaaaacagatctcgggccagacagaaagcgctggacaaccataactaacaccgcgcctaacaggcggccacaaccaagaagaacccctctcccgccagagcccggtaaaccttcaaaagatggacatatgcttatcaaagaccacaaaccctacccccccattggggcctcacaagcatcacaacacaaaggttcgcctagagcgctaaaggcacaccgtggcactccttaacaacaactcgtgtgcccaagcccggccacacgcataccccacaggacctctctacaggcagagcatccac

SEQ ID NO: 612100 - DNA, 116 bp, Homo sapiens
cggcacgaggtgtgtcaacttttttacaccgactgatattaacttggatttaccccacaatataatttggagaccctttgttatccaaataaaattgatgagtttctgtgcctgta

SEQ ID NO: 612101 - DNA, 348 bp, Homo sapiens
cagttttgggtgcgtttcttaatcctgaggtctagtttgattgcactgtggtctgagagacagtttgctataatttctgttcttttacatttgctgaggagtgctttacttccaactatgtggtcaattttggaataggtgcagtgtggagctgagaagaatgtatattctgttgatttggggtggagagttctgtagatgtctattaggtccggttggtgcagagctgagttcaattcccagaggtggaatctacagaggcaggcaagcctccttgagctgcgagatacctggtcatcttgttcgagttgagccacagggcacttgtactgggccgtgctgaagagg

SEQ ID NO: 612102 - DNA, 103 bp, Homo sapiens
cacctttgtttaatcacactgcaacacacatgcacactgcattaacacatgcacacacactatgcacatgcacacatcacaaactcacatgaccatgacatgc

SEQ ID NO: 612103 - DNA, 606 bp, Homo sapiens
agaacatgtcattcacaaaattgtgacctcacagcattatttacaatactgaaaatctggccaagtagcctcagatttctaacatttggcagaaggtacacgtaaatgataagactacacaataaaatatattaccagcaatatatctgtgtgaaaatctattgtaaccacacattatacttagtaaccgagcacataaatgacatgctcgtgcactagtgatcagcacaatgcaaaaaattcacacccccgaaaaagacaagatatgatatggcaatttcgtggtaaaatattcatgtatttgtgctgcatttctaatatgtccgtaactgacacatcagttttataattaggagacaaatacctttttaaagtaaagcgaacacaagattctttagcaatgttcataccatcccacaatagagtctagagagtcacaaaaacctcagcctccttcgagagtgggggagcttggtagtgaaaaaaggtcatgaatgactgggtgaagagagggatgggacaacctagtaggagggaggtagggataggcaagggaaaggtggggaccagtagtcatactggcaggccaagtaacggtgcagacga

SEQ ID NO: 612104 - DNA, 478 bp, Homo sapiens
gaaagatcaagaccctggaggtctctctaaaattaagaggccagccaggcacagtggctcatgcctgtgaccctagcactttgggaagctgaggcaggaggatcgcttgaaaccaggagtttgacatcagcctgggcaacatagtgagaccccatctctacaacaagcaaaaatgaaaaaaattacccaggtggcatgcctgtagtcccagctacttgggaggctgaggcgggaggatcaattgagcctaggagctcaaggctatggtgagctatgatcgcactactgtactccagcctgggtagcaaagtgaggacccatttttgtttttgttttttaattttaataaagccaaatgaccatgatcaggaaggtgaggtcctgagcaccccgaaggaacaggaggtggccacagaggggtgatgtgtttgtgatgtgaagaaacagtggatgatgacaaagccctcaaggaaccgag

SEQ ID NO: 612105 - DNA, 160 bp, Homo sapiens
acccatttcagttttttggttttgacaaatgtcccctggtgatgtaaaatttttcccctggggtagggtgggggaaggggaaacaggaactctttgttctatttttgcaacttttctgtaaatttaggatccttcccaaataaaagttttttttttttta

SEQ ID NO: 612106 - DNA, 339 bp, Homo sapiens
  misc_feature (6)..(6): n is a, c, g, or t
gtattngactgtctcgggtgaaatcatgtagtttaaaaattaaaaagacattaatccttcaaaacaaatagaaatcaaggaacaaacacaaactctttcaggaagctaggaaatatctacaactaacgatgaaggaccatggacggaggatagcacagggcttagcagagcagaggaatagtacagtgtactttgaccgaacgcgtgcatgcagatgtgcagaaactgctaggtggggttggttgatgccgattgtcactattatcaagcctacgtggcttgaagttgacgacggctaccgacttttttggactactcatttggtgtgattgcacatag

SEQ ID NO: 612107 - DNA, 1263 bp, Homo sapiens
agcggttcagcctgggtgacagatggtaagaccctgtctccaacaaaaaaaacaaagaaacaaaaaatttccaagctcccctacttgcgttctcgagcccttcgggggttgggataagagccaagaaatcctgggaactcctcatattatagccattcacaagaactaagaatcttgagattcagtggcaactgttgttgcgaagacttctggaagatctccgacgttagtgttacttcagatacgtcacgggctcacgtgctctttgtgcgcacgctccagaatgatcccatggcctcgaccagcccgagaaccgtggcagacagacagtttcctcagccaagggcagattgttgtgtcccttgtagactccccattgggggaccggtgttacaagggcagagcatgctgttggcgctgtggtgcgcctgggggcgtcccacgctcttgtctcgactcttatgtgctcctggcgtcttcacacctctagaaaggcctttgacagtggttcatcaccatcaggtggggccgcccagaaaaaagaaaattttctcgcctgtcgtcaaatataaacggggtgaaaacttggagacgcagccatcagcgactcaaccacggtggcggcacctttaaggggagcgcacctgtttactaatacagcctgcagatatagtgggggctaagaaacatatcagcttttacgcacacaagagaatctcttttgaacacggttaaatctttggacgcagcatcaggcgtgccaatatgggtcttcttatccgtggatgcctctttttgtgagcggcaaacgcaagttaacttctccttcagcgtcgtgcttagtgcccccgaaaagaggccgttggcgaaactgtgtccatctcgcggcgacagtttgtgactcccccggggctctccctgggtggcgaacaatccttctcttgtttgtgttctgcccccgcggttttgccagagtgtgtgacttgcttggggggccttaacagggcccgctccccgagaggtttaactcgtgggtaagcaatctgcaccggagcattgttgtttccgcccacgccgaaatctccggggggtgatacgacttctggcggctatactcggtgaggatcatacgcaagcggggcggttgttacccacccatttttttgtggcccccgggtgacgtgcgtcttcaacaggcccgtcggtgcgacccctttgttggatcatcccggcgcccgctttgtggcggcctccccccccgga

SEQ ID NO: 612108 - DNA, 326 bp, Homo sapiens
tggggggttggaagcctacacatttatagctttctctaattacacaggtaggaaattataaaatcaggtacaagggctgggcaggggcctaaagcttaagtgatgaaaaaaaaaaacaccaccccttgtggtgaacccaatagctttacgaaaaagtaaaaaaaagcgcgatgcagggggagctccggtagctccttggaggtattggagaggctgagctcaggaagagggcttgagcaccaggagtgggaggtcggtaagtgcaggtgagggtaaacggccgcgtgtactccagtcgggcaattgtagtgagacccgtgtctctc

SEQ ID NO: 612109 - DNA, 222 bp, Homo sapiens
  misc_feature (14)..(14): n is a, c, g, or t
  misc_feature (63)..(63): n is a, c, g, or t
  misc_feature (69)..(69): n is a, c, g, or t
  misc_feature (89)..(89): n is a, c, g, or t
  misc_feature (119)..(119): n is a, c, g, or t
  misc_feature (122)..(122): n is a, c, g, or t
  misc_feature (138)..(138): n is a, c, g, or t
  misc_feature (143)..(143): n is a, c, g, or t
  misc_feature (155)..(155): n is a, c, g, or t
  misc_feature (184)..(184): n is a, c, g, or t
ctgtcatgagattnggggggggggggctttttatttgtcttctgccatgggggcctcttagtnggtgtncttttccaactcccctttgnttttgaagtttgccagccctgacttcgggncangcggccgagcagagtnctganaggccggtcgtntggaagaggccatgctggcccccgccgcnccccccccccccctgctttcctgctggtggcctctctg

SEQ ID NO: 612110 - DNA, 660 bp, Homo sapiens
  misc_feature (407)..(407): n is a, c, g, or t
ttttttcagtggggaaaaaaatctttatttcaaagtaaaaggcccaaagtctcttacagcaaataaaatcattgttactgctctcagatgttaagcgttagcaacctttttggcgtatgctaattcatcatgaactcccaatagctgaactgaatggcttttaagtacagctataaggtctcatggcataattccttttgttgatgccagtgacaggattttaaaagctacattccattaaaaattaaaaatacagcagcttttccaggggaactagatcccaaaattgtacccagaactcttgttaagatattaagttaaatatcttgcatgtatatatcattatagtaaatcagtattcttgacaaccacagtgtaagaaattaaactttggctaattgtttccncatcatgaaatcagccttttgctgcttcataaaaaattatgaccaaacattcaaatacttatacatgttactgattacagagatatttaataatcagacttaccagtttcatagttttgtcctttaattttaagcatataaccccggtacaaaagtttttaagtaatcaggataaaactgggctaaggttaattccttggaatgaaaaaaattgaatttgaaattggtttcaggtttgaaaattaaagaattt

SEQ ID NO: 612111 - DNA, 207 bp, Homo sapiens
gaagataggtctctccggtttcatgtcaccttccacctattgcgggaggttagcccattgaggtcctctcacatgtctcgtcctgtcgttcctgtcgtggatgtcggagtcgtcgtgggactgcgactcgtttcgtctgatgctctttgttgtttcagatgcggacgcttcatgggtagtcccggactcgagcgggcagtgtttctc

SEQ ID NO: 612112 - DNA, 379 bp, Homo sapiens
ctcccggcaatacattctgtcttttttggcaccatggcagacagaaggctttttagcgcgccaacactcagggtaatctgctataataggcccgaatctccaatgtatatttcattcacagcttgcgtatttctccttcggtgttttaggattacgcgattaggccttcgggtgcttcttctgggggagcaatgcccatactgcaagtcagccaattatgcagcagcgcaccaaggagagccaatagcccacgcccctctatcttgtgaccctagcgaacctggtattgctttcagggtctggtacccgtatcaagtgtgcaggtatgctgcatttgcgcgatgcggtgcacacgctctaaagctccatcttgcacagc

SEQ ID NO: 612113 - DNA, 190 bp, Homo sapiens
ggtgcggagcgtaggagaggtaagtatgagttagtggggtggtgagtgtcaggaagaagggcataaaggactaggcagcagataaggaaaatgagaatgagggcgtgatcaggaaaggtgataagcgcgactaggataggggaagtagcgtagggtagtcccacgtacagatcgacaaggggatccacaa

SEQ ID NO: 612114 - DNA, 234 bp, Homo sapiens
cgtcgacatcttgacagccaatgaaaaaaatattatctcaaaagcttgggacaaccgctacggggttcttatggtgagtgagctagcagaagctctttcaggccaaaaactcggaaatgaactctatcttggctctaacgtccaagaagaggttggtctccgtggtgctcatacttccacaaccaagtttgatccagaagttttcctagcagtagactgttcaccagtcgacgc

SEQ ID NO: 612115 - DNA, 470 bp, Homo sapiens
  misc_feature (51)..(51): n is a, c, g, or t
  misc_feature (85)..(85): n is a, c, g, or t
  misc_feature (132)..(132): n is a, c, g, or t
  misc_feature (142)..(142): n is a, c, g, or t
  misc_feature (149)..(149): n is a, c, g, or t
  misc_feature (176)..(176): n is a, c, g, or t
  misc_feature (196)..(196): n is a, c, g, or t
  misc_feature (203)..(203): n is a, c, g, or t
  misc_feature (230)..(230): n is a, c, g, or t
  misc_feature (333)..(333): n is a, c, g, or t
gctgcgtccgtacctgtcaggttggagggcttcaccagccaggaggacagnagatgctgaccgcatcgagagcactcaagcgccngccattggcccccaggtgtctgagcacagctcatcaggattcaccancagaataccngagcacnccatccacaaggtgctgcagctcatgntgtcggcgcggcgagatccncatcgcntgcagcgcaggttctctaccgcctcantgagtcgcgccgcctcatggatcatggactcgcccagcctcgcccctctgccgctgcctgccattgacaatgttgctgggacctctgcctccccatgcagccntcgaacttcccaggcaccctcctttctgccccagaggaaggagctgtagtgtcctgctgcctctgggcgcccgcctctagcgcggttctgggaagtgtgcggcatccgttaataataaagccacggtgtgttcaggg

SEQ ID NO: 612116 - DNA, 192 bp, Homo sapiens
gggggggggggggttatgcttctcccccaccccgtgtttttttttttggattccttttgggaaccgggggtttagggtgaggggggggtggggtgccccaatttttttcccccctttccttcccccccccagggtttaaaaaaaggggaaggggtggtaaccggaaataaaaacctccgattttccgcccca

SEQ ID NO: 612117 - DNA, 206 bp, Homo sapiens
tggtgcctgggccccagcttccggccgccacccggccctgttgagtgcggcctccagactcgagtccagaatctgtttttgtcaagtcagttgtccccagctgcacacggggactgttgagcgctgcgctctcccgggtttgttccggacaaagggtggcaggggtgagccctgatccctttcaaaaaataccagcttcccaggga

SEQ ID NO: 612118 - DNA, 577 bp, Homo sapiens
gccgtaaggctgccagtgcataacggcgaatcgacgacatagaaggctcctgaaattctggggtgttggcttttttcttatagttgcgggtcttgcaatcgaatcgccgatcttgctcagctcggtttattgcccggattctgcaaacggaatttttctttgcgttcgatctgtactacctgggcgttgtgcacagtgatttccaccgcaccaaaccgcagatcgcgcagggcgctctggatctcgcgcaaaatggctgcttcgtcctggccgtcaacgctacgtagagatgcgctcatggtcgtgctcctgaaatgagaagtgcctcgcagtggcggcactgcttgcggcgtgagggcgatagtagataagcgcggatattcttaaaaatactatttaagaatgtttatataaccagaaagaattttctggtgggacgtggggttgcgagaggttttgcgggccgacccgtgaaataaagccgtgtggagatccaaatgtgggagcgggcttgctcgcgaaggcggcgtgtcagtcaatacataggttggctgatccaccgtattcgcgagcaagc

SEQ ID NO: 612119 - DNA, 332 bp, Homo sapiens
  misc_feature (250)..(250): n is a, c, g, or t
tttttttttctgaggagtttcactgttgctgcccaggctgcagcgcagtgctgggatctcggttcactgcatcctccaccccgccagttcaagtgattctcctgccttagcctcctgagtagctgggattacaggcacccaccaccatacccggccaattttttgtgttcttagtacacatggggtttcaccatgttggccaggatggtctcgaacttcagacctcaggtgatccgcccaccttggcctnccaaagtgctgggattacaggcatgagccaccgcacccagccagttaatgtttctattaactaagacctaattaagattgag

SEQ ID NO: 612120 - DNA, 164 bp, Homo sapiens
tcatacgagggaagagcagcaacacgttggaggggaggcaagagcggtcaggttctgcggccaagtagaggagagatccgattagatctaaggtgactggatggaagcagggaagtcaagttgggtcaccaggtgagaggtgacgatggctttgactagagtgg

SEQ ID NO: 612121 - DNA, 142 bp, Homo sapiens
taggagtggacagcacagcacagaggaggatactccggggctttgtgcgccaagagatgagtcagcaccgtgcctgccagggccagttcatcgcatctggatcacgacccctccctagttatgctgcagacactgccggctc

SEQ ID NO: 612122 - DNA, 794 bp, Homo sapiens
gatctactgcaacgtaaaggccgaagtggacgtgtcttgggatattgctgttctttcacttctcaggcgtctccgagagctcagtatccaggactgagactctgtaccattgggaccagatggaagctgttgcatctgttgacatgtattcccaaagtcctggggtcatacatgctgctgtcagactaccaatagtctgggtggacagaacatgcggtagtatctcggaaattgcctaaaggccgtggatcagatggatagagagatgagattggtagacgccttaaagtagctggagactccaggcactatggagagctcaggcaggccgaaacaagaatgggctttctaaaggaacatgggggaatacagagaaaatccctaagtgatagcagagtgtttcgcaaggaagctcaagggctcacgtgaaatatgtggtttggccatttctactgagaatccgaccattcaggttgtaaaatattagatcggacgatctggcaatattgtccaagaatagacctcgtagaccaagatatgggaaggtgactgtggataacgcacctgtgtccgctggtgagaggacctggtatctaatagtcatttcccacggctagcactgttacagatgggaacccactaggatcatgttgtggggtcagtgacctaggaaataccgatgaaattacccaaggaaattgaaatggaggacgcgtactccgggatttcaataccgggaacttatgggcccctttaacgaaaaaattgacaatccatctgcagaatccgggaat

SEQ ID NO: 612123 - DNA, 390 bp, Homo sapiens
acgaggttccccctcggtatctctctcagcccttcagctctcttgtctacagcgcgtgtctctgtcataacttgaggcctggcccgcgctggggctcgctccaggcttgatgcgtgactttgcgtccgttaccatactttgaccctggctcctccagttctctggttccctcagtggctggctgtggtggtgactgggctcaactcctcaggggatgtccactcttgggacagccctgctcaggaaatgggacgccagtgctgcgggacttgccttgctgagaaaccggaggcatattgaggtaatatcctttagattaaaacttcagaaacttcaggaagattcagttcagaatgattattattattaagcttaaactggggttaccag

SEQ ID NO: 612124 - DNA, 184 bp, Homo sapiens
agtagatatctgtgctgcagtgctgcactgccgatcgggtaatcgcactaagttcgtcatcaatatggtgagctcccgagagcggaggaccaccaggttgcctaaggaggagtagaggcaaccgagtagaggcaaccggcagtaagtagaggcaaacggcagtaagtagaggcaaccggcagta

SEQ ID NO: 612125 - DNA, 453 bp, Homo sapiens
  misc_feature (358)..(358): n is a, c, g, or t
aaaaaaagatccataggagtagctgggattacaggcacccgccaccacacctggctaattttggtattttgggtagagacagggtttcaccatgtgggccaggctggtctgcaactcctgacctcaggtgatctgcccacctgggcctcccaaagtgctgggattacaggcatgagctactgtgcctggccagaatctattatttattgagaacttcctcttaatatggtctgatcagctaaagacgggtgagtactcttcttcactggtagtatgaggaagcagaagtgaacagcactgcggctcagctgcagttgcttccataggctggctagaagcaccagaagtctcccacggngcaccagaatcttggggtggtgtgccatcaggtcttattccatatatggaatattatggctcctcaaaagaaaaacatgtggagacagcatatca

SEQ ID NO: 612126 - DNA, 154 bp, Homo sapiens
  misc_feature (15)..(16): n is a, c, g, or t
cgttctggtcgtcanncttcgctctggtgcaggtgtccgaccgagaccaaggcgagaacggggtggtccctgcaccgtggtggcgacgtgctttcgagctcaagcgagccagcgacaccggggtaccggaccaggaaaaggtccttcttgaccc

SEQ ID NO: 612127 - DNA, 155 bp, Homo sapiens
gcatctcaggtgactagaggatccccctacagactggccgtccaagtcaccatgagctggccctcagttcaggcctctgtccctgtggctgcatgctggtaaaaggacgcacagtgcccgccctggtaggactcccgtggacaagcccaggatag

SEQ ID NO: 612128 - DNA, 243 bp, Homo sapiens
gaccgtagagctacctcaggctcagaatattgggagtcggagaatcgtcaagtatccctgcatacacagtcggggtccgtgtagggtattgctggtagacactcgctgcatctgctctcttgcctgtcctcgtgttgtctctagtctctccagcggccttctctggctgcagatcaggtcgagcatctcttgctcagctgcggtgagaataaggggccgcactatgccgggtagggtaagggc

SEQ ID NO: 612129 - DNA, 901 bp, Homo sapiens
ggtcgcgtgtgcacctcgctgctccaggctctggggcgcattccagccttccagcctgcgagctgcgagagaaaaggaatattactgtattcattctgtgcccgcatgacattaccgttgaggcagagcgaacaaaaattcaaattttaacgcatgagggaaatcgtgcacatccaggctggtcagtgtggcaaccgagatcggtgccaagttctggggaggtgatcagtgatgaacatggcagtcgaccccgatcggctacctaccacggggacagcgaccatggagctggacgcgcgatctctgtgtactacaagtgaagccacaggtggcaaatatgtgcctcgtgccatcctggtggatcgtagaacctgggaccatggactctgttcgttcaggtcctttcggccagatctttagacctagacaacttttgtatctggtcagtctggggcaggtaacaagtgggccaaaggccacgtacactagagggcgccgagctggtagattctgtcctggatgtggtacggaaggaggcagagagctgtgactgcctgctggggttccagctgacccaatcgctgggcgggggcacaggctctggaatgggcactctccttatcagcaagatccgagaagaataccctgatcgcatcatgaataccttcagtgtggtgccttcaccaagagtgtctgacaccgtggtcgagccctacaatgccaacctctccgtccatcagtggtagagaatactgatgatacctattgcttgacaacgaggccctctatgatagtctgttccgcagctctgaagctgacaaaacaaactacgggatctgaagcagcctgtgtcagcacccatgagtggtggtcaccactgcctccgtttccctggcaagta

SEQ ID NO: 612130 - DNA, 426 bp, Homo sapiens
  misc_feature (322)..(322): n is a, c, g, or t
atgagataccatgtcacacccgttagaatggcaatcattaaaaagtcaggaaacaacagtgctggagtggatatggagaaataggaacacttttacactgttgggagtgtaaattagttcaaccattgtggaaaacagtgtggcaattcctcaaggatctagaactagaaataacatttgaccaattccattactgagtatatacctaaaggattataaatcattctatgataaagacacatgcacacgtctgtttattgtggcactattcacaatagcaaagacttgaaaccaacccaaatgtccatcttgtttcacactngtcacattcttgttttaagtgcctttagttttaacagttcactttttacagtgctatttactgaagttatttattaaatatgcctaaaatacttaaaaaaaaaa

SEQ ID NO: 612131 - DNA, 370 bp, Homo sapiens
atcgctgctcacaaacatcttgaaattctgtggcaaatccaaatggaacctggtttctccactttgaacagactctgcttttctagagtcatccccatcataaatactctccagggccaacaattcaccctcctgagcttctctgtcttctgacaacatttaattttctgaggaactgttaataacaatcagaagaaagagatattaacactgcaatctctgtttcagttcagagtggagttcatgcaaatcccatttattctccagctggtggagctgggactgctgaagctggatatgctggcctgtaacatttctgctgtgaagtctgctgatggaagttcccttttgtgtgaaaagtttctttctc

SEQ ID NO: 612132 - DNA, 316 bp, Homo sapiens
aggaagggtcccacgctggggagagccccaagttgagaacaagtaagcgaacaattagttgtactgaagccacttgttacggatgactagctgagatcacaaacaacctgtgtgtaaaatgtatttccctacaaacgtagcacccttcagcaggaccctataaaactttcctccagcccttgcctctttgcaggtagccccttctctgctgagctgcccactgcaacatattttcacaatttctctaataaatctgcccttcttacctacaactatcttggtaaatggctttaccacctgcaaaactgaccctagg

SEQ ID NO: 612133 - DNA, 1036 bp, Homo sapiens
cctgactgtcttgagttgagaggacggggcacaaaccctaccatgaccccccacaggctggtgcaccgtgctgctgctgtagctctgctgctctgtgccagcccaggatggcgccttgggcggtgcccaggctgcgggcaaggggtgcaggcgggttgtccagggtggcttgcggtggagtaagcgaggatgcgggggtcagccagccggatgggctacgctgagaagcctgagtgaggctcgtctcaaggacgagcagggggcagagagtgcggagtacatacacccctctaactttgctagccccaatctgaaattgccatgttgccatccagacccaaaagagaccgactgaggcgccctatagacaggagacggcagtgaaatttagcatacagtagccgcagaagtggctcgatatattgaacattatcacagaagcacctcagaatagcagccatagattgacattgatcagcaaagtaaagtggagaagtaaaacatcacattaaaaggaggacgtgagcggtcagaagacccacccgaaaagggcaaggagcaaaccgtagtccaacgggcacccaaaacaaaaggaggaaagtatgtcgaagacaccacagcaagaagtacggacactccaaaagtaacaggcaatgaggcatcaatccaccgaagcggcacacatcatctttcacttacagcccaaataacgatgcacacgactttccgacagaatgacacacgacacaaaaattaatccatatggcaggtgcgtgatttgaatacaccatgaggaggaacaacagacgattgatgaccgatatattagtgtgggaaccacgacgacattgcacccgcgaatgaaagacaagccagatatactgtgaggggacaagccattactgaaggatatgtacacttgtgcaagaacacgacgaaacagacttagcacacagagaaaacctttgacagtgcgaattgcattatcaccgagcgaaaagatgtagcgagcacagcaccaacacgaatccagaga

SEQ ID NO: 612134 - DNA, 280 bp, Homo sapiens
cggctctgattagagtcataccaagggcatagctccctgatacattgggaaatacagaaagaaaagaaaaaatacaaggcattagttctgcagcatgtccatgaagatcaagcataagaacacatggatctgaggcttaagcatggctagcctatgttctacatacatcagtgactacagggataccaaagatggtctgagcgcctcataagtgtttagtaccaaatatccagcattttcggtaagttctagtctttgactctttctcagaatctatatg

SEQ ID NO: 612135 - DNA, 242 bp, Homo sapiens
gtctgcattgtatatttatgcatctcagctctcttttcttcttttcatttatatattttaaatttaattttaagataggttcactttgtcgctagctgagtgcagtgcatggtcaggtcgagctcaggctatatgcactcactgtacaatgtacctgctctataaaaatcaaaaaaaaaactgggtctctgacgcgggcatgattcacggggctcagtagttacaatgctagtagtgataat

SEQ ID NO: 612136 - DNA, 221 bp, Homo sapiens
tctagaggatccttctgtatccgggagtcccggggaggtgtacccaacagctcattgagaacgggccatgatgacgatggcggttttgtcgaatagaaaagggggaaatgtggggaaaagatagagaagtcagattgctgctgtgtctgtgtagaaagaagtagacataggagactccattttgttctgtactaagaagaattgttctccccgggatacag

SEQ ID NO: 612137 - DNA, 649 bp, Homo sapiens
agcggaggtgttccgtgtgtgtgtgtgtgtgtgtgtgtgtgtgtgtgtgtgtgtgtgtgcatatgtgtgtggggatgggggagaagaagtagggggagaagtaatatattatgaagatagcgccgtgacatatataaaaacgaaaacaagtcagctctcctattatcaccatattatacgaaaggtgtacactccgtagtgaacttcgtgtgcacagatcaatcacaccatacatataacttccaaaagggtgtgcagcatgaggagtgtgtagacaagatatattttaattatattaaaacgcagggatgagaagaggaagtgcagggatatttctataacacaatcatagtgtgtgcttaattacacaaaaatctacgtgtgtggtaaacgagagaggtattagtagctcccatcaaagagatgaagagaaaaacaaaaagcaaaaaaccaaacaaggataatgtagaccatagtttgtgatagtgcatcttcaaattaagccaagaagcagagcagagtagtgcatctttatatactgctcctttattacttgaaggtttgagatgtgctcctttaacaaaaggggtgagacgaaaccaaagaacgacgcttctagaacagtgaagcactctcattatgtatacga

SEQ ID NO: 612138 - DNA, 356 bp, Homo sapiens
ttagcacagtcccacttacatgatacaagcactaatataagtaagcaaaccaaccacaactcttgataatttactcataaaactgtcaccggttcataactgtaatcaaaagactagatttagagctaaatagattgatacgaatcctggcatatataaaccaagagctgcaggagacataactgtgtcactcaatcttactgtcctcatctctaaaaagatgggcagtaagtccagttgtggtgacccacgcctataatcccagcactttgggaggccgagttgggcggatcacctaaggtcaggagttcgagaccagcctgcccaacatggcgaaaccctgtctctactaaaaa

SEQ ID NO: 612139 - DNA, 112 bp, Homo sapiens
attcgatctctacaggatctttaggctatccaccagaggaatgagagaaagtttccggtcgctgagttttaaagtgtggtatcacgagtggtatggctggtatagaggtacc

SEQ ID NO: 612140 - DNA, 113 bp, Homo sapiens
tcgagcgcggtaccgtatgcggtgtactcgtaggtcagtaccattggtggtcaactgatttgatggtcagggagggatcgttgacctcgtctgttatgtgaggctcatgtgta

SEQ ID NO: 612141 - DNA, 165 bp, Homo sapiens
ctgagtgtagcaaagcatcaggagcccgggtaagacccgctctcccccaggcctatagaagaatagtaataacaactccccattttaacagataagacaactagacgcccagaaatttccaagaaggtagatgccactagcctatacttattataggataaacaa

SEQ ID NO: 612142 - DNA, 384 bp, Homo sapiens
cttttttttgtgctctaagcatcagcaaccccagctccaggtgcaaaagccatttacacttgcaaaaaccaggaagataccaagaggcccaattcaatcatcctgttacttgaattgccactgttggagatatagtactttgtattatggtctcattttttcttattttagtgcaaaatgaccagcttaatatggggaggtcatttttaaccatggataccttcaagtaggttacattatatttcatatgcattcatttgtaacctcttgacataagtctacacatcaaagagacacacagagaaagaaatgactttttaaaaataagtataggccaggcatggtcgcacgcctgtaatgtgagcactctgggaggccgaaacc

SEQ ID NO: 612143 - DNA, 466 bp, Homo sapiens
atctcaaatttgggacatcaagagtgtttacctgagccaggtcagggtttctgagcagccacacaaatgagacaacagaccaggatgacttgcctccctaaccaaaaatgtaccctctctgcatgaggatagcagaaggctaatcttgatgggacccaaagggccagaccccaaacacagtcacttcacctcaagtaagcattattataagtgataatgacaacccaaaactgagtcgtggctgctgttttgcaacatgatttcatccaaattctgtggctcgatcctccaggagccttgaaggtgggtactgtccattcactggcttgcctgagatcatatggcacatggcagagtctgaattcagactcagtccttctcatgactcccaggccaccagtgacatctctcccaaagccccaaaaaagttaagggtgttggatgttgccatgaaaatgcaaaaaaa

SEQ ID NO: 612144 - DNA, 657 bp, Homo sapiens
  misc_feature (526)..(526): n is a, c, g, or t
gtcagagatccccggatgggacattcaaaaaaaaaatagtaaaagaaagctcggttggatcggaatcagtttaaaaccgggttctcggattataagcttggtgacttggtggcctcagcttccttatgggtaagcacgtaagtgggtttaaagatggagtaataacatgtacatcagtaaaaatatggccggtaaattatatatagatatggaaatgggtcggccaatcgggggatgggcgaccatgtccacaagtggtggaaaatagccatttttctgggctggctctttccaactccttagtgggatcccattaagacaggtatctagcaaaccaccgggaaaaacacgggtgattcatatgccacccttggtccctcttagaagtggtaggtctatatcgggccgggtcgcgggggctcacacctataaatcccagcaactgggcaggcggaggcaggagaatcattggaaccggggaggccgaggttgcggtgagccgagatggcgccatggcactcaatcntgggcaacagcaacattaaaaagcgggcaatatagaggggaaaagttaaccggtttgggaggagcagagggttacataaattacatgtgggctgtggggctgatgtaggtttgtccttcctagttcttcct

SEQ ID NO: 612145 - DNA, 419 bp, Homo sapiens
ctcattacaatcccatattccagactaggataaggtcgtgcaggaagaaaacgctatccagcatctagcttatactccatcagggtcacagacacaaattgaaaccaaaaatcatagggtaaacataatagatgagctaaaggcagcaagtatgactactagcgatggaaagaaggaggaaactcaaagaaaccttaaaaaaactagaagaggtttggaaattcataccctcaaaaaaacattgtaatttgccctcattactaataacacatagacattaccaaaatcttggtattttttaactattctgataataagcaaactcttgctatttgagaacattattaaatttacaaaataaataccacaagtatgtatgattttgtgaaatattgataaatgggatttagatttagagg

SEQ ID NO: 612146 - DNA, 182 bp, Homo sapiens
tagaacggagctgaactgacacagtgctcagggctgggagaggccgtgcatctgtagcttgtcactgcttccctgttctgtgagggaggtttgtgccggacagaaggcagggcctcagagggttcatcagctcttgttctttgtcctttgactaataagaattgtattgtgggccccgctgg

SEQ ID NO: 612147 - DNA, 1160 bp, Homo sapiens
  misc_feature (565)..(565): n is a, c, g, or t
  misc_feature (633)..(633): n is a, c, g, or t
gtctcaaaaaaaaaaaaaaaaaaaaaaaaaagaaagaaagaaagaaatcctgattctgtcactggggcctcagtttcatctgtgaaatgggttgaatgcgggcgcttcccactgaaaagggaactgccacatgtggttgggttcccggggttcagggccccatttcttcttgcctttcccccctttcaggaccgtgttttcttctcgaccttcgaccttccctgtgggtggctcctgcgtctttctcttcttcgtggaatctcagattcaacttgtgggcggcgacttccgaaggctgaggaccttgccaaacacccttgtgtggccttaccaaattataccaaaaccaaccttctccgtgtggccgtggagagaaccttgtctcccgtggggccccagggaaaaattgttaccaacacccttctctgtgcccctccttgtgaacctccgtggctgtgcacctgtgtctcttgtgggccagtctccgccgctggtgctctcatctccaaggtcttctcctatagaaaaaggctctccttctgtgtgtggggcctctctgtgtctncctgtggagacgccgccgtggggtctccgtctctgtgcgcggggggagaaccccccagggagaatgtntctcccaggggtgtcgcccccagcaccaaaaagggtgtcgcaagtggggcgctctccatctctatagcggccggccatgacacgcgcgtgtgcgtctcgtggggggagtgcgggggcacgtattttatttctctgtgcgcccctttatacctgtgtccccctgtgtcttttacaccacgcgggctccaaaggtctcccccgtgcccgtgcctttttctctttaccctttgagagagaagcgctttaccccctctcttttctgtcacaccacttgtgagtctcccccgggggtgtgcccggtgaaccctttttcacggggggcctctccgggtgctgcagaatttttctctttttttcccccccttttgggccccccttatctctcctgtggggtctctgtggcccaattcttcccagaggcgttttccccccgttggctttacaccggcactcttctcccgtgaattcccggccttccttaaaggccttggcgggccccaattctccggggggccagtcggttccaa

SEQ ID NO: 612148 - DNA, 1031 bp, Homo sapiens
agaaagtgccctttgctctgtcccgctgctgtggacgtgaatacaacgcttgcggcagcaagacttggcgtgcgccatcttcgaatcgtcagcttgagagatgacgaagccactgcaccgcttggcccagctagtagaccatagggctgacacacgctcaccggcagcagccctccagcgcggaggatcatacgctacaagtgctagcggcgacgcttagaggtgacgatctctagggagctcaaaccgcaactaagtattccctatctctgaccagcttatgcttcgagccacaaacattgtatgcgtatgttcccataagccaagcgttgtcgtagccgcagacagataccccgtgtatgcgcatctacacatctactgcgcacgtaggtgacgtgaccgtactcacactcgcggaatcgagatggccatccgtcgtagcgacgtgtccacttcattattcattgagagatgaccacagggaggaaaaagataagcgtctatggttagggctcgctcaaaggaaagtgcaggctccatgaagttggcccgcgacgcccactaaggttgcgttgagagttgagcgtaaaacttccctagtaacatgtggacacatacgggcgcctcgtcccgagccggtcgataggtggggccatgaaacaggatagggtgctaagtccccgagctgttggacgacgtagtgccgtagtcctcggatataagcataaaatggctccatatatgtggacgtagaagaaccaaggacaactgcagttaacaaaaggcatctaccggagatggctattcgccatacaggacttaaaaacaatccaaagaaatctaaccagcaaaaaaacactatccaagcgataagtagaaaagaactaacgaaaaccctgaccccctatgaaccgccaaaacaacaattggtaacaacattgggcttatataaggactacacataatcccagatggaatacattaagtagatacaaacagaacaagattgtagaaaatggaaggaagagaag

SEQ ID NO: 612149 - DNA, 361 bp, Homo sapiens
  misc_feature (331)..(331): n is a, c, g, or t
  misc_feature (335)..(335): n is a, c, g, or t
taatgttgctagtgtagtgaagaagataatgatttagtttttcttctttctttttttttttgagatggagtttcgcccttgttgcccaggctagagtgcaatggtgcgatctcagctcaccaaaacctctgcctcccgggttcaagtgattctcctgcctcggcttcccgagtagctgggattataggctcatgtcaccacgcctgggctggttttgtatttttggtagagacggggtttctccatgttggtcaggctggtcgcgaactcccgatcttaggtgatctgcctactttgggcctcccaaagtgctggggattacagggcgtgnaacncggcacctgacaaatgatgtagtttt

SEQ ID NO: 612150 - DNA, 120 bp, Homo sapiens
cactctagagatcccctgcttgtctgctctggaaggttatttacttcggctaagatttcagaaactgcgtacctgcaatatctgatggtacaggcacggttggtccactttcaggtgacg

SEQ ID NO: 612151 - DNA, 104 bp, Homo sapiens
ctctacttcccctgttaaatttactgttagtccaacagcaggaacagctctttgtgacactaagaaaagaaaccttgtagagagagtaaaaaatttaacacccg

SEQ ID NO: 612152 - DNA, 110 bp, Homo sapiens
tggcgactctcgaggatccctccctgtcccccaagatacaggctgtctggacagcagatatatattaatatattagtctggtctttttggttaaactttaggcaccactt

SEQ ID NO: 612153 - DNA, 344 bp, Homo sapiens
ggatcctcgtggtcgatcactgtactgagtaaattatgatatgtgaaatgtctcattgtatacaaaaaaaaaaaggtttaaaaagttacttccttacaaaatcatgccttatttaacacttatataatgctctgcccttagcagggggcttaaacttgacatttctcatattacatcctccataattatcatgtgagggcaaccagagtagggaccatgctctttgggaaaaaaaagaaacatgatgtccagatgaggccacagttccggctagcaattaaagcacccagagcccagatcgaaccacaattaactcaatagatccggggtcaaaaatggggtcc

SEQ ID NO: 612154 - DNA, 1112 bp, Homo sapiens
  misc_feature (1112)..(1112): n is a, c, g, or t
cggagctgcgtccccgcgccggcaccctgcgcgccgctgctccgcacggcgctgcctccctcgacccgtggctccccctcgcaacttggcgggcctcctcacttttgtcctagcccggtccggccgccgtcgtcccccacgcgcctggcgccgagctcccgtggtccccggtgccaggctgtcggtgccggcatggactgcggagggtggcgggggccgaggatcgtcaccccagcggatgagctgccgccggacggaggcgcggggcggacgattggaacttccacgattcctggaagcaccggggctgcaaagtttgcccaagacgtcgccaagagaagagttatcccgaatgtttccaactaacggggaccttgaatcaaaaccttggccctatccatggtaactacaaaagaaccaagggtgcaaagggtatcattaccaaggtcatgggacctttgaatgaaccaaccatgcaagtgtgataattataacagcacgtaatacaaatagggatcagaaactgcacgagaaacgggaaatttccctaagacatgacttgtgcccccatacacatacaagaaaagacaacccttgcacatgggttgagcacggtgaattggtgccaacccctgtggcatgtggaacccctataggaaacccaggataagggtatggatcacaccagaggactcaggaatatgaaacaaatagcattatcgccaaacaccaaagaagattcccccaaaggacgcaaataattagcgatgcgaagttggaaacaccaaaagagaataatacgagcgccaaaaaggggctaacaaagtgagcaaaatatagaggagccgcgcccccaacacatgggggcagatatgaagaaacccccaaggagaaaagaagcaaactattaaattaccgcaggcgagatgaacgaaaaccaattacgacccaataggagagccacaacaaaggtataaaaatcaccaaaaaaaacagaaggcgaaccagagtatacgaacagacaccagaacgagcgacagaaaccactaacaaagagacagagggaaaccacgaggaggcgcagatatagaggaacaagaacgccacacagn

SEQ ID NO: 612155 - DNA, 154 bp, Homo sapiens
gtctctagaggttccccagcgagcgcacggtatgtgtccatagaccctcgcgccgccgcaggtcaccctctgccttcaccacgctgcttgtggagggtgtggagatatccacccctagtcctcagaggatgggcagtttgtctccctttcagag

SEQ ID NO: 612156 - DNA, 316 bp, Homo sapiens
acgggtgaggtacagcatcctacaagtggcagtaagggtagaagaaatcagttattagcgaatcgtggtctaagttactgggttagtccaattctgaatacacaagtaatattctagcctcttttcaggaggagactgatgtacagtagtcatgggcaggccatggaacaaagttccattgctggcctacagtggattggagggttgctccgcagagagtcgtaactgagagaatatatgagagcccacaaacccactgctcctggctgtccaaggccaaaggcatcttcttcctggagagctgtacctcacccgt

SEQ ID NO: 612157 - DNA, 277 bp, Homo sapiens
gagcccaagctcagacctatcatgtcagcttcgagactttggccgaggtggacggatcacctgaggttgggagttcgagaccagtctgaccagcatggtgaaaccctgtctctactaaaatacaaaagattagctgggtgtggtggcatgcacctgtagtcccagctactcggaaggctgaggcaggcgaatcgcttgaatccgggaggtagaggttgcagtgagccgacatcgcgccactgcactccagcctgatgacagagcaagactctgtctc

SEQ ID NO: 612158 - DNA, 221 bp, Homo sapiens
cgagcttcccacgataaaactactcacggctacgcttggatctcactgactaaaacacaggactcaatactgagctccttctgtgtggatctaatattcatgccttggtcgctatattggataatctctggggtagtcctcctggtacgcgccatgatactcatcagggtattctggctgataatcactatcactgatttccgacccatttgttcctgttc

SEQ ID NO: 612159 - DNA, 1449 bp, Homo sapiens
gtgaactgcacgataaaggaactcagagcgcctctctcttagttgatagattaagttgatatctactgaagttatgcagtgtttgatagtggtgtatttacctaatagtatggtagcctatgtttaatgggtcgtgacactaactagatttttggctactcaatattacacatcattcagctagtatcctagtataatataatagacacgtgcatacagtgcacatgataagatacatataatactaagtgactcttgcaaattaacgaatagtataaatgattgctaataggctaaaacataccacaggcacaaaatacgcctaggatttgaatgctgcaacagctgcacagctgcacaaaccacgccgcgaaaacactaaactaccagctaacggcaggtctccatactctaccaaacacgcggcgactaatataccactatccgcactcctcatcaccacggcggcggccagtgggcttaccaacgcggcacacgcacacccgcacacccgcgattgcgaaccgttatctgtaccaccgtatagctcaacgtatcatgctcccaccaggaacatacggattctggcattacaaaccaacatcccgttatacaacatctctctcctaagcacacaaattgtccatacatggcgtttggctcacacgtgtgaaaaaccaccacatctcaaccctatggctctccctcattgaacccttcgtcccaaccatgcatgcttctccaccttccaacttcctacccaaactgccttactactgggctcaaaccgcccccttgcccatcaaccctcgcactcccttagccgcccctacccctcaccaccaaccacctctgcctacaaaccctccccaactaaacctacccacatccacaacaccccactacacctccctctaacctccccccgcacaaccccgccccaaccccccgcgcctccccgaccaccccaccccacccacaccaccccccgccgcccacaccatcacctctcccccaccccccccccacgcgccccctcgcccccccccaactcaaccgcacacccatacaggccccccacgcctcacactccacccctgcccccccaacccccccccgccccacgcacacccaccccgccccccacgcgccaacgcccccatacgcaacaagccctccccaccccctcaccacacacaccacacgccacaccatcaacaccccaaccacctcccgcccgccccccccccccccccccctcccaccccccaggccctccccaccccttgccccccacccccccccccccccccctcccccacccctccaccaccccccacccgccgacccccccactctcacccacctcccacccccccccccccccccccccccccccccccccctcaccccccccccccactccccctccctccccccacctcccct

SEQ ID NO: 612160 - DNA, 127 bp, Homo sapiens
tgtgctgaggtgactctcagaggattcgcccaggtagattaaaggtgagaaaagagccagccatttgaaaagccttaagaatgctttaaacagccgggcacagtggctcacacctgtaatcccagca

SEQ ID NO: 612161 - DNA, 331 bp, Homo sapiens
acccaccaacacacacacacacacacacacacacacacacacacacacatatatataaatcgcacccttagcaccagtgctatctttgtgtgattcctaccatgaaagtctgcactttaaaaagcaggaaaatgtgaaatctacagatgtggatcacactcaaacttgtattgggacacaagaacttctccctctcaggccacagtatgtacagagagatgtcgcccatgtgtggtagagacattgcgtgagagagaggtggtgattaggaaaaatgtgtctacaagagttcctggggagggtgatagtgagactgtgtagacatttgtgt

SEQ ID NO: 612162 - DNA, 210 bp, Homo sapiens
gtctctacaggatccccgcgtgatggagactgcctggatctctcacgccctaggacagagaattaagggactggggacctggtgacatttcttctctctgaaatagataggaaagacaggcagtttccctttatatttcccttgcttcaggtttcacagtgtaacttcagctggcactggcagaagcagaagggaggggcatctcccctg

SEQ ID NO: 612163 - DNA, 186 bp, Homo sapiens
agacccagtttccccaaaaaataaaataaattagttgggtgtggtggtgtgttttcgtagtcctatctccttgggaggccgaggcaaaagaaccttgagcccagtagtttgaggctgcagtgagctataattgtgcccctgtactccagcctgggtaacaaagcaaaactccatttatttatttta

SEQ ID NO: 612164 - DNA, 236 bp, Homo sapiens
cgatggggtagaactagaccaatgaaaagcttttcccaccaccttgacgagcaagacctgttgctcttcagaagaaggatactagtatggttgtgtaacattaatggccatggcacatatgttgagtcaatctgatactaaaagctcactcctcgtactcaaattgatcacattcactcacaggaaatgaggaggaatgattccttatcccttccatccagtatcagtttaccttt

SEQ ID NO: 612165 - DNA, 359 bp, Homo sapiens
aacatcccgcataagcagcgacactggaaggcaggctggctcagacagcacaccgagcacgaaagtaagtgccctagaacacaacagctctagcataaacaagacatcaaatcaaaacaccgaaaagccctatcagttttagtcacttgtcttaagcccgtaatggtctcttacatagtcaaggtcactgattcaattaggttccttccaaaaggaaagagggctcaaattgttacagtcaccaggtccacccactctaggactcatgctctgaacacacacatggcagtcctcccagaccactgtctgctactgcatactggacacagtccacagtcttctcttatttgagtcgacgc

SEQ ID NO: 612166 - DNA, 382 bp, Homo sapiens
ctaaaaaatacaaaaaattaattagctgggggtggtgacaggcacctgtagtcccagctacctgggaggccaaggcaggagaattgcttgaacccaggaggcgaggttgcagtgagtcaagatcatgccactgcactccagcctgagcgacagagcaagactatctaaaaaaaataaataaagcttctcagtgataccagtgctgcttttctagggaccagctattgaatggttctactatagactgaacaaagatttgccagcctatgggtcataaggtttgaatttatctggtgtgctattagatatgtataaatgcccccatgtagatctgccttgacgtgaacaatgcttcaaaagtgtcatcaactacaaaggagaa

SEQ ID NO: 612167 - DNA, 248 bp, Homo sapiens
cctgaggtgtgatatacatacagccaagggcccaggttttagatatacagctcagtgaagcttcagaaatgcatgcatgcatgtagccctgactcagatcaagatacggaagagcccagccctccccgatggtccctcatgcccccttgcagaaaaaactgcctcctccagtaaaccctattttgatgtccctatagattagttttgcctttttgtggactttggataaatagaactggaccatatga

SEQ ID NO: 612168 - DNA, 394 bp, Homo sapiens
  misc_feature (20)..(20): n is a, c, g, or t
caagaggaactgacaccacnatttcccttttctgtggaagagccccccgtaggtgaggcctttatactagcccccttttttgtaaccaaagggaaaaaaaaagttcctttggctggctgcaaagtcccaaagggcccgtttaaaaaaccaaaaaaattttaactaacccgtaatgggcatgttatttggaagggctcctttaccccctttaaaccccctaaaaatgccctttccattgtccaaacgggaatggattgtggtttccgttttaatgaaacccatatggaatttccagtgggggccaaaattttttttttttaaaaaaaaccaattccaacccaaactttttggggtcccgggtttttaaattccctttaaaatgttaattacccca

SEQ ID NO: 612169 - DNA, 935 bp, Homo sapiens
tactctgagtgttagtgaatatcgagcgtggggtggcgtgggtggggcacgccgatgtggcattggtgatagaaatggatctgtgatacctgggtacaggttcattctgttcagacgacagcagaaaggctctgagatggcagcagtggtctatcgtcatgatcaagtcacagggttacccagacaggtgatgtcacaggtagttgtcactctattgatcagcgagtattggaagatcctggacgtagacggatataagccggtcgcatacaaggcagatcttccttacttaactaacattccaaacattcaatacgtctgcggagcactcgttcgtgctagggcttccatggtaagatttcctacaaaagtgatgtgcgctgtatcgccatgtagggaagatttggcgttatctaacgttaggaattcctacggagagtacaaacccacaggtgtttgggagcaattaattgactgtgccagagatatgaaagccctagggttgtgaattctaacccgagctctttagaggccctaggttccacaaacagggttggttacggaacgtgggtccttttacccacaaacatggagatccaggggcacaaggcccaaggatccttatagtggggtccttagagaatttttacaagggccctaagtgaggttcaacggggggccatgatttcaaagggaaaccttctgggagagaatgagggtagaaggtgagcgggatcgaacagtttgggggataacacagggcgaccaatcgagtggccacatatacggaccccgggtcagctattttcccccccctataagaaggttatgcacaagttccgtgttatgctcccccagagaaggatggcgaatggacaatattggggtggaggcagagatgaccgagagcagttggaatttggctttccgaatta

SEQ ID NO: 612170 - DNA, 893 bp, Homo sapiens
catggtggcacacgcctgtagtcccagctacttgggaggctgaggcaggagaatcgctcgaacctgggaggcagaacttgcagtgagccgagatcacgccactgcactccagcctgggcgatagagtgagactgcgtcttaaaaaaaaaaaaagaggggaagaaaaaattggtccaaattggtttaaaattgtttggttgcagggcaatggaggctcaaaccttgtaatcccagacatttgggaacgccaaggggggggaaaattcacaaaggtcaggctattggaggaaccaggatgccaacatagtgaaacctttgtttctactaaaattaaaaaaaatgagctaggattgggtggtgcatgcttgtaatcccacttattcggagggctgaggaggagaatggctggaacctggaggcggaaggtttgcagttgagctgagatggcaccaatgtgactcaagctgcgcgacagagtgagattctgtctcagaaaaaaataaacaaaaaaaaaaaatgtggggcggatcgggctaaaaaatttataacaattgttggggggggggggccaagtagggtaagggaacggtccagacggtcccagagagacccggccgcgaggagtcgggcttccccccaaaaaaaagaccgggggggcacgcgaggtcggaacaacccgaggggcctgcggccacagggcttcacagcgtccagcgacgtaatacccccccggcgacagcggtagaaaacagacagagcccgcaaccaagagaagacagagaggaacgcaagcctggatccgcacaaacacgccccgccaacacgcaactgaacgcgagactccggacaacgaggcccacccgcggagcgacgaaccaacagagcagacccaa

SEQ ID NO: 612171 - DNA, 1541 bp, Homo sapiens
tgactgatggcccgaggccccgcctgcccctggtgccccatcagaccttaaacccctgccattgtccccccagaacatgctagcgtagatggtgtggcttacctcgcccctcatctgtggtgtgggtgtaggggtgtggagtggacattgcccacgcctctcaccatctagcacttacattttagtagctagccactcctagcacccatacactacagtacctccctacatcaccactatcctacctactactgtgtagcctacagttctgccttgcccggcaagcaaatagggtctagagccctgaaacgggacgggcatcgacgtaggacggaacacgggcgccgaacggcgcgggggcccctaggcaggtttgggcgatccccacaaaaagctacccaccgcccccgccaaaagcccaagccaccgcggaaacgaccaccacaccaagagcacaccaaagggcgacaacaacgagcaccagagaacgcaacggcgcctaccagggcgaggacgaccagtcacagctggccaccccgagtccaacccaggcagctgacgccctgatgcgctcgccaggacccaaaccgcaagctacgacgaggaccaccagaacgcccaccagccgcacccccacacccaggacacaggctaacacacccactgcacacacgcgaaaacgacaacgggccgacacgaaacccgcccaacagcccgaccaaaaagacacgaacgagagagtccagagacatgccaacccccagtagcagacaacgacgcccacccgacccagccaacgaacacacaacacaaacacgacccacggcaacaagaaccaagacacataacccaccacagcgcgacaaatacacaccgacacaacgccgaacaccaggaaaaccgacagcaccgacaacacacacgcagagcaagagaccacgaaccacagaaaacaccgaaagacaagcaccgacgccaggcccgcgctacaggcgacagccacagcccaccacgaccgcagccaccagccggccgcgccggccacaaagcacacagcccaccccgcacccacggagcgccagcatgcaggcgaaccaccacccaacgacgcggcagcccacaggcgacaacgaacacagccaacgaggcagcacgcgcgccggagacggaacacgcacccaacgagccacgccacaagacgacccaacccgcggacgcaccacgccgagcgccgccacgccggccgacaccaccgagcaccacgacgactagaagcgagaccggcgaccaggacaggacaggaagcagccgacacacgcgccacgctcacacgcgcacacaaggccaaccggcacgcgaccgaccgctcaggccccagacgccaggaccgcacagtaagacgaccactcgacgacgaaccccccagctccagcgcacgacagccgcacggactacacgcaccgcgactcgagaacgccgagcacacaacgccgacaccgaaagacacacacaccgcgagccgacgaaggcgaccaacgacc

SEQ ID NO: 612172 - DNA, 328 bp, Homo sapiens
caaatggaatcctgtagtgaaccgagtctaccagaaaacaggctacaatctgtgaccacacaatgatgtggactggatggcagctagaatgttatgattcagatggggacttttcttccccttccctgcctagtttccttttgttccttgagtccacgcagaattccattctctggtcagcagacaggtttatgctaaagtattgactctattctgtaaagggctgtacatagttcccaagcttctgcagggggtgatttttgctcttgtcctgagaaataacagtgctgtttaaaaaaacatttgaaatatgtaccgcacacaaaga

SEQ ID NO: 612173 - DNA, 377 bp, Homo sapiens
tttaagtgagcgtcgtgttataacggaaaggcttaaacagaagcagtgttgctgctggcggttcagctggtgcatgagccggtgatccaccagaggcgccacctaaaccctggagtgttacagtagccttgcctctcgagtagcagagcacaaacagcacagacacaccgcacactgatcatggtacagttcagatagactttgacacttacacgttcagatagcaacacagatgctgctgctgaggagacaggtgtcagcaccttttcctgccctctccagaggcgagggcccatgagccccagcacacagaagcccaggctttcttcatagcaacccctggccaagatttcttgggtctctcgccatggcggcgg

SEQ ID NO: 612174 - DNA, 174 bp, Homo sapiens
cacgaggggacctgtcagatgggccggcatgtcgccttgagctcttcggagagggcgccgtatgtggtctcggaagtgagaatctgctccgggcttgacatatctctcaagtaggcggtcaagttcacggtatcgtcagagatgtcccactcctcttccatcaaatccccgtaa

SEQ ID NO: 612175 - DNA, 377 bp, Homo sapiens
  misc_feature (316)..(316): n is a, c, g, or t
cgggaggccaggcaggaagatcacgagccccaggagtttgaaaccgcccaggcaacatagtgagaccttatctctacaaaaagaaaaaatagccaggtacagtggctcatgtctatgatcctagcactctgggaggccaaagtgcacagatcacttgagtccaacagtttgagaccagcctggacaacatgatgaaaccccgcctttacaaaaaataacaaaaaaattagccggctgtggtgttgcacgcctgtagtcccagctactagggaggctgaggtgggtggatcacttgggctcaggaggtcaaggttgncagtgagctgtgatcacaccactgcactccagcctgggcaacagagcaagaccctgcctcc

SEQ ID NO: 612176 - DNA, 158 bp, Homo sapiens
ggagagaagaaggcagcaggggccacttcaagcttccctgcttcctaagcttaggttgtcagaagcctttttaagagaatacatttttagcaaagggagcaatagtgtggtagcagtttactacttgcttctttttttttggtttgtttcagagtatt

SEQ ID NO: 612177 - DNA, 287 bp, Homo sapiens
cggggaaaacaaccgccatggaatgcgtaagcattcgctttgccttttcctcggggaaaaccaacggccgaataaccgctcgtcttggccgccctacttcatgagggccaacctcaagaaacttttgaacaagaccaacaagaaggcagttgagtcctgaaggccccgtgctccccacctctcaaggagtctcatgccgcaggttgctcagaaactggttctgttcccccagccccttggctcacctgaagtcctatcactgccgctctgcccctccccatgagcca

SEQ ID NO: 612178 - DNA, 92 bp, Homo sapiens
cctcctccaggcaatgagcaccagggggggtccagcccttgcttgggaggacttcaatagtccagttgctctgccgcgagtgggtgagtgag

SEQ ID NO: 612179 - DNA, 160 bp, Homo sapiens
cgacttggtaggtgaaatgtggttggagcagctgtcagcttggggaaaatcactcattcaggtagtcagcccgaagtgaggctgcccttcagcctggacaaacactgcattccacacagggaacaagcgggtgctttccctgtcccttccccttaggggc

SEQ ID NO: 612180 - DNA, 445 bp, Homo sapiens
agccacatgtattctttccacatctgaccactctggaccagtggcaggatttcaggtcatacaaagtggtggagactgttgtaacagtactgtacagtctcagtcggtaggatctgctttgacctggagttcagtcactgcgtggtgagcgctggagcagtctgtccgtagatacatgcgcttgagatagtctcgagttcagattctagtaagtgattatccttccaagcgtggatgatccaagtgttgaggatcatgtcgtctgataagatctacagcctgttatcaacggggatccttaactaccatttgtacatctgagacgtaagaggctataaccaggctatggtcaaatgcgcagtaaatacattcgaaaaatggtttgactagttcggctggtaggattaaggctgctacgtgcagttgaaatcgtgccgaattcctg

SEQ ID NO: 612181 - DNA, 186 bp, Homo sapiens
ctgtggtcccagctactcaggaggctgaggcgggaggattgcttgagcccaggagttggatgttgcagtgagccaagatcgcaccattgccctccactctgggccacggagcaataccctgtctcagaaaacaaacaacaaaaagcagaaacgctgaaggtgtcggtttacgggaaaaccgcctgt

SEQ ID NO: 612182 - DNA, 405 bp, Homo sapiens
agctctctaggtgtgaggcagtacagagcatctggctcctggtgaggagggtcctcactcggtgaccacactgcctgggttcacagcatggagggctcacccatgcagggacacgggtggacacccactgcttcacatgccttattcacattagaaagcatgttacagcctttcagtctgtgcaattaaagagatcctgtatgaaatccactcattccttgggagggaagctggactccggaggcacgctcaggttgacgggtgacgcacagtcctccagggcccgcattagcatccatgacacagacacacgtgaacacccagcccgccggtcctatcagccacctgtggggtggatgttatggatagaaatggatgactgaattcaggggtgggaagaacttc

SEQ ID NO: 612183 - DNA, 481 bp, Homo sapiens
  misc_feature (71)..(71): n is a, c, g, or t
tgacttatttaggctgttgaaggtaaaaggatcaaggaggaattctatattccataaaactatccttcaangatgaatgaggaattaagacattcccagataaacaaaagctgaggggatttattgccagtagacctgcccacaagaaatgctaaagggagtcctttaggctgaaatgaaaggaaactagacagtaactagaagccatatgaaaaaataacaccaatggaggtaactacatatgctgatgtcaaagccagtattattgtatttttggtttgtatctcccatttttcctatatgacttaaaagacaaatgtataaaacaatgattataaatatatgctagtgtgcacatactgtataaagatgtaacttgtgacaataataacataaagggggaggacagagttatatattatttatatactgtatgtatattttgcatactattaaagctaagttgctattaatttgaact

SEQ ID NO: 612184 - DNA, 873 bp, Homo sapiens
  misc_feature (59)..(59): n is a, c, g, or t
  misc_feature (61)..(61): n is a, c, g, or t
atcatagctactacttcattgcaactttattactgaccagatcagacatcatgctaaananctgggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatcgtgtggagcgaggaaaggtgtgctgtgcctgaggccaggtgcctgccagtgtagagccggtggagcagctgggctcggcgcatgaggttcgccctggatacaacgaccccatgtcagggttcggagcgacattggccagttggcctgacatctatgtgctgactgtcgtcactatcatcatctgttcacctgctcctgtgctgcctttacaagacgtgccgcgaccacgtccggttgtcaccaccaccaatccacactgtggtgcatgccccttatcctcagcctccaagtgttgcgccaggaacctggaccagataccaggctaccaacaccatgcgctcagcagggaatgccggacagacgctaccaatgaggaacccaccaaccttaccaggcaggccagggccaccggctacacgaaacctgtggaggggagcggcgcaacccggcggcagctctgaacccgctctgtcccgaggggcagagagatcatggattcagcgcacaggaggagggacacagaaaaggagcaaccaggaggggcacgggcaccaggggcggca

SEQ ID NO: 612185 - DNA, 375 bp, Homo sapiens
  misc_feature (19)..(19): n is a, c, g, or t
  misc_feature (162)..(162): n is a, c, g, or t
  misc_feature (292)..(292): n is a, c, g, or t
  misc_feature (337)..(337): n is a, c, g, or t
tgaacttaagtcctttatntctgtatgttctcaaatggctagatccattccaaaaaattctggagccaattatttaagttcccagataacaaggccgggcactgtggctcatacctataatcccagcactttgagaggctgaggcagatggatcgcttgagnccaggaattcaaggccagctttgacaaaatagtgagaccccatctttacaaaaacaaacaaattagctgggatgatggtgcacacctctagtggctactcaggaggctgaggcaggaagattgcttgagnccaggagttggaggctgcagtgagctatgatgataccaccacacntccaccctgggtgacaaagcaagaccccatatctttta

SEQ ID NO: 612186 - DNA, 101 bp, Homo sapiens
tgatgaagggatgaccgctggttctcacgctgtcatatttcaggatagaggacaggagctggtagatgggctcaaagtctgcctgcaagcggctctgaggg

SEQ ID NO: 612187 - DNA, 321 bp, Homo sapiens
  misc_feature (59)..(59): n is a, c, g, or t
  misc_feature (61)..(61): n is a, c, g, or t
  misc_feature (214)..(214): n is a, c, g, or t
atcatagctactacttcattgcaactttattactgaccagatcagacatcatgctaaananctgggcggcactgcgcccggcgctcgcgtccgtccgcccgtccgcccgcccagccatgactgcgccggtccccgcgccgcggatcctgttgccgttgctgttgctgctgctgctaacgccgcctccgggtggtgagccgggggtgggggcggnccgtcctgccctgggaccgggcagacacttccccgcgctgcctctccaacgagccgggcagcaccagccccactatgccccccactgacccctgattgccccgaggc

SEQ ID NO: 612188 - DNA, 170 bp, Homo sapiens
  misc_feature (3)..(3): n is a, c, g, or t
  misc_feature (170)..(170): n is a, c, g, or t
atnctgtaaacaatacctttgatactttttagaaagagattatggccaggcgtagtggctcacgtctgtaatcccagaactttgggaggccgaggtgggcagaccacctgaactcaggaatttgagaccatcctgggcaacatggtgaaacccatctctactaaatacgn

SEQ ID NO: 612189 - DNA, 255 bp, Homo sapiens
taagcttctcaacgtgaactaatggctgcatttacaaatgaacaattggtattttcgggataatttttctttctgaactgtgctacttctaccattgcacgtctgtcactccagatttcttcggctctgttcatgtgaaacgcaatcgggaaaagaatgatggcttttttggttttttgagccaattcataagcccaaggtaaatatttgtcccactttttctcgttcatcctgagccagaatcaaaaaaaaaaa

SEQ ID NO: 612190 - DNA, 141 bp, Homo sapiens
gtctaggtggaaggggagtgagcagacactcgggaggtgtcttgagattatcatccgctgagggtggaaggggatagagcaggcactcggcaggtgtcttgagattatcatcctgctgagggtagagcttgagggtggaag

SEQ ID NO: 612191 - DNA, 1234 bp, Homo sapiens
  misc_feature (201)..(201): n is a, c, g, or t
  misc_feature (310)..(310): n is a, c, g, or t
atggcagcaagaaggcggctggtgggtgcaagatggcggtcctggggtagaggttggcaagacttcctgactaagcgtaggtcgacgtaactatatcggggtcactcggcgtccagacctcaacctaacctcttacctggcacgatgccggctatggcgaacaggaactggatgccatactctgcccttatggagatagcnaccaagagggcctaggatctaggccacaacattggatgcaaccagtgtagaagccagttgtagcggacctttctcctagacttttccctagaagtatccgattcccctnattctgtcatccaatacctgcattccttagaaggttaagactgatcgtttttcttcgaggatggtgtggagagataatttttccgtgtaggggctagttgctggtggcttaaaagttatactccgaagcacacagtggaggaaaacgagttggggacgaatgagtgtctgaagatgtgggagtgaactctgtcgcaagaggacactttctctctagtgcactctccatgaagtgagagtgattccttggtggggcgagagatgccagtcgaggccgtgcgcggtatgctaggtgaaagtctgggcatcgacattaagttcgctgaagagggaatgaaatgctgcaatcgattagtaatttcgtgcagagtgtaggatttcactattggatcactggtaaggaagtatgaaagctaggtggatgaagggtggcgttgcaaaactttgcttcttgccacgagttccgaaaggcatttaagctggtgggggaattctgggagacaagaatccccggttggaaactggactccgaggggtgttaagcgagacacccaggtacgactggaagctacaagttgggtaacccattcctaacaggacattgcccccatggatgcagccttgggtatccagatggacgtcaggttttaaaaccaagcggggtcagatctatacggtgcccacaagggtcctgggcggtctgccacccgtgcaacccctggctggccgggggaaccatgggggcgatacacccacaccagaatcagccgcggatggcgcaccgcaagcaaagcaccacgagcggagcacaaacccgcccacgaggcagacaaagcaaaacgcacaacacggagaacacacacgcagaggccaccacagagacaaggagggccaccagagccgccacaaacccgaagaccacaca

SEQ ID NO: 612192 - DNA, 2794 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgca

SEQ ID NO: 612193 - DNA, 259 bp, Homo sapiens
  misc_feature (258)..(258): n is a, c, g, or t
cccttttcccgggggggcccccccccttttttttggtttcacgggtaagcaaaaattggggaaagatttccggttttttggaattttttcccaaccccccttttttttggaataaaccctttttgaaccggcgggtttgggttttttggatccgggggccggggggccccccccctccccccggtaaaggccggccaattgaaattaaaccttttgttccccaaagttttttttaaaaaaaagactttggaatgcccna

SEQ ID NO: 612194 - DNA, 104 bp, Homo sapiens
acccactactggctactactggcctctggttggtcgagttgtcggaagccgaacgccttcagggagattagttatcactgatgtggagcaggctgaaggactgg

SEQ ID NO: 612195 - DNA, 462 bp, Homo sapiens
  misc_feature (129)..(129): n is a, c, g, or t
accccaaggtcccctgactcccgggcaaatgtttgcattgaggagaacatgtcccggaggagctcagtgaagaagatttaaaaaataaaggagaaggggaggagagaggaggacgcgaatcacacccgntgctgcgcgccagcccgccccgtctgtacaatgggatgctcgggactcggacgggaggatccagtgactgcgagccccgcattcgcccgatcccagcctcacacccccagccagcccccagagaccctcccacacttacgaaggaaatgcatgcggccaggaggagaatccgcaccaggaggtacccaggaaaaagaagaaaaggacagattcatttggggttcagcctcatgccccccacacccaagactttgtggctaagagaatcaggccaccttgaggttcatcaagttcatcccattaaaacctcccaaaactctggaaaaaaaaaaa

SEQ ID NO: 612196 - DNA, 108 bp, Homo sapiens
  misc_feature (55)..(55): n is a, c, g, or t
cgctgggacctgggattacaggggtgagccaccacaccagccctcacaaaccttntgaggtagaaaatattaccatgtccttttttacagtcagtgcaggttcccggt

SEQ ID NO: 612197 - DNA, 521 bp, Homo sapiens
  misc_feature (129)..(129): n is a, c, g, or t
accccaaggtcccctgactcccgggcaaatgtttgcattgaggagaacatgtcccggaggagctcagtgaagaagatttaaaaaataaaggagaaggggaggagagaggaggacgcgaatcacacccgntgctgcgcgccagcccgccccgtctgtacaatgggatgctcgggactcggacgggaggatccagtgactgcgagccccgcattcgcccgatcccagcctcacacccccagccagcccccagagaccctcccacacttacgaaggaaatgcatgcggccaggaggagaatccgcaccaggaggtcttcaaactgctctatcaccagctcccacagggtcttcccttcctcagcagggagctctacccaggaaaaagaagaaaaggacagattcatttggggttcagcctcatgccccccacacccaagactttgtggctaagagaatcaggccaccttgaggttcatcaagttcatcccattaaaacctcccaaaactctggaaaaaaaaaaa

SEQ ID NO: 612198 - DNA, 791 bp, Homo sapiens
  misc_feature (39)..(41): n is a, c, g, or t
  misc_feature (46)..(46): n is a, c, g, or t
  misc_feature (200)..(200): n is a, c, g, or t
  misc_feature (202)..(202): n is a, c, g, or t
  misc_feature (537)..(537): n is a, c, g, or t
  misc_feature (602)..(602): n is a, c, g, or t
  misc_feature (619)..(619): n is a, c, g, or t
  misc_feature (623)..(623): n is a, c, g, or t
  misc_feature (625)..(625): n is a, c, g, or t
  misc_feature (634)..(634): n is a, c, g, or t
  misc_feature (686)..(686): n is a, c, g, or t
  misc_feature (693)..(693): n is a, c, g, or t
  misc_feature (696)..(697): n is a, c, g, or t
  misc_feature (701)..(701): n is a, c, g, or t
  misc_feature (705)..(705): n is a, c, g, or t
  misc_feature (709)..(709): n is a, c, g, or t
  misc_feature (715)..(716): n is a, c, g, or t
  misc_feature (719)..(719): n is a, c, g, or t
  misc_feature (723)..(723): n is a, c, g, or t
  misc_feature (725)..(726): n is a, c, g, or t
  misc_feature (741)..(741): n is a, c, g, or t
  misc_feature (748)..(748): n is a, c, g, or t
  misc_feature (758)..(758): n is a, c, g, or t
  misc_feature (761)..(761): n is a, c, g, or t
agatatatcaacttaacagtctatttgatcattactctnnntcagngataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagncntgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagaaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagatnaaatagcagaagtgagaagaaagttcaagggtagagaagaattcctgaaaaactcactcaagtgnagtggctgctgaatggncttnanaaaaacttnttccatttacaagtccggcacttaagcggaagagctataaaaatagagcatntgtgccntgnnctgnaganctcnggaccnntgnttantnnagatgaactgaagancagaagncaacaagacntcngttgctaatacctattgtcaaagatctatt

SEQ ID NO: 612199 - DNA, 115 bp, Homo sapiens
  misc_feature (48)..(48): n is a, c, g, or t
acggctaccagtggaagatgctcaacaccttcgccttgctggtgctgntgaacgagcagtttaactgggtgtccgtgctgtcatacctcacgcaaggcgaagaccagtactatct

SEQ ID NO: 612200 - DNA, 565 bp, Homo sapiens
ctctctgctgattgctgcggcgttgtgtactcctctgcgggggggagtcgcttgtttggttcgctgcttttttttttctctccgcgtgtgtggagcgccgtggcctgtctccctccgccgggtgtgcgcccccccctcctttgctatcgcgaccgccggagggtgtttgttcttcttctggtgaggggtggttcctctctgccgctcccgcttcggtcggagtgcagaggtcgtgttcttctccactcgtgtgtcgcgccccctctctcgtctgttttccgctctcctgggggtgggtggcgaggacccagcgcctcatcaccacctcttctctttctctcccgccagacaggagctccctctctatctctcgcgcgcctccgcccatttaacttcgcccgccgccgcgtcgcgtcgtcgcttggttgcttggttcgttgtcgtctgcgtgtgagatccctcactcctcctccctaacttacttctctcttctctctctctctcatccataaacaagtgtgtgctgtgtcacaaaaaaagaaaaacaacaagaaacaataagata

SEQ ID NO: 612201 - DNA, 426 bp, Homo sapiens
  misc_feature (103)..(103): n is a, c, g, or t
agtcagctgaggagacagaggtgctggagggtgagtgtgtgctggaggtatcttggggatcgcccaccctggctgggctaggtggggaaagggagagggcatngccctgacgtctccccctgccctgacttcccagcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgacgacaggcagctgccttctggtctgcatgacactaagacgcttgtccacagcggcgacccaggcctccaagcttgcacagaggcaaggccagacttttccgtcgtttattttcaataaataagcagctcagcgca

SEQ ID NO: 612202 - DNA, 567 bp, Homo sapiens
aatcactgtatgctgttgggcgaattatgtactcccatctctgatggccttgtctaatgatatcatcaatgagtgtctgacaatgcacaagatgtcaattttaaatatggcttcaaccttagctgacttatccttttcatggactcatgtctattaggatgatgttagtaaatgtgtcgcttggtgagcgaggtatcgtcctcgtgttctacaccagagtctagagtgcagctgggtgcaatcgttggcatcacctgcgaacgcttccatcgctcctggtgttcaagtcatatgctcctgacctcatccatccgtgagtagactggagacatagcagcgtcagtatgcacacgcaagaccccagctaattttgtgtatttgtagtagacgacggggtttcaccatgtggccaggatggtctcgatctcttcacctcgtgagccacctgacttggctcccaaagtgctgggattaccaggcgtgagccatgcgccctgacattttggtgtgtccatcaaaggagcaaaactgaggtaattcagattctgtctttgtgatcttctagga

SEQ ID NO: 612203 - DNA, 404 bp, Homo sapiens
  misc_feature (18)..(18): n is a, c, g, or t
tcataggttcgcaggganagaggtgtctgaagagctctggtagcaaaaagtgctccttccttgcttaggaacagagagggtatgggctctcttgctgtcagtctgggaggagggttcaaggaggtttggcctcctagggactggagacgccctgtcctcttcattgccttatactaactgtctgtccataggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagtaagctgaagtgtgggcactgagaacctggaagccacccgtgaaggccccttcttt

SEQ ID NO: 612204 - DNA, 6215 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 612205 - DNA, 6017 bp, Homo sapiens
tttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 612206 - DNA, 255 bp, Homo sapiens
atcccctgtgggagacgggggtctcacctggttgagcatggatgggtcttgatctcctgaccttgtgatccgcctacctcggcctcccaaaggtgctgggattgcaggcgtgagccactgggcccggcctatatggtgaattttcatgagagagaataaaagaaactgtgcacgttgatcgaaagatatggtggtataagacgaggaataccaggcatgtggtttccctctctgattcatgatttctgtgtcaac

SEQ ID NO: 612207 - DNA, 5934 bp, Homo sapiens
  misc_feature (2)..(2): n is a, c, g, or t
  misc_feature (321)..(321): n is a, c, g, or t
  misc_feature (369)..(369): n is a, c, g, or t
  misc_feature (488)..(488): n is a, c, g, or t
  misc_feature (527)..(527): n is a, c, g, or t
tntccccgtgtgtagtccagtgtgtagtgtgtcgtgtgtaagtccgcgcgtgtgtgtgtcgtcgtgtagtgtcagagtgtgtcgtgtcagcgtgtgcgtcgcgtgtgtgtgtcgcgtcgtgtatcgtagcgtagtgtagtcgtgtcgtgtcggtgcgtgtccgtgtgtgtgtcgtgtcagcgtgtgtagtgtatcgtcccgcgtgtgtcctcagtgtacagtgtgtgtcatagagtgtgtgtgtagtgtctcgtatgtgtccatgtgtgtgtatgtcgtccatgtcgcgtgtgcgtgtcgtgtgtcgtgtagtcgtgtgtncacgtgtcgtcctcgtgtgtcatgtatacacgtgtgtcatatcgcacntgtacagtgtcgtgtgtgtgtccatgtatgtgtgtgtatgtccgtatgtacgtcatccgtatagtgtccccgtatgtgtccgtgtgtgtgtccgtgtcgtgtgtgtcacgccgtgtgcnatgtgtgtctcacatgtatgtgtatgtgtgtgtgtctcntccgtccgtgtccaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 612208 - DNA, 1010 bp, Homo sapiens
  misc_feature (345)..(345): n is a, c, g, or t
  misc_feature (369)..(369): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (444)..(444): n is a, c, g, or t
  misc_feature (454)..(454): n is a, c, g, or t
  misc_feature (460)..(460): n is a, c, g, or t
  misc_feature (481)..(481): n is a, c, g, or t
  misc_feature (494)..(495): n is a, c, g, or t
  misc_feature (554)..(554): n is a, c, g, or t
  misc_feature (597)..(597): n is a, c, g, or t
  misc_feature (677)..(677): n is a, c, g, or t
  misc_feature (681)..(681): n is a, c, g, or t
gatgatgcatcaatgctgccgatggatcatggagactggggctatatcatgactgacccagtcacctttaatgtaggtggacgcttgctatatcgtacgtcgtctcaccacattgtacggtcagttgaccccaattctcgccatgccctttgtgaatgcgtcacttgttatatggagtgtgaggtatcttcccgcaatcacgtcctcaggagaaactccatccaataaagggcgacaatttatctatgtaattatttgggatacgaacgtagtcggacgcgtccatgttattcaacgagtgatgatcgcccgtccggaacgttgccgtgtaaagagatctttccnaggaagaggtgttgatcccttgtnacacagctntgngaaatnttgataacgcgagaatttcgcattcgtcgactggtgccgtgtggagaaggcaaagangtaacatgcngaattnttcctccttatccacaacganaactttgtgaagnnccacctttggtaggtttacatgaatgtgttgctgcaccatttgtaatatcccataaggnactcgttttgtgtagtacacgcatgtggtgagttacctttttntagaaagaaaagggtatagttgagtatgccatgaatcttaagaataccttccgttggaaagggcctttcatctataatgntctncttacacaacacgcacatggtggacttggtgcatatttcacttacactggctaagcgttaatacccctagttctagccgagttaagaagggtgcgcatatttcccttgaacttaaggcaagggcttatcctcccattaatatgatttccttacaccgaacggtcgaggatatataccagccttccaatttgtaaatgagaacgacaccgcatgcatgaacatggcccgaaggggtcttgcgcctttttacctttctttcgtggaacacacatcgtgtagttatgcaccccagtgaaaagttttcttccattaagcggctcccacccttg

SEQ ID NO: 612209 - DNA, 448 bp, Homo sapiens
  misc_feature (12)..(12): n is a, c, g, or t
ccctccctaagngacgatggatgcagaattccgacatgactcaggtgtttaagttcatcatcaaaaattggtgttctgtgcagatgtatgtgggttcaaacaaaggcccaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctgtgaagttggacagcaaaaccattgcttcactacccattggtgtccatttatagaataatgtgggaagaaacaaacccgttttatgatttactcattatcgcacttaga

SEQ ID NO: 612210 - DNA, 5459 bp, Homo sapiens
gctggagagtagcgaacagaagcgagctgtgctgcgtgcacgcagtgcaagagaggtgctcgctcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 612211 - DNA, 5084 bp, Homo sapiens
gggacggagtgttagcgctggagatggagaaaaaggggcacattctggaatagtcagcacattggaagtagagtttacgggacttgcaggaggacacgtagaatcaaggacttccaggttcctggcgtgtcctttacagagggatttgagggcgttgggaggaggaaaggggggccagcaggaagcggtgactggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcagtcggtcgccttgtccctgcaagcccctcggggttgggaaggggaatttacaaggttgagagggaggcgggtggccgagggggaaggaaagggaaggggacatgtttataaacagacacatgacacgggtgtgggggacaggacgggggtctgtgccacagctctgcctgaagatgtgtcactatcggggtggggaggacagagcaaaaggatgctcacttccttctttcatcttctggatctgtgacacgggctcagagatggaggagggggaacagttatccctctaggtagttccgagcaacgaacttgaggatttcgtcgagcccaatgactggcagtgagatcttgaggaccatgagccactgggtgaggtccagggcccggagcttgaagatcatcggcagggggtcaacatagaggatgaggaagtgcagggacatggagaggcagatggagcccagcagccagatgttcacccagggtggcatccgcagcagggactggttctcggacaggctgttcagtgcattgcacatctcgatggtcaccagcacggacagggccatggtcatgggctcgggggcctcgaagacctcacagtctatgccctcaaagtgggtgttgtcctcggtgcactgcatgaagtgagtcagctggctgtagttgacatgaggcccatcctcagcgtacaggaaccaccaggcagctgctcccacggtggctgcacccacatagcccccgattgccatgtagcggaagaagagccagccactgatgaggggctccttggggctccggggggggcggtccatgatgtccaggtctggtgggttgaagcccagggctgtggctgggagcccgtcggtcaccaagttcacccatagcagctgcaccgggatcagggcctcaggcagccccagggcagcggtcaggaagatacagaccacctcgcccacgttggaggaaatgaggtagcggatgaactgcttcatgttgttgtagatggcgcggccctcctccacagcagctacgatggtggagaagttgtcgtcagccagcaccatctcagaggcagtcttggccacggcagtgccagatcccatggcaatgccaatctcagccttcttcagggcaggggcgtcattgacgccatcacctgtcatggctgtgatctcatcgtaggactgcaggtactccacaatcttggacttgtgcgagggctccacacgggcgaagcagcaggcacgtcggcaggcttcccgctgttcagccaggggcaggtcgtcgaactctcggcccgtgtaggcgcgatcggccacctcctcgttctccccaaagatgccaattcgccggcagatggcaatggctgtgcccttgttgtccccagtgatcatgatcacccggatcccggcgtcacggcacagctggatggagcccgtgacctccttgcgcggagggtccagcatgcccactacacccacgaatgtcaggtccgtctcatactccaggaacctggcagagtcatccaggaccatttcctctcgcttcgggggggtgtcccgggtggccagggccaagcagcgcagggtgtcccggccagtgccccactccttgatcaccgccatgatcttttccttcaccggccccgtcagtggcacccgggtggtgccaactcgcacatagttacagcggtcgatgacgccctcaggggcacccttgacaaacatcttgttgcccacagcagcccgggaagatttggctggggagcaatagacagacatggactttctgtctcgggagaactccagggtgaattccttcttcattagctggcggatcaccgagttgcaggcgttggctctctccaccttcgagaggcttctcacatccgtgttgaacacattcatcttctccaccagggtggtgagtgctgtctcggtggcctcgccgaccttctcatagacacctttggcctcgttgaagtccaaggaggagtcattgcagagggcacagatggtggccagctccaccagcccgtcatactgccctggccggactggcttatcattcttcaagacctctccctctggagcgtaagtggagccggtgatggagaactcattcaggaggcagatgtccccatccaccttgtcaatgataaacatcttgcagacagacatctggttggtggtgagggtgcctgtcttgtcggaacagatgacagaggtgcagcccagggtctctacggagggcaagcttcttacaatggcattcttctttgccatccgacgggtacccagggccaggcaggtggtgatgactgcaggaagaccttcggggatggcagccacagccaaggccacggcaatcttaaagtagtagatggccccgcggaaccaggagcccccatggacggggtcgttgaagtggccaatgttgataagccagacagccacacagatgagggagatgaccttggagagctgctccccaaactcatccagcttctgctgcaagggggtcttgtcctgttctgtggcagccatttggtctcggatcttcccaatctcggtgcccacaccagtggtggccacgatgcccaaggccttgccggctgcaatgttggtgcccgagaaaagcatgttcttcttgtcctggttgacagctcgggggtcaggaacgggctccgtgtgtttgatgacagatacagactcgcctgtcaggatggactggtcaacccgcagcgtggtggatttgatggcgaggattcggatgtctgcagggactttgtcccccacagccacctccacgatgtccccagggacgatgtcccgagccttgatcctttgcactgacttgcggtcagcccggtagaccttccccatctctggctcatactccttcagggcctcgatggcgttctctgcgttccgctcctgccaaacccccacgatggcattggcaatgaggatcaagaggatgacaaagggttcaacaaaggcagtgatggtctcttcaccttcctcaaaccaggccagcacgaaggaaatgcatgcggccaggaggagaatccgcaccaggaggtcttcaaactgctctatcaccagctcccacagggtcttcccttcctcagcagggagctcattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctga

SEQ ID NO: 612212 - DNA, 299 bp, Homo sapiens
  misc_feature (198)..(198): n is a, c, g, or t
  misc_feature (221)..(221): n is a, c, g, or t
  misc_feature (229)..(229): n is a, c, g, or t
  misc_feature (281)..(281): n is a, c, g, or t
ccagtgttagcttaattttaatgtctggggtttgtcatggtgaaattataactattacagtgttggagaacacaaaaaatgttttttgaatgagcctttgggctttttgtcatgttaagcagtgaactatttttaaggtttaatcagggattatttttccagccccgggtttttttaaggaattatttcacacccggnccatttttagcagtttcctcagngatggaanatcatgaatgtgagtcattatgtagctgttggacattgagcaaataaacttncagatttgacgccagtga

SEQ ID NO: 612213 - DNA, 247 bp, Homo sapiens
gtactcagctcatagcgtatataagtgtgcagtaaaagctcgtagtggatctgggagcgggcggcggcagcgtgaggagagcaccgcctgccctgcccttgctctcgggccccctcgatgtcttagttgagtgcccgcgggcccgaagcgttactttgaaaaaatgagagtgtcaaagcaggcccgagccggctggataccgcagctaggaataatggaataggaccgcggacctagtggtgtgggt

SEQ ID NO: 612214 - DNA, 590 bp, Homo sapiens
  misc_feature (471)..(471): n is a, c, g, or t
cgccaccccccctcctggtcttaaagtttgaagcctgcatttgtcttgtctgagttcttgccacaggaaatcaacgagttgaaactcaccagatcactgcatccagacaatgagatgccaaacccctcatccctcctgatttccttatccctccctaattcctttgaccaactcctcttccttacctctccctaactctggttttcccacatgtagttacatttcttccctgctgtataaccccctgattttagttgactagggagatggatttgagactgatccccattttccttggctaaagcactcaattaaagccttcttcccaggcagtactcattgtcttggtgattggctttctgtgcagtgagcaacgggacctagactggagccctggcatttcagtaacagattttggttccctacctgagaacacattgcttgtggctcagctgctgcagactgggactntcagaagccccctgtccagctgtctgacctttttttggctggaggtgggtttccatctttttttctttggctctgctgctgccagccccaattgtattgctgattgcctaggaagacag

SEQ ID NO: 612215 - DNA, 712 bp, Homo sapiens
gggacgggcggtcagcgctctctctatggccgacggtacacggtcatgcagggatcactgacggaccccgggccatcaaatcagggaaggatacagcgggaggccccgcctcccaatccaaggcggtgctcactggggtacctggaccggggcagatgtcaccaccctgcctgctcagttcctggggtccgacgatgctagggacgctccgagttgagggagagtggctagtgagggccaggtctcctgaaaggcgggagatgcagaccgtccgcccccccagcccagagcaagcatctggggcaccagtgacccaggacgggaagaagccagtccacagccgtccactgtcaccgggctcctcgtgtccaggcgcataccgctggtcatgggcgggagctattcaccaatggtgaactgggtatcactgtcagatattccatggctcagggcctgggttgagggagccttagggagacggatcgtccgatcgtgggtgcttgtcctccagtgttgctggctggcttactccgtctacgccaccagtgacctcagcagagaggccctcgtggccacgccatgctcatgtggtgtccccaccgcccacgttgtttgatgtcactgacctgtctacatgtatttatattcttgagattttctaccctcactagaatgtaaactcatgaaggacagacttttcttttctcgtcga

SEQ ID NO: 612216 - DNA, 274 bp, Homo sapiens
cccccacatttacatacattttgacttatgcctaacatcacacacaaaacaccataaacaaaattaaaagataagccttagactgagaaaagagattgtacaaatctatatctgtaaaaacttttttatttatactatattatgtacctgagattaattaagaatgcatgaagatcaatgcatactatggcaaataaccatacaatgccagtgggccacggattacaaccggcaactcccatcagaggaaaatggattatgaacttgtaaaaat

SEQ ID NO: 612217 - DNA, 299 bp, Homo sapiens
tccagggcttccactggcaaaacactaaagatccaaaagggccttcagggccccagcaggccggatcggtacggtatcaagtcagggcaggtacagtaggataagccactcggtcccttccggggcaaagaagaaccggaggggagggaattctcccttaagacttacttttggtaaaattgtccccgagggtactttacttccccactggatgggaccagggggttcccaagtcatggagcggtaagactggacttggtttggtctccgaatcccaatggttttggaaactcaagtat

SEQ ID NO: 612218 - DNA, 839 bp, Homo sapiens
  misc_feature (276)..(276): n is a, c, g, or t
gaagaatagcccgcatcagggtgcggggtgcaggtgcgggcgtccgaggggccgatggtggaggagcaagggccgggtgaaactgggactcggttcccaaagcctgtcaggatgcatgttccatccaatcccaagaccatggtgcgtgggcaggtgcattgagctgagatggtgtagggatgcaggtgcttggcgcgtgcaggcgctgcggtgtgtaatcgtgaagatactggtctagcggcacttactgaccacgggccgcatcggtgtcggcgnagagtccgcagagtctactcaggtgcagtctagtggccggtgggactagtggcaagcctgtcgtatggatcgtggggtctggggctgtcctgtggagccagacgttcgtgagcctggggtgcgcgttggtcttgtcctggacgctctatcgtgctgtctcctgcgtccgacgatggagttcgacggtggtatgtgtgcgacctaggtgtctgcttgtatcccggtggtcaggctggttatacggcggcaggactgatcctattgagcgtgtcaactgtccgcatgatctgcttcatcatcgaagatgagatactcaggttaaagtggctattactagggccccaagttgactgcatagaggaaatagaccacgggcatggccagagcttgcacttcgttaagtcgagccaggcctaggttcaacaggttggcgggatgattacaggggaagaattctgaggtcccctggtgtcaccatagaatcctggaatgtgcttctatcccatcttttaaaaatgtcaccagcatttgagtccaggttgttccttgaaaaaggctggtgc

SEQ ID NO: 612219 - DNA, 395 bp, Homo sapiens
ttgatgcttgtggtgactctagacggatcccctccttgtagtcagaagctaggggctcttaacgggaggtgagagggagtcatctgtccatctagctgcttctgtgctggaaagctgaccacaaggcgtggtgccaccatggatgactctcccccaagggacttgagcagctctctgtgggccagctccatatccttgagcctgtttagctttaaagtgagctgctctttggtacggcagactctgcccacgtcccttagggcctggcctggaggagagcggctggggcgtcttggctcatcgttgcctccctgtagctgaggctgacgctctgtctgtcctgcagggaggctgtctggctgagggggtctcatgggttcctctgcagtggtcgg

SEQ ID NO: 612220 - DNA, 915 bp, Homo sapiens
agcggattcttgtacagggccgcggcacatgggtcgagccggagtgcgctagagctccgtgcgctgctggggccgcgagagcgctggggagcagcggacgccggctgctggggaggggggtggggtggtgacggacgcacacgtgcttcctgtgatgctgtgcacataagtgggcgtggtggtctggctgacgtgttgttcatatcatgacgccgtatcttgacttatgaccgttacagatccattttctattgtatccttatcattctgtgtattccaaattatgacacccagttatgtagcaaaaaccggatgtggagtatctgcacggtccaggatagaaggcaagcaagtccatgcctactggttcttgcacgtggggcaagcccgcgtcaggggacatcttttggcctgactgcttcatccatgggagactcggtacgtgcgactggaaacatcacctgaaaggtttttccatgtacaatatactattgtttagtggcaagtagtgctattaagtgaaaaggattatacaggtacatggtctatatatgacatataccactatgtgaccttccggctcgtcgcttttgtagaatgccagaagctagcgttctttgggtcaaaccggagcggacgcggatagaggcttcacgccacacatgaaaggtggggcgagttggttttactctggtccctcatcttgattgtccctatttcttcaaatggcggggtaaactaagacttttcagaggttgcgattacggtagaatagggaagaacaaatagttcgccggaacccggtgcacccgctaggaaataccctaggccttataattccccgcacatcggctaaccgagacgtcgctccatggttcccatgatctgggagaaaccccgggtagaaagctaccc

SEQ ID NO: 612221 - DNA, 128 bp, Homo sapiens
tataggagagagaactggggagctggagggtattgtgagccgggtcatgcactgtgttccagcctgggcaactagatggcgatgatcctgtcttaaaagtaaataagcaagtaaataaataagcaaag

SEQ ID NO: 612222 - DNA, 1007 bp, Homo sapiens
  misc_feature (5)..(5): n is a, c, g, or t
  misc_feature (82)..(82): n is a, c, g, or t
  misc_feature (86)..(86): n is a, c, g, or t
  misc_feature (145)..(145): n is a, c, g, or t
  misc_feature (172)..(172): n is a, c, g, or t
  misc_feature (174)..(174): n is a, c, g, or t
  misc_feature (652)..(652): n is a, c, g, or t
  misc_feature (655)..(655): n is a, c, g, or t
  misc_feature (676)..(676): n is a, c, g, or t
  misc_feature (678)..(678): n is a, c, g, or t
  misc_feature (702)..(702): n is a, c, g, or t
  misc_feature (819)..(819): n is a, c, g, or t
  misc_feature (886)..(886): n is a, c, g, or t
  misc_feature (908)..(908): n is a, c, g, or t
  misc_feature (913)..(913): n is a, c, g, or t
  misc_feature (939)..(939): n is a, c, g, or t
  misc_feature (974)..(974): n is a, c, g, or t
  misc_feature (999)..(999): n is a, c, g, or t
  misc_feature (1001)..(1001): n is a, c, g, or t
  misc_feature (1005)..(1005): n is a, c, g, or t
ttccngcgcttacccagcttttcactctctccgcctttctgctggacggcatccaactcagccagggcgagctttagctttncctnaaagacattctttaaggaagtcatttcctcttagagcagagcatcagagtgtcctttcntaaggcgctcctgaaaagattcaaatngncttcgggttgtgctccatctccaggtgcttatgatggtaaaacttgagaagcaaactctccatgaatataatttttgtgatcatgatgattttgtttttaaattggattcttttccagggtcagcaacaacaaaacctcctgaaaaataagcactactccagaaaagtagtattctttccccctgtcacggcaagcctagaaagcctttgaggataaaatctttataggctggtcataattaaaaattctcttaggggcagcatttctttgctggattccttttgggattggccttagaaagaagaataggtggcttttctgttgcttactgtatgtgagaaaagtggtcaattgtagaaaacagtgacctttcctaaaatggcaagatccatatttctatttagctcctaacagcacactgcttaagacagtttaagaagtggctttccaattatggtacatgaaccttttaaaatnatnatggtgattgaaacccctatncnaggcaagcagtctgccactgagtnatgtacccagccccaagtgaatatttgaaattgaaaatttgagcaaggaaagtatatattcatgtgtttgtataggcttgacttttgttgttcttttagacagtcttagtccaggcnggccttaaactttgtttgcccaagataaacttgaactgatcttcatgcctctacctcctaaagagcngagattacagtcctgtgacacngtgcntggctcagaaattctttatcaaaganatgcaagtgtttcttaagggatgcagaagatattntgccgttagtctgctgcaaaccctnancttntt

SEQ ID NO: 612223 - DNA, 149 bp, Homo sapiens
ggttggggataatgggggcagcgtctgtgtgaatcacatccacaaacttggcatcgctggggtccactcggactaattcaggtgtgccttgaaagcaaggttcagctggatccagccctaaaagagataggatgtgtcatgttagtatc

SEQ ID NO: 612224 - DNA, 563 bp, Homo sapiens
tactgaaaaacttgggtactggagctgagtagtacctatagggctgaaaaattacctactaggtactgtgctcaccacctgggagacaggatcattcatgccccaaacttcagcatcatacagtatacccatgtaacaaacctgcacatgtgcccctgaatctaaaataaaaattgaaatgataaaatgtttttgccaggcacggtggctcacgcctgtaatctcggcactttgggagaccgaggtggggggatcacctgaggtcaggagttcgagaccagcctgaccaacatggagaaaccctgtctctactaaaaatacaaaattaccgggcatggtggcacatgacttggtagtcccagctacttgggaggctgaggcaggagaatcgcttgagcccaggaggtggaggtgcggtgagccgagatcgcgccattgctctccagcctgggcaacaaaagcgaaactctgtctcagaaaaataaaccgaaaaaatcttttattgccaaattgagagcttcgttatacctaccatcagaggtcgaacttttaatttatattca

SEQ ID NO: 612225 - DNA, 107 bp, Homo sapiens
ctctagagtatcaccttatctgaccatccccctcgacgctcgcgttcgcatttggcggctccctaccggtccaagcccagtcctcagtcatggtatgcccccttgga

SEQ ID NO: 612226 - DNA, 245 bp, Homo sapiens
  misc_feature (43)..(43): n is a, c, g, or t
aaaagtgggtgcccccggccccaaaaaagccaaaaaacccccnaacttgtaaagccaagccgggcaaggcattcaaagcccaaaaaggccaaacccagtaaacccaaagcaaagtccagtgccaaaagggccggcaaaaaaaagtgccaatgaagtcttttcttggggacacctccctcctgtctcctattttctgtaaataattttctccttttttctctcttgatgctcccccccccctttta

SEQ ID NO: 612227 - DNA, 507 bp, Homo sapiens
cgggtgtgcatgcaggatgcgaccaaccccgacccgggttaaaactcccagggactcttctgctgctgccacctcttgttctctcccccgttcccactcgtgggtctccctcagggcctgggaggcacaggtgtccctgcttgctgatggggctggatgtactgcatccgcaggttccctgcggaacttgggtggctgccctgctgcagcccctgtgctgccctgcagaagacttgtgtttgcctcctgcagcctcaaccctggatgggcagctgatgggcctaaccacacatgatcactggtgtgtatcagcattgcggcttgtggaccccatgtgggctgtcctgacctcgctgtgcgtactgcctgcaccagcggcagggtggccctgtgccgagctgcaggaggccgatggccagtgtccggtcgaccgaagaccttgctgaagttgaacaattggtgcaggtcgtgtctcgaacacggggctcgcgagtcctctcaagccgc

SEQ ID NO: 612228 - DNA, 359 bp, Homo sapiens
cttgatgattaccaggaccgaatgaccaaaggggaaaggcttaatcaggatcagctggatgccgtttctaagtaccaggaggtacacaattaatttggagtttgcaaaggatttacagaggagtttcatggcactaggtcaggtatattcagaaaccattaaggaggcacagcacgtcggggagcagcttatgagagaggaggctgaccagaaccgtttaaaaactgtacttgagctacagtatgttttgggccaaattgggggatgttgaagtccggacttacctgcaaacaaggtttgattggggtgcccaattttttccccagggggattgttcatgttggatgattttttaggct

SEQ ID NO: 612229 - DNA, 255 bp, Homo sapiens
ctggaccctatttgagggtggaatgtggggggagggtaagaatccccctcacggcggcggttttttggcggcagcgctttcccccgcccgccaaccccgagcgccgccttcccgccctttcgggtttgaattgcccgcccgcagggaggggagggaaggggccctcgcgatgggggagggggcacggggcgggggcggcgagcccgaggagagcgggataaacagccgccaacatggctcctcccgccgcggccg

SEQ ID NO: 612230 - DNA, 1156 bp, Homo sapiens
  misc_feature (346)..(346): n is a, c, g, or t
gtatcaacgcagagtggctattacggccgggggttttaatacctgctttgcatattcacacatggtcaactgggacatgttaaactttgatttgtcaaaattttatggccttggtggtgggaaataacttaaacttaattattgttattttaaaccttaagttttaaattattttcacatttttggggggacaaaatctctttttctacatctttctcagtgactgagcgtgtatattattattattatcgctaaatactcttatgattatcacgagaaatatttaaattttttccgaaaaaggttaaccttttgaaaacaaaatatctcaagacgcactattgtnggtttcatttaaaccccttttggccttcccccttttttggggaggcctagatattttgggggtggggctacccattattaccgaaatgtttcgttcaaaggggatggggagcattctttatgatttacgcaaaaaagagaagaacgagtttcgttaaacagttttaaagaaaagccgagtgggaaaagttttgtttgtataaagcacgaaaaaggtttttatgttaatatacacgatataatatattgtccccgacaaaaagagtgtggggggtagcaccacgtttttttaaaaagtctttttatcaaacacggtttcttttcaatgttgtgatatataaaaaaagagcccgccgattatttttatataattattgagaaagattaaagcatagtagaagatgtaaaagaacaacaaaactagccaggacagaaaacgattttttttttggtgggggggcaccacccaatgattttttttctatctgggggggggagaaaaaaaaacaggggggggaaggaatatttatttattactatagatagatattatagtatcacgcaaacacaccgagagcccaaccagaagaagaaggtggtctttttaggacggattgaggggtgatcgcgggctgataagagcgcgagagcgagggtgatacggatgtgaaaaagacgcgttttttttttccccgcggtgttttttttttcaatagaggataataagtcgataagaaagagagagccccagcgacgatgttttctttatctaccacccggggtggtgggcacaaaaacagaggggggcaaa

SEQ ID NO: 612231 - DNA, 834 bp, Homo sapiens
taacacatttactcggttttatttacccttctctgatttttgaaatctaaataaaggttttggctaccaaacaaaagggaaattaaaaaaacccagggccccgattaatgtggattgcagataacgggttgtataaggccccatccggggaagggtgtacatcttcgtgggaacaggctagcgtgtgtggcccagggagctagcaaccgtggttagaaaacagcaagtaagccacgagctcaagaagttctgaggctgggaacacagaaaagagctccttcctgcttccacccgaatctggttcgcatggccttggaaaagtagcaaacagcagcccgtgtgataagcagttcgtggatcatgccctctttaatgtatacgcttcgtaagggccgagaaatgacgccctcctcgtccaacgaaaagcggtggttgtgcaccatgttgcaccggccctcatttaaggcatgtggtgcacacatcttaataatttcacaacagctcaaggaccagtgcgtcgttgaattgcagggacctctatgggcaggctcagtgatattcaaccccagaagccaaggtgtgtgaaagctcactctttagcagactcacgaagggtctcctgcagaggcggggggtgctaaccatccccagggacctggcaggggaagactctgaatctctgtttcccctcggttgtggacgggaacttctattgacgcactggggcaccagcggggcccatctagggagggcccagttgcccgttcttggaaatgacaccgaatttggcttgctcttagaagccttcgtggaaaactccaattccggagtccg

SEQ ID NO: 612232 - DNA, 294 bp, Homo sapiens
  misc_feature (242)..(242): n is a, c, g, or t
ccccggctaactcagagtgggccaatgctcgtgggaccttgctggcttcaaacaatgttaaccagcttttccagcccatttgcacaacgtaacgtttctgacaatttccatttaagcttccatctttccaaacacatggatgaaacacacaagcaaagcagaatgggtgcgagcttcaaggcagaacaggagaatgaaggggggaggctgtcacgtggcagcgttcatccacagggaacccngctcacttctaagtcaggctttaagaagagccaactctgtgaggatccagaa

SEQ ID NO: 612233 - DNA, 797 bp, Homo sapiens
ggggctgatacagagtttatggaattagatttttctatttacaacgtgagaatcacatctacatactatttggctagtctacagtgggtacattattcccaacaagcttaagacttaccagtgaagtgggctcattcatacaaaaacacactcacactaattctttaaaaacagtaggtgcatactttatacctcctccatataaagccaactttggattaaaaaccactagttttcaaagcctcagtcctcgtgatttggaagatgaaccaagatatacgccatagtgatcctacaatctatttaagtcatttggtacagcgtgctatcttatgggactacagtaaatattttttaaagggacaccaatgtgaggggcaccatcgggggttaaccttaaccagaaagcgggtttcctcctcctcacccccaaaaaaaaaaaaaaaaaaaaaaaaataaaaaaaaaaaaaaaaaaaaaaaaaaaaaaaaaagggggggggggcacaaaaatacccccggaggggccacaaaaccggccacaccaaattttgtaaacaggggcccaaaggaggacaataaagcgagaaaggcggcgtaaaccaggtggaacgggaaaccactgaccgaggaacccggagaaagacccaacacggggggcgaacaaggtgggcaaacacccaaggagttaaagccccaggggaaaaatacacccagcggaacaggtgaaccccagcacaaaatctcggcataaaattgcccacgaagatcaaaaaagcggcacagcaaaacacgaaagt

SEQ ID NO: 612234 - DNA, 421 bp, Homo sapiens
cgagttttgagttttcaggtccatcaggtcgtttaagacatttacatgtgttggttattctagttatacattcgtgtaaattggaagcaaagttttcaacttctttgcctttggtttgaatttcctactgtagctcagagtagtttgatcgtctgaagccttcttctctcaactcgtcgaagtcattctccatccagctttcttccattgctggtgaggaactgcgttcctttggaggaggagaggtgctctgctttttagagtttccagtttttctgctctgttttttccccatctttgtggttatatctactttgggtctttgatgatggtgacatacagatgggtttctggtgtggatgtcctttgtgtttgttagttttccttctaacagacaggagcctcagctgcaggtctgttg

SEQ ID NO: 612235 - DNA, 299 bp, Homo sapiens
gtgctcacttcatatccactcctccagtgatgacacacaacagagagcagctattttattatttctaaatcatgcaaataaaagtgtacgtgaatattaaatataaatggccctacttcaggtaaagaaaactactaggataaacttcaactacatttatgacgaagaatttcaaattctgaatcataaattctgaaacctcctgattgtattgtgttttctttccactgtttatcacaaccaagtaatcttaattatcttacaacttcaataaatgactgactttctatgctggctgt

SEQ ID NO: 612236 - DNA, 207 bp, Homo sapiens
gcagcatcagcatcagcacattagcagcatgaccttagcaggaccacattggcaacaccatttgcatggcattgggcattggcaaaggcaatttgcaaagcagcagtagcaaagcatttgcaaaagccaaagcagcatgagcaccggcattgcagttgcagtagtagcatgagcagaagcaaggcagttgttgcaccagcagttgca

SEQ ID NO: 612237 - DNA, 231 bp, Homo sapiens
cagggaaccgtctataacgtggaggtcagtgtcatactagaggagagtctttttataggtcccgagtcttctgtgctagtgagtatctgcctagtctcggagctgagcgatggtaacgatcttgcctttctctcctcttccaccctcattctgcactcggccgccctgggcagccaggatccgctcagacactaccaccacgaggggagtccgaggcagacctgtaaccag

SEQ ID NO: 612238 - DNA, 335 bp, Homo sapiens
ctcgatgtcaggcagagagaagatgacatcaatatgtgagaccttcaacaccccggccagatacagtggacatccaggccgtgctgtcccatctacgcctctgggcgcaccactggcatcgtcatggacatctgagagaaggggtcacccaaaacggatgcccatctacgagggctacgccctcccacacagaccatcctgcgtctggaactggctggccgggacctgaccgactacctcatgaagatcctcactgagacgaggctacaagcttcaccaccacggacgagacgggaaatcgtgcgcgacatcaaggagaagctgtgctacgtcgc

SEQ ID NO: 612239 - DNA, 1225 bp, Homo sapiens
  misc_feature (891)..(891): n is a, c, g, or t
  misc_feature (1225)..(1225): n is a, c, g, or t
gcaccaaatggcggatgacgccggtgcagccggggtggcccgggggccctggtggccctgggatcggtgtgtgacacctgcggtggcttccgcgggcagtgtttcgggcagtaggcatcctggggccggggtcgctggcctgtgtgcactgcgtggccaggggcctgaggcctgcggcagctctgctggagtgcaaggtcggaggagtacgtgagtggatgcccagtcagacgagagattggtgccgcgtatggtcgaaaggacgagttggaagatcaacgtccgctggacggagagtcgtatcgtctgtctccctgtcgccattaagggaatcagaggctcattgagtttcttccttggtggcgcctcgtctcgaaggcatcgaggttctctgaagcattatgccatagtgcgagaagccaggacccgtgccaggtcgagcgcaccgaggttaaaggccatttgtcgcgtaatcggggactacgagtggccacggtcggtctgggtgttaagttgctccaatggaggtggccacctgccatccgtgggtgccatcatcctgtgccaagctctccatcgtccccgtgcgcagaggctactgtggggaacaagatcggcaagccccacacttgtcccttgcaaggttgacatggccgctgcggctcttgtgctggtacgcctcatccctggacccagggtgcactggaatcgtcatcgcaccttgtgcctaaagaagctgctcattgatgcgtggtatccgatgactgctacaccttcaggccggggctagacttgacaccctgtggcaactttcgcgcaaagggcaacttttgatgccatttctaagaactacaggtaacttgaccccgaactttgtgaaggagatggttntaccaaggtctccctattagggagttacctgagcacctgtaagagcccaacaagagttcgtgacaggaccaggtccccgtgcgtgtctacacccatagcgttttataccgcagacaaaaggagttacggcttgaaaaaaaacaaagaaccgggccatattctgtgcggaaacgacaaacaagacgagggacagcacttcgtgcacgcccttaaaggagagagagcgaccatgagaatgccgaagaaaatagcacaagaaaagcaatagagaaacacacaaagcgagacagatgacacgacatcaagcatactaactatctgactatataatgan

SEQ ID NO: 612240 - DNA, 656 bp, Homo sapiens
tgaggaccgcacactgggtcgagttcgtgaccaaatactcaaagacagacagtcaaaaaggatgaactgtttctgcgctagtgaaccagtgtgtttctgaatgcccactgggaaaagcaaaacccctgtatgagagtttcttgagatcagaactgagactgtgtcaggccccggggtaggcaataggaatacatctctgatgatgaacactttgcccattcaaacaggaaaacacctcatagcacaacctgcattccaagctttcattatgtatgcgggaataggtcatttccaaaaccacttccctgcatacctctctacacaaactcagcagaagctggacacaaacaagaaggtccaaggaacacttaaggaactcaatgccctgccccacccaacaacagccaattaatgttgcacagcctgttttagtcttggagggctattctgtatctattgcaatgactcaattctgccactttattgcaaaagcagtcacagacaatatataaacaaataggtgtggctatgtgccaataaaacgttatttatgaaaacagacattatttacgaaaagaggaggtggacaggatttggccatgagccacagcatgctggctcctgctttactacaaatagatcccttggaaatcgag

SEQ ID NO: 612241 - DNA, 111 bp, Homo sapiens
caaaaatgcttataccacatttcaagtaccaaacttaaagcatagaaacacaacgacgattatatactctattctacaatcaacgggatattcgacaaagagcagagaaag

SEQ ID NO: 612242 - DNA, 116 bp, Homo sapiens
ctgaactgaactttatttactcattcaaaagaaagtggccctcactctaagcaaatatatcttgtgctttatcttctggcatactgagatactttctaaagtggtttccaattcca

SEQ ID NO: 612243 - DNA, 442 bp, Homo sapiens
ctgaagtcataagcactgcacctgtgaaattgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaaaaaagatagagagataaatataaatgagaatgaaggtaaagatgaaagataaataatgtataaggaaagtattaaaggttaaatgggccccctgctggatggtacagccaccttaaggctggtgaagagacaagtccccctggattgtgttcatgtatcgatatggttccttttccgtcaccctggacattgtcagggtattgaaagtgccgagatcctgcaggctgtgcg

SEQ ID NO: 612244 - DNA, 572 bp, Homo sapiens
  misc_feature (294)..(294): n is a, c, g, or t
tttttatctttcattttggtccccttagcccaagtaaaaagaatagtaattccgccgaggagggggaatggcttgttgggagcccatcagggccctgggagcccataaagattcacccatggttgttgaacttagagtcattctccggcttttctttataattcccccatatacgcaaagaagatatgttcttgttaccctgggaccacacaaagcccccaatatagtaaggtttttcttagataatcctagatgaaatgttagagatgctatattatccccctgtggccctgntttaggaaaggggctcccccccaaagattgggttgctctcccgggggcccaacccaaaaaggtttggcaaaatcgggctcagggaaactttgcccttctgcaacccccggggggggccccccctgcataaagcttccctttaaaacaaaggggtttcaaaacattttgcccccccattagcttttttttttttttttacctttttggggggaaaaggattttttaaaagtttgtcttccaagggttttataaaaaggaaaaaaagtttttccccttta

SEQ ID NO: 612245 - DNA, 872 bp, Homo sapiens
ggattggtgcagttctaatccctaaatcataatcttaaaatcaggaatgtgtggagaacagagccatgtcatatcactttgctcttaccattccttttgatcagcctcaattcagcgctcattgtgtagtatgttttttctttcctatgaaataattcaacagaaagcatttcattttactttggctattgttgcaatatatgtttaataatgaccaaaggtgcattctgagtttttacaaggaatgtaatactggatgccttaagaacatatcttagtttctcatgtgataagttaggctttgtctgatgtattttccttctctctattgtctaatgttgaggttgtgtgaaggaagtgtatgttcttagtaaagcattttttcaaatataaggtacatgccgtatacagaacttaacatttgccacagaatatatcactagtatattttcgagaaagaaaagtacggggtgagttctgttaggaaataagagatgagacgtatgtatctcacaaaaaatcttatttcagaatggacaatctttttgagaaaagtagctgagtatactggtttaagaaaaatgcttgctttcagaattgacggttaactctacagtcgggaggtgactctattacgtcccgttattacttctccacggttgcttaatcctctgtcgcactttgtccgggggcagccgggcatatcaaggcaacggctggtacaacttcaaacttacggcacatgtccaggaccatggtgcgctgaagaccgagggaaacgaaggggcacactacataaggggacacaagccttgtggacgcgcacattgttgacaaaaaaattcgtcaaaaaaagcgccaaaaagggaaaa

SEQ ID NO: 612246 - DNA, 134 bp, Homo sapiens
cccaagatcaggtgggggaccatcccatcatagtccatcccaggatttcatggcaaggttcttctcactcattcagcacttttcgcttcgcaagcgcacagcttctccaaatccatggaggtcaccgcagctcg

SEQ ID NO: 612247 - DNA, 761 bp, Homo sapiens
tggccgttcggggccatcgcgcgcggggccggctgtcgccacggttctccgtccgtggggctccttcttcctgcccagggccggccgccatcgctgcagcctcccctctgtttgcttgctgagggtcatccctagctcgtcggtccgggtgccgtggtcctgggcctcgatcatggctcttagtgggctgcttggacgtgacctgatgtcggtcccggctccagcgcctcgcacactgggtccatcggagccttcctgcagtctcgtgtcgtgctgctcggccgtgcggccctcctctgcatttctcatgcattatgtctgtctgctcggagaccaatgcgcaatgctcctgtcccgacggtgctctcgggatcggggagtctgtgtcgccggccttgccctgctagcggcatgccaccccactacccgcttgtgaccacgtcccgtcttgcttgccactccctcaaccctgcctcttctgagcggcctctgagtaaccctggtcgggatggtctggcccacacagaaatggtggtcaagaagatcagggaatgactgatgtagggaagtgccagggctgcccagaagtctacagaggcacctacacgccagccatctgcaggagagtctcagagggccagtccccatcactgcctccatccctgctgcatttgcattcacttccataggccagagctcaggggaacagggagagagctccacactgtaaccactgggtctgggctccatcctgcgcccaa

SEQ ID NO: 612248 - DNA, 339 bp, Homo sapiens
gtataacttttcttctagagtagactgaggttctacattatggagaggagaccccagaagtgatggatccttctcagtgcatcatatacaagtgggcatctcatgtcaaaatatcttgtaactggtgatgttagtcgtcggttacacttgaagttaacgtgtggagaggtggcaactgatggtttactcttctgtactaaagtatctgttttctccattataatataattagtatcttatggggagatactatgagactatatcaatatcctgtgtctcatcatgctttcctccattgatatttattatgcattgtctatgagacaattccttactcaa

SEQ ID NO: 612249 - DNA, 550 bp, Homo sapiens
agaaggtgtgatcgcagaacttaaggtataaaccgtttgttttagaaaaattatacgttaaggtcaggggatacatgtgcagagagtgtgcaggttggttacataggtgtacatgtgccatgggggttgatgagccgatcaacctgtcaactacattaggtattgctttaaaggctgggtcaaatggtatttctggctctagatccttgaggaattgccacactgtcttccacaagggttgaactaatttaccctcccgccaacagtgtacaagtgtttctgtttctccacatcctctctagcatttgtggtttcctggctttttaatgatcaccattctaactggcatgagatggtatctcatggtggttttgatttccataatgaccagtgatgatgagctttttttcatatgtttgttggctacataaacgtgttcttttgagaagtgtctgttcatatccttcgcccactttttgatggggttgtttgtttttttcttgtaaatttgtttaagttccttgtagattctggataacacgttcgcgag

SEQ ID NO: 612250 - DNA, 173 bp, Homo sapiens
tccattttggacaaaaatgtatttctgggacttcccaaagtacagacattttcccaggccccagggggtaaagcaatgaggggtgaagtctgccagggtctggccggggccgcttagcgtgggaaggaagggaaccccccttttcaccacaattggagagctgggggaacaac

SEQ ID NO: 612251 - DNA, 196 bp, Homo sapiens
gttgactctagcaggatcctcctcgccctgtacagattagcgtgaagaactatgaaccccagaaggacaagcgcttctcggcgcaccgctaggtcgtaagtccactccccgcgctcagtactctgtgtgtgtcctgacacccccgccgtacggtaacgaggcgaaggcggcaggatattccccatatggacctaga

SEQ ID NO: 612252 - DNA, 629 bp, Homo sapiens
tttgtttaatcattcacctatgtggacattgggtcattttcagtttctaaagtggttgtaagccctagtaattcatgtcatacacagtataaaaccctttcatcatttgtccaactgtaaggagttctctgatctcttaggaaaacagtacatcagataatcttcaaatatttattttatatttttgcatgattactgaaaaatatttgaagatatttccaacatttggtagaactatgatttagtatataacatgttatgtttgccttccctttttttctcccaggtatgcaataagagagagcaacagcattgtaaagatatttaagaactttaaggaaaaaaaatcatttaaaccagatttggagcagaaagtgagtgtgatctacatatgatacatttttaaattctttgtaatggctcaaaaatgcctaagcaaaactctttttatgttccctttaggtatctacggcggcttcttattgggagtcagatctgtaaatggcttagccttctatgactgggacaatacagaactcatacgaagaattgaaattcagccaaacatgtgagtttcccctccattgtgttggaatattatccgtgatgagtctggggtcctaaggcag

SEQ ID NO: 612253 - DNA, 201 bp, Homo sapiens
caaaagcgggatcgaagcagctgtagctgtcggcctacaccagagccacagcaacgcgggatccgagccacgtctgcaacctacacgcacagttcatggcaactccggatccttagcccactgaggaaggccagggatggaacccgcaacctcatggttcctagtcggattcgttaaccactgagccaccgcttttgtgtt

SEQ ID NO: 612254 - DNA, 350 bp, Homo sapiens
  misc_feature (51)..(51): n is a, c, g, or t
  misc_feature (79)..(79): n is a, c, g, or t
  misc_feature (86)..(86): n is a, c, g, or t
  misc_feature (93)..(95): n is a, c, g, or t
  misc_feature (97)..(97): n is a, c, g, or t
  misc_feature (106)..(106): n is a, c, g, or t
  misc_feature (116)..(117): n is a, c, g, or t
  misc_feature (124)..(124): n is a, c, g, or t
  misc_feature (138)..(138): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (156)..(156): n is a, c, g, or t
  misc_feature (159)..(159): n is a, c, g, or t
  misc_feature (161)..(161): n is a, c, g, or t
  misc_feature (165)..(166): n is a, c, g, or t
  misc_feature (204)..(204): n is a, c, g, or t
  misc_feature (208)..(209): n is a, c, g, or t
  misc_feature (213)..(213): n is a, c, g, or t
  misc_feature (231)..(231): n is a, c, g, or t
  misc_feature (233)..(233): n is a, c, g, or t
  misc_feature (236)..(236): n is a, c, g, or t
  misc_feature (240)..(240): n is a, c, g, or t
  misc_feature (244)..(245): n is a, c, g, or t
  misc_feature (297)..(297): n is a, c, g, or t
  misc_feature (307)..(307): n is a, c, g, or t
  misc_feature (309)..(309): n is a, c, g, or t
  misc_feature (345)..(345): n is a, c, g, or t
tccaggtcttttaaagacgactagtcccaaatgttatttcttggcataggnggtcttcttagcttggggcggtgtgttnttgtgtnccgtgtnnngngtccctggngtgctccggnntgggcgnctttttctgattgngnganagnggtgtggtgngtncntggnntcgggggttcttgcttggggcggggggactggttaggngggnngggngggatgatctcattggtntnttntggngggnngttagggggtggggtatggtttggggggtgatcggggggctgggggtttggngttgggtttncntgggtttttgctgggtttggggttccctggccaggnttttt

SEQ ID NO: 612255 - DNA, 254 bp, Homo sapiens
atcttacctggccagataaaaccagcgctgtataggcggcgatcagcacgaggacgatgacggcaatcgtaacagggcgcttcctggattttttggtttcaataccagcatgcgccattgaaaaagcctctttcaatcagatacttgtttgaggtgacaaagcgaagggcatttacaacccgaacaatcatcatctgttctgctgttcccaacaggtggctatattatggcaggattgagtcttgtgaagttcg

SEQ ID NO: 612256 - DNA, 213 bp, Homo sapiens
caagaaaactctttttaaatacatttaggccaggcgcagtggctcatgcctgtaatgccagcactttgggagattgaggtgggtgcatcacttgagcccaggaatttgagaccagcttcagaaatacagtgagaaccccatctctacaaaaacaaaacaggcaggtgtggtggtacgtgcctgtagtcccaactattcaggaggctgaagcgg

SEQ ID NO: 612257 - DNA, 1087 bp, Homo sapiens
caagagggagactgggggcaaggaggagtcgtccctcatggaccttgctagacgtcttcacggccccagactcctgccccgagcacagaccccgtgggggggcccgagcaccgcatggcgtgctgccagataccaaacaggaatgacacaccaagcatcaggacgcccatgggagcgagaccacgccatgtcgcactcgcatgctgcatgtactcacacatggaggcgaggtcccatgccacgcacgactgacctgcgaacactactcggggagagccccttgcgcaggacacttgccttagccacccatgcgaaggaaccacataacagtattgaccccatatgacgagctagaggaacacacaccagaaccaccacatggccaacgccagagcgagagcaagccggccagcccaacaagaccaacgttgacgtccccctctagggagggaaacactatctccccgacgatgagattggggcgagtcccccaggggaccacgcctgagagaccacaatcacaagccccatcgcgaaactcaccccatggagaccacccgggggacaccccgagccaccgacaatccacaggaactaccccatgtcgacaacgcgggtcaccccgctggccccaacaggccccccaggcagccgcacgcggggcgcaccaccacacggaccggcccgggccgggcacctcccggcgcccccgcgagggcacccgactgcggaagctatcatccatgacacccatattgaccccggaaacgcccccgacccaccgcgggcacctggtgcaacggcacaacttccccgcgcgacagacaccacggccaaagggacaccacaccattggcagggccatgggccaagagcaccgaggcaaacacggctagaccacgggacgccccgcggaggccccacctggcgagcagcgagatccaggccccaagcatgacaggcggggcgtctacaacgggggccgcagaccccacccggcgacgtgcgacgcggccatggagaaggcgaccagcaccccaccacacaagaccctggtgaccagcgccacgaaccccagaactcaccc

SEQ ID NO: 612258 - DNA, 1360 bp, Homo sapiens
gaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtaccccaattatgaatttattagtgataactctatttcctggtcagctggactgcacaatcgatacacagaaaattcacttcgtggagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattc

SEQ ID NO: 612259 - DNA, 434 bp, Homo sapiens
  misc_feature (32)..(32): n is a, c, g, or t
  misc_feature (174)..(174): n is a, c, g, or t
  misc_feature (176)..(177): n is a, c, g, or t
  misc_feature (181)..(181): n is a, c, g, or t
  misc_feature (269)..(269): n is a, c, g, or t
  misc_feature (287)..(287): n is a, c, g, or t
  misc_feature (307)..(307): n is a, c, g, or t
  misc_feature (316)..(316): n is a, c, g, or t
  misc_feature (318)..(318): n is a, c, g, or t
  misc_feature (336)..(337): n is a, c, g, or t
  misc_feature (348)..(348): n is a, c, g, or t
  misc_feature (350)..(350): n is a, c, g, or t
  misc_feature (354)..(354): n is a, c, g, or t
  misc_feature (375)..(375): n is a, c, g, or t
  misc_feature (388)..(391): n is a, c, g, or t
  misc_feature (420)..(420): n is a, c, g, or t
  misc_feature (432)..(432): n is a, c, g, or t
  misc_feature (434)..(434): n is a, c, g, or t
tatactttttttagttgtttcttttggcttanactgaccatttccccccttctttttgagttttccatgattaaacttgcccaaataaaaacataacaatccttatgcaagcatatctgccaccacctcccactgcttcctgggccgcaaacagtaaaataaacagtgattaananncatnccaaagtgaaggtttctctttcttctatcacaacatagttgggtagttcccttaaagtacatcattgctataagttggtatcactgcnaatctcaagtcccaaatnatctctttttctggataganagttattcngnagggggcacaaaagggcnngctttggggcntnctgncaaacacttcattggttagangagtttaattttnnnngtcaaataaaattgaggctggcatagggngtacagtttatntn

SEQ ID NO: 612260 - DNA, 1275 bp, Homo sapiens
tcttatccaaccatttataatctttattctattaatttctccaccaggtgctagaatttttcttctcccaaagtggccctcaattctcggacacgtgaattaaacgcataagtgaatttttttaaagcgtggtgcttaaattattaaacaaaattaaaccgcttaagtttttctctgtggctctccaagcacgccattattgaagcaggccaatgtgttcactttatgtgtgtgcccgtgtattcacatttcgaggcaaaggtgttctttcacttttaaattacctcctgtgtgtgttctccattatattgtgtttaagttaaaactccttattctcaaaagtgccttgggataacgagaagaaaaccgccgtggtagcacaacaactctttgtgcacaaggtgcattggatttaggtggtctttcgtggtgaatgttcagaatttccccaatgtggggctttgtttgtggaaagcatttcttctccgtgaatatgtgaaagttccacctggtgcaattatccattgtaaaatttatgggtctttgtttaaacctccgagttttcgagatcagaagccgagcaattggggcctgtgtgtgtgcccttttcaagggacacgagggacacaacaaaattacgggggttttagcgggaattttccattacaggcccaagggtgtgcaccaaattaaacacattgttaacacacagaagctccgaagtttgttggggccccaagggctatttcgagaacgcttttcgacactctaaatcttatgaggacctatcaagtgctcggaactctatgtgggtatattatttatagcccacgcgtgaactgcgcttattcctgtgggtcttaaacgcggtcttattaaaggggggccacttaaagaagaccttcagcgtaaacaattcattattcctgagacattatttttttagtttccgctgaaaaacaaacaacagattctttccaaaagggtgctgtcgtttttcccagctaagctcctgtgctcttttgtcttacccagggttacaagcaagctgatttggtcccagagagttagaacggggaaacgggccttagacacatggtcttgagactttgaggacattcatgaaggacaggaatacactatttattgtgaaggatctatcctaccggagctcaatgggagggataacccatccaaccattggatccacttcctaggatataaaatcgtctcccacattgtgcagtaacaagttgtcataccacagagaatatt

SEQ ID NO: 612261 - DNA, 338 bp, Homo sapiens
tggagaaagaaacccagaaggactttacccgggaaaaatgaccatgactccctggcaaggagtgccccatgcccagttcttagagacccttgaaagccccaaaaaaaaagggggccgccgtggtacaaagaagggggccaccaaaaaggtccctcccttttttgggagaaaaaatgggtttctttcctccccctccacaaggggggggggggggggggggaaaaaaaaaaacccccccccccccccccgcggccctgcaggacatcgtgtaccgcaccatggagatcttccagctcctgaggaacatgcagctgccaaatggtgtcacttacccacac

SEQ ID NO: 612262 - DNA, 129 bp, Homo sapiens
gagtaccaaatgatcccaaaataaatggctataaaacaacatacactgaagccaggtgcagtggcacatacctgtagtaccagcaacttgggagtgcggcggcaggaggatagcttcagcctgggagtt

SEQ ID NO: 612263 - DNA, 219 bp, Homo sapiens
gtcgagccagaacggctgcatagcgaggagatcggctaccagggccgcttcccgggcagccaggccaacctggatgtgcgcgcctaccgcgagcgcatgagcaccatcatccgcaacaccgcgtatgactcgccgtcggaccctgacggactcaaggacttcaccaatgcgcccggcttcgaactggtgggcattgaggcgcagttgcgctggcggccc

SEQ ID NO: 612264 - DNA, 318 bp, Homo sapiens
  misc_feature (3)..(3): n is a, c, g, or t
  misc_feature (7)..(7): n is a, c, g, or t
  misc_feature (11)..(11): n is a, c, g, or t
  misc_feature (50)..(50): n is a, c, g, or t
tgngacncgtntttatttgcctcttaatgataacggactggggggctgtnttgcggtggctcatgcctgtaatcccaacactttgggaggccaaggcgggaagatcacctgaggtcgggagtttgcgaccagcctgaccaacatggagaaaccccatctctactaaaaatacaaaattagccggatatggtggcgcatgcctgtaataccagctactcaggaggctgaggcaggagaatcgcttgaacctggggaagttgggggttgcagtgagccaagaatcgtgccattgcactccagcctgggcaacaagagtga

SEQ ID NO: 612265 - DNA, 258 bp, Homo sapiens
gttgaacaatagcttttccgctgtgttaaggtggttctcagcttcaagtgatgttttccagggcagcttaaattagtgcttgcatattccaaagggagagtgaattggaggtgggatcctgagaaacttgctcaaaggtcactcaaggtcgagttagaggtagaatgataggctgagacactgggcattacagtcaggagaatcagagggagcgacgggtgcagtgcccggtttaaagcagggagcctttataccttc

SEQ ID NO: 612266 - DNA, 117 bp, Homo sapiens
ttttcagccagcctgcccagggtatgccttgtggaagtgtcagtagcaggttccagcaccaggccaagcacactgcactccactccctctcccaccatactcctctttggtacagat

SEQ ID NO: 612267 - DNA, 440 bp, Homo sapiens
cgtcttggttttcctatcagtctttccacatactggtctagggctagataaatgtcagctggatgatgagaagactggaacctaagaagtttagcgaagacgtgtacgattcgagtggtcttcagatcacaccacgcttgatgttggtaccaaattctttccaaaaagtatcactgtattctatcatcagcaatcttcttgatcatgtccagcgttttacgaacaagcttcttccgtaatcaccttaagcagtttatgttgctgaagagtctcgcgggaaacgattcaaggggagatcatctgagtccaccacacccttgacaaaattgaggtatttaggcatcatatcatggaagtcgtctgtgatgaatacacggcgcacatcgagcttagtgtaatcgctctattaagatccatattcgtgaaacagaccacgtgga

SEQ ID NO: 612268 - DNA, 387 bp, Homo sapiens
atcccacctatgatcacatgcttgctagcacccccaattaagtctgccaagaagaacccgagaccctacaccactcaagcacttaacagccagatatagaccgacgggaaaaaattcttcttcaaacaacagtgtttagctgctcggtccccctgaggtttaggtgagtctacctactgctgccctccctaacacatcagcttcatgtgagtcccagagaaagcccagcctaccagataccctgggaatgaccagatagcaagctcagagtgaagcacagagccaggagcggcaacctgtcctaatgcaatatgttgctgatcaagcctcaggccaagaatcactaccatctgcaggcaccaggtgtcaaagggatgatgacaagcc

SEQ ID NO: 612269 - DNA, 912 bp, Homo sapiens
gcctgcggcggggcggggatgcgatgagtgggccgctggagtgccggccttcgggctccatggactgggcgccgcgcccctgcacagcccgccgcagagtgtacgtgcctggggcagtggtgcgcggggccaccgcgggccctgcggggtggcctgctccacctgcggtgggcgcgtgacctgtaaggctggcctctctgcagtcagagtgtctgagctctgccatggggataggggtgtctttattacttgcagttttctctaacacctgggggctaccggagtgtgggccgaagcaggcgctgcagccgcggaagtatccccaggaacatccccaagatgtgagctggaaaaagcctcatccccagctctgcagtctccagggtagagtctggcctttgctgtgctcccaaagcacgccacaacacgtgagtgcacggtgcgtacccataccacgtggggaacgtgaaatggcctattctcatatcctgggggtcttcccttgtgcacagttcttgacactgggacatgcgtgacctaatgtgtaccctgagaagagagcagttgcggctctaggtgacatatagcacgtgagtgtgtctgggagcgctgttgagccatgtccacaagaagtggggcccataatgggcagccgtaaactggtctttcctatcccgtccgtttcagcgtgaaggtagggctcctgtgcagtgacagtccatgtgcgcgtacgcccgtgttagtcctgtggtcaaacgagacgcttgagtacaatgtatggcaacaaccatgggtgacagcgataggagggatggacctcgtggccaggtgagactgggcattggatgacagtcctctattacagcgcgcccctatgtaatttgccgcgcataattctacaggacacctgaa

SEQ ID NO: 612270 - DNA, 110 bp, Homo sapiens
ctgtggtgatgagaggcctttgtcccggcccacccggggtcaccaggaaaggatctgaataaagaggacccttcctaaaagaaaaacaatgaaatcctttcaggcattga

SEQ ID NO: 612271 - DNA, 4175 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612272 - DNA, 111 bp, Homo sapiens
  misc_feature (14)..(14): n is a, c, g, or t
taatcgagctcggntacctattgctttgatcaccagaaatcaatacaagggcagcctggatagaacagtgaccagcaggtggacttccaggagtatgctgttttcctggca

SEQ ID NO: 612273 - DNA, 4124 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtaaaaaaacacgacagcacaaacaagcaggagagagacaaaaagcaacgaggcaacacacactacacga

SEQ ID NO: 612274 - DNA, 3870 bp, Homo sapiens
agcggagtggttagtttccaggcccaaaaccagaggtctctcagacatttgtttcaaacggctgattgagggagttcaggggttgggggttggcggttcttgcccagtttagcttgggatcaacagctccaacaacgtgtccaatcaacaacagcttgattgtaaaaagtcctgaatctgctggatgatgaaataattttgaatggataattaaagctcaaagtttcagaatcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612275 - DNA, 4119 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612276 - DNA, 156 bp, Homo sapiens
ttagtctgggctcagtgatctcggtctgaagaggtgacagaatcttcgagagcttcaaagattacagatgcctgggacctagagtttctgattcggtaggctaggatgatctccaggtgattataatgcatactcaatatttgtgaccctattcca

SEQ ID NO: 612277 - DNA, 4110 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612278 - DNA, 4311 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctgggctgtgtcgtcccaaagatactaagtaacaggcagaattggatatggcacaaatttctgtttaaagagatgcggtctcgctctgttgcccaggctgttgtgcagtggtattcacagtcatgatcatatttctctacagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612279 - DNA, 522 bp, Homo sapiens
caccatgctcagctaattttaagaattatttattccttattatttcttttgttttctttgggggagagacagcgtcttcctctgttgcccaggctggaaggcagtggtacaatctcggctcactgcaacctccacctcctgggttcaagtgattcttctgcctcagcttcctgagtagctgggattacaggtgcccaccaccatgcgcggctaatatttgtacttttagtagagatggggtttcaccgtgttagccaggatggtcttaatctcctgacctcgtgatccgccccgctcagcctcccaaaatgctgggattacaggcgtgaaccagcgcacctggccagtagtctttccttctttaacaaaaagcaaataatcactttgcttaaaatccttcagtgtcttcctgttgcacttcaaaacaaaatataactcagtgtatggtctatacctttctgtcattcttctcttttattttattacgctctttcaagccgtttcgcatcatttttctacatg

SEQ ID NO: 612280 - DNA, 281 bp, Homo sapiens
agtagtggtataaccgtgctactctcaacccccgggcacatgttgccaagagtacagtagagttaccaacggctactcctatgctacgactaatcgtcccaacaatgatatcactactcactgacgtgactgtccaaaaaagacataatgtgaatcaacacaagcacccacagcctagttattagcatcatccctctactattttttaaccaaatcaacagacaacctatttagctgttccccaaccttttcctccgaccccatgatgagcgttactgctg

SEQ ID NO: 612281 - DNA, 4174 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagggttttgctttgtcacccaggctggagtgcaatgacatgatcacagctcactgcagccatacctcctgggttcgagtgatcttcccacatcagcctcctgagtagctgggactacagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612282 - DNA, 271 bp, Homo sapiens
tcagccaaacttgtctgctttggattttttttttaaagtataagtggtctatatttttgtttcacctttttaaagtgtaaatgtgttttaaaaagtaagcattttatgtgtgtgttcccataacgtgacattcgtgatgtgcagaccttcatttctcttccccctctttcatacccttcctctttttcccccttttctacatatactcttgggtattggggtctctaaatataagagtgggtgtgctttctacaaaaaaaacaaaaaagag

SEQ ID NO: 612283 - DNA, 359 bp, Homo sapiens
tcatggagggattaatgaccttataaaagagactccagaaagctagcttgtcctatttctgccatgtgaggacacaacaagacagtagtcatgtgcagcccagaagagggtccgcaccagaacccaaccatgctgggaccctgatctcaaactggcaacctgcagaactctaagaaatgcctcctgtttataagccaccagtttatgggactttgttataagcagcccaagctaaggcatatgggcaatgaaaatatcagaattgtttgaaactttaatctattgtaataactcctttcacattgtgtataatacgtcggtttaacaatatgtaataaaattttaaaacaaggcaaaaa

SEQ ID NO: 612284 - DNA, 4364 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgcaaaa

SEQ ID NO: 612285 - DNA, 258 bp, Homo sapiens
tagaggcttagtgggtttttctttctagcggaagaacatgtgtgtcactcgtgtgtgtgtgtgtgtgtgtgtgctgtgtgtgtgtgtgtgtggaccgagcgcgcgagcgagagacagggcgcggacatagggacgcgggagcgaagatgagagctgagagattatatctcccagactataatattctgggggaaatattatgtgctgctcacctgactgtatcgagagggcaccgcgcgtcgaatacgcacgcctgga

SEQ ID NO: 612286 - DNA, 4006 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612287 - DNA, 4140 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatccagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612288 - DNA, 785 bp, Homo sapiens
  misc_feature (3)..(3): n is a, c, g, or t
  misc_feature (66)..(67): n is a, c, g, or t
  misc_feature (80)..(80): n is a, c, g, or t
  misc_feature (93)..(93): n is a, c, g, or t
  misc_feature (98)..(98): n is a, c, g, or t
  misc_feature (100)..(100): n is a, c, g, or t
  misc_feature (113)..(113): n is a, c, g, or t
  misc_feature (164)..(164): n is a, c, g, or t
  misc_feature (177)..(177): n is a, c, g, or t
  misc_feature (195)..(195): n is a, c, g, or t
  misc_feature (229)..(229): n is a, c, g, or t
  misc_feature (236)..(236): n is a, c, g, or t
  misc_feature (239)..(239): n is a, c, g, or t
  misc_feature (248)..(248): n is a, c, g, or t
  misc_feature (263)..(263): n is a, c, g, or t
  misc_feature (267)..(269): n is a, c, g, or t
  misc_feature (272)..(272): n is a, c, g, or t
  misc_feature (279)..(280): n is a, c, g, or t
  misc_feature (282)..(283): n is a, c, g, or t
  misc_feature (285)..(285): n is a, c, g, or t
  misc_feature (291)..(291): n is a, c, g, or t
  misc_feature (295)..(295): n is a, c, g, or t
  misc_feature (308)..(309): n is a, c, g, or t
  misc_feature (311)..(312): n is a, c, g, or t
  misc_feature (321)..(321): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (331)..(332): n is a, c, g, or t
  misc_feature (336)..(336): n is a, c, g, or t
  misc_feature (343)..(343): n is a, c, g, or t
  misc_feature (348)..(348): n is a, c, g, or t
  misc_feature (353)..(353): n is a, c, g, or t
  misc_feature (385)..(385): n is a, c, g, or t
  misc_feature (426)..(426): n is a, c, g, or t
  misc_feature (492)..(492): n is a, c, g, or t
  misc_feature (508)..(508): n is a, c, g, or t
  misc_feature (516)..(517): n is a, c, g, or t
  misc_feature (530)..(530): n is a, c, g, or t
  misc_feature (547)..(547): n is a, c, g, or t
  misc_feature (568)..(568): n is a, c, g, or t
  misc_feature (584)..(584): n is a, c, g, or t
  misc_feature (657)..(657): n is a, c, g, or t
  misc_feature (661)..(661): n is a, c, g, or t
  misc_feature (714)..(714): n is a, c, g, or t
  misc_feature (742)..(742): n is a, c, g, or t
atnctaagtataagctctcttccttcttggtctggtggtttgttttggagctactcgatatttatnnctttttttttgtnccggtcttttttngtctngngttttggtttgtncaacaaagtaaacaattttttgctgtgtggcagtttcttttttttgaaaanactgagctaaaantcggattgtgtttttgtntgggtgtgggccggatcttttgtgatcccaactnccctgangancactgatgncattttgggggcatntttnnnggnttttttnntnntngttgtntttntcttagtgtttgnngnnggttttttntttntntngnntgtngcgtttnattcnggggntgcccagagtttaaattacaccatagtttttntttctttctgcaaatcattctttctgatttgcagttttttncgaacgagaggccatgttagtggaacaaaagtttgatgttcatgcccaacaagctctgatattttntggatacatttgtatnaagcaagnntttttgctctgtnccctgggtggccacagntggtttgtgggggcgtggttnttggatgctgagaganagtagcatacttaaacccacagtacagataatcaggaggcaagcaaaaacaaagctataacttggcagtggtnttcnccaccacttattccaaaaacatattttgcttattaaataagggaaatatggtncagttttgcaatgttaatagctgccagnctctcatattttttataaatatcatttcctgactagcaatgag

SEQ ID NO: 612289 - DNA, 489 bp, Homo sapiens
  misc_feature (110)..(110): n is a, c, g, or t
  misc_feature (187)..(187): n is a, c, g, or t
caattgtttttgtaagtagatatacctctaaatattcattagtgtaagattctctatgttaccatttagcttttgtagaaatatcaactagaattctttacaataaatgnatgcgccggctaaaagttgtccgcctaatccccgaatccttggtaacggtatttccgccctaagcgttttaacgccngcccctatatcttttatccgactctcctatttgcgacttactctcccccacccacccagccagcccctgattcattgtcctcggaacggcccccatacttttgcttatcacacactaaaccgagttatcctctgccggtcacgacaatctcccggaatctcgtcctactctcccgcttatatgccaatttaattctttcctctcgcttttgggaccggggtccgaaaaaaacccggaaccgacccctttaaaaagcccgttttaaaaataaggggcccggaaataaaaaactttagggtcca

SEQ ID NO: 612290 - DNA, 373 bp, Homo sapiens
acccgtattcacattattaaccattaaggaaatacaaactagaatcacaatgtattaccaccacatgcctattaaaatggcatttaaaaaaaaatgcggcagggcgcggtggctcatgcctgtaatcccagcaatctgggaggccgaggcaggagaatcacgaggtcaggaattcaagaccagcctggccaacatggtgaaactccgtctccaccaaaaaatacaaaaattggccaggcgcggtggctcacgtctataatcccagtacttgggaggctgaggtgggaggattacttgagcccaggagttagggttacagtaagctatgatggttccactgcactctagcttgggtgacagagagagactctgt

SEQ ID NO: 612291 - DNA, 170 bp, Homo sapiens
  misc_feature (20)..(20): n is a, c, g, or t
  misc_feature (160)..(160): n is a, c, g, or t
atgagcgtagctcgtgtcgnggaccaagaggcgggtgcgtgtactcagcgcaggcggatcacttgaggtcaggagctcaagaccagcctggtcgatgtggtaaaaccccatctctactagaaatacaaaaattagccaggtgtggtggcgcacacctgtnatcccagcta

SEQ ID NO: 612292 - DNA, 163 bp, Homo sapiens
  misc_feature (34)..(34): n is a, c, g, or t
catagactcaaggatgagggggttctgttggtanagtccacttcgggtctcaagggaaggtacagggattttagtgattgactgcaggccacccccttttgtgggttttttttaagatggagttttgctcgttacccaggctggcatgcaattgcgcaatctc

SEQ ID NO: 612293 - DNA, 552 bp, Homo sapiens
ggggtctcaccctgtgggtggctggcaccatcccatccatcttagacttcttattctgggcttcggaggagatctggtggcttccccattaacctcttctcccaatctggctcattccttggcttcgaaatgggatgtcgaccacacccgggcatttttccaagacttttctccagctacggtggtcatcgtttttttctccaggtgaattcctagagaaggggtatccaagaagatgaagaaagagagccatggaaatcggggcatcccgggcagcataaattaccgggtcctctgtgagagtctcagcatcccagtggctgcaacgaagtagatgggactggtcagggggaaagttcaaaacagtctcagcgagggacttcaggctaagcccattacagagcaattggtttctcggccgcatggctaggtatcggaggtccaggcaccccctaagaaggaggccataatcctgcagaagcttgctggcatcttctgagcatcccactccaactttcaagctggtgcctctggaaaatatcccataacggc

SEQ ID NO: 612294 - DNA, 209 bp, Homo sapiens
ggtaaccagcgtgactcgcccgccagaaggatattaaaaagcagagcccctcggttaagggaaagcgccggagatgacggctttctgctgccgcccgaaagatagagggactcggagatcatgcagcagaagcaggaccaggctgccagacgaaggagcacccacgtagctttgtggcttcgtgtcaaccctcttgatctgcgactgta

SEQ ID NO: 612295 - DNA, 145 bp, Homo sapiens
caagatcttaaaacacgcaatctactcttcccttacggatatcgtttggataagtactttatcataaacatccgatgaaggaggtccatcctctgtgagaggtggtcaggaaagtaagctagatctatagaactcaggcatcgtg

SEQ ID NO: 612296 - DNA, 537 bp, Homo sapiens
tgcaaatgttttccatcactagttgccatgatttaaaaatcaaatgctttcccttaaacatctgaatatgtacaaattaccactgtctgaaattttttggaagatttattaatagatggtctagcagtagtgggcctgcattccacatggcacaggaaatggggtatgtgggcccctgttgccatggtctcacctggtctaccccatacactgactttgctttcctatccttataggcttgggctggaggtagtggggccagtgacttgcttactttcatttgtttcctgtttggtcagcagtggtcccagtgatgaccgccttactatctcattaacccttttcctttctgaggtgattttccattccaaactctttagacacaaaactgctctggagccaggcatggtagctcactcctcaggaggctgaggcaggaggatcgtttgagcccaggagttcgaggctacagtgagctatgatcataccactgtactctggcctgggcaacagaatgagaccctgtctctttaaaaa

SEQ ID NO: 612297 - DNA, 778 bp, Homo sapiens
ggccgccagaacacaggtgtcgtgaaaactacccctgtgagccaaaacgtgggaccggaacaggatcatatcagcagttgtcgtccatctggacagcgtagattacgggcaaggtccacactactactggccatctgatctagtatagattgctggagggcactcgacaaaagaaccatatgcaaaaactcttgaggaaggaggcgtgctgagatgggaaagggcgtccttcaaagtatgcctggggtctgtggatacaactgaaccagctgagtcgtgcaacggtggtatcaccatgtgcatatctcctggtggaagatttgagaccaagcaaggtactatgtgactatcatggatgccccaggacacgaagagacttaactcaaaagacatgattacatgggacatcgtcaggctgactgtgctgtcctagattggttgctgctaggtgttaggagaatttcgaagctggtatctccaagaatgggcagacaccagagagcatgccctatctggcttacacactggagtgtgaagacaactcaatagtacggatagttaacacaaagtggcattccactgagccgaccctacagccagcaagagatcatgaggacactagtaaaaggaacgtcaagcaactcaccctacaagacaacaatgagcaaacaagccccggaccaacagaacagactaagcagcaaataaccagaatcaagccatgggagacaagatgacaggagccaaagcgcaaacatgcccagagaacaacggatga

SEQ ID NO: 612298 - DNA, 165 bp, Homo sapiens
acatcactgcgcccgctcataaggggatgatgaggctattgtctttttgtgaacttcttcgatactgtcccatttgggtccaaaagccggttagcgggggcaggcctcctatgaagaggcgggtggatggaattaagggtgttagtcatgttagattgtttcagg

SEQ ID NO: 612299 - DNA, 398 bp, Homo sapiens
  misc_feature (5)..(5): n is a, c, g, or t
tgtantgcgcgtcttcatgtgaaatggtggcgtccggggttcctctccagcactcacatgtcgcactgcctcttcatgtgaaatggtggcgtccgggggggcctctccagacactcgcatagtcacctggctcttccatgtgaaatggtggcgtccggggttcctcctcagcactcgcgtgtcgcctgcctcttcatgtgaaatggtggcgtccggggtacctctccagcactgccatttcgcctggcgtcttcatgtgagatggtgggctccggggtacctctccaggactcgcatttcgactgcgtcttccatgtgaaatggtggcgtccgggggtcctctccagaactcgcttgtcgcctggcctctcctgtgaaaatggtgggactccggggac

SEQ ID NO: 612300 - DNA, 615 bp, Homo sapiens
actgggccggattggatatgactgcaggggggtgtgtgtgtgcagcaattcccaattttttttccttttggcctcctccaaagtcttcaaaaaaaaaatttgccaatctttccaacttttattttttatgatgacaatcaaagccgggccttaaaaccactattttgtacttttttaaacgattagtgatgtccttaaaatgtggtctgccaatctggacaaaatggtcctatttttgtaaagagggccataagataaaatgatgttatccatccatatggatatatggatttccatatagacttggagaattctgccaaaacatttatgacaagctgtatcaccgccttcgtttatatttttttaactgtgataatccccacaggcacattaactgttgcacttttgaatgtccaaaatttattttttagaaataattaaaagaaagattcttacatgttcccaaaacaatggtgtggtgaatgtgttaaaaaaactaacttgatagggtctaccaattcaaaatgtatttcgaatgcccctgttcatgtttttgttttaaaacgtgtaaatgaagctctttacctttcaatgactggtataacattttaagtt

SEQ ID NO: 612301 - DNA, 1046 bp, Homo sapiens
gacgttggtgtgcctctagtcagcggctctgtcgccggtgattctcactctctgtcttttgggttagtgttcaatcgggttccctgtctcggtttgaccgtgccctctcctccttgaccctttccgcgctctcttgtgctccccccaatttgttgggttatcgctttgccacggcccccactgttgtggacccctcgcgggtttacacctcctgtttgcccgtatctttctccacaggggccgctttatcccgcccgttgtcctctccctgtgtatttccgccctgtcctgtggtttacacgtcggtttgtattgcgtgtgtggccccctctcccctttcccatcccccctgcgcaaccttcaacttaggcctcctattttatttacccacctgtaccctaccccgttttactcaaatcctctggatccagggttgagcatcaaagtccaattacccccctgatcggcccactgcgagcagttgccccaccaatcgtcatatgaagtcaccccttgccatcattctactatcaacattactaataagtggctcctttaacctctccgcccttttccccaccccaggacacctctgattactcctgccatcatgacccttggccataatatgatttatctcccccctagcacgagacccaccgaacccccttcgaccttgccgaaggggagtccgaactagttctcaggcttcaacactcgaataccccccaggccccttcgccctattcttcatagccgaataccccacaccattattataattaaccaccctctacccactccaatcttcctagggcaccaacatatgacgcactttcccctgaactttacaccaacaatattttgtcacccagaccctacttctaacctccctgttcttatgaattcgaacagcatacccccgattccgctacgacccactcatacacctcctatgaaaaaacttcctaccactcaccctagcattacttatatgatatgtctccataccccttaccatctccagcattccccctcaaacctta

SEQ ID NO: 612302 - DNA, 256 bp, Homo sapiens
gctctgtaccccgcccgatgttgcgctctgaattacccttcgtatcaccgtcaccctatgcagcttcgggctctggatcaggctctttcacacagatctttttctgcgaggactgataggcgcaagccttgtcagtaaggttgttctctatctaccacagcacctggctgaaccctttcatcttgctgggctcgccaaacttctgcttgaatttctcgaaagggaagaggtgtttgcggcccaggaatgccgtctc

SEQ ID NO: 612303 - DNA, 105 bp, Homo sapiens
tcaatgttaagatggccccttgaccattgagattgccaccctaccaggaagctgctggaaggcgaggagagcaggatttctctgccctcttccccaactttttcc

SEQ ID NO: 612304 - DNA, 4100 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccccccccaaaagggggggggccctttgggaaaccaccaagcggcaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612305 - DNA, 461 bp, Homo sapiens
tggttgtaaacagaaggctaacatgatactggtccgcgagtcagttacatgtaagccagaggagtccgtggacagtgagcccatacccagccaccgacagtccggtggaggcgtgtgactgagatgcttcggaccctctcatttgggatccagcgatccctgaggccaggactgagagctgcagggcagaaggccagttggcgtctgatgtgcaaactggtgcagtgtgcagacctgcgctctccacagcacagggcaggagcaaggcaggcatccacactgtcctgcccaccaccatcccgcagctcaggaaatcacacagttgctaggcttggcagaactgggacttgttttacctgagatgtcagcactgaaattctcgttgggcctcttccccgtcagaaactccacttcagaggtctcggtggagacagagctggccatgccattgggcgccgcag

SEQ ID NO: 612306 - DNA, 4171 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgagcccaccgttgactacgagttcccagtagatggtgcgctagtcattgttcttcctgagccagagtcactaatcccccacagactataaaccatggcccctcggcttacgggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612307 - DNA, 443 bp, Homo sapiens
gggaattaaatacatttaagaactgtgttggcttggttcagaaaggtgggaaaacctaaagtgggggcttccaggctataggtaaatttaaacattttgtggctgacaattgggtgagtttatttgaagacctgggattaatggcaaggaatgttcaggttaaggtaaagctttgtggagaccaagttttattgtgcaccggtatctctcagacaccagacgtcagagagagagcaggttgtaaaatatgtcttagacctaaaagggtatgtggctcttagttgattgtctcctggatctgggaaggaaggaaagaaaacaaagaggaaatggggttctttatagaatgtggatttttcctacaagagacttttcagggcaatttcaaggtatggcggtatatttttgggtcattttgattttcttcttgttatgccaggtct

SEQ ID NO: 612308 - DNA, 3918 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612309 - DNA, 776 bp, Homo sapiens
cgtggtgcctcacgtgtaatcttactacttgggaggctgaggcaggcagactgactgagctcaggagttcaagaccagcctgggcaacatggcgaaaccccatctctactaaaaatacaaaaaattagccaggcgtggtggtgtgcgcctgtaatcccaactactggggaggctgaggcacgagaatagcttgaacccgggaggtggaggttgcggtgagccgagatcgtgccagttcactaaagcctgggtgacagagtgagactctgtctcaaaaaaaataaaaataaaaataaaaataaaaataaaaatacaaaaactagctgagcatggtggcatgtgccggtagtcccagctacttcgggggctgaggcaggagaatcgcttcagcctgcaaggttgaggctgcagtgagccatgtttgcaccactgcactccagcctgggcaacaaaagtgagacccctgtctttaaaataaaaaaagaacatatgaagccacaggatactaagtccaacacatggcgtaacagaaccacatcctaaagactacctaaaagacaaacatgagggatttcctttattacagtggccatttgcttgtggtgcactcagggtactaatttacatttatatttttaaaacacagataacatattcaccaagaacgaacattccacaggctgggaagtgagaattttcttctcagtactgggtcccgcacacatccttccaaggaacgcgcatatacaggttctgggttccaaagatgggttact

SEQ ID NO: 612310 - DNA, 3973 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612311 - DNA, 3702 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaaggggcaacgtcatgttcatgctcctatgcccccctgtgtggtatccgcggaaggggttctt

SEQ ID NO: 612312 - DNA, 186 bp, Homo sapiens
cgcgcgcgatatctcccttagcgggctcctttttcgaacgaaggtcggctacacccaggtgattaaaagcttgatggctcacccaatagcctgtggggtggtctcttcacactgacgcgcgttaacagaatgaagggatagaaaagtcttctgagctactcttttaaggaaaaaagcttatcggcc

SEQ ID NO: 612313 - DNA, 3478 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612314 - DNA, 3272 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgta

SEQ ID NO: 612315 - DNA, 713 bp, Homo sapiens
  misc_feature (8)..(8): n is a, c, g, or t
  misc_feature (87)..(87): n is a, c, g, or t
  misc_feature (102)..(102): n is a, c, g, or t
  misc_feature (142)..(142): n is a, c, g, or t
  misc_feature (168)..(168): n is a, c, g, or t
  misc_feature (237)..(237): n is a, c, g, or t
  misc_feature (243)..(243): n is a, c, g, or t
  misc_feature (300)..(300): n is a, c, g, or t
  misc_feature (335)..(335): n is a, c, g, or t
  misc_feature (348)..(348): n is a, c, g, or t
  misc_feature (353)..(353): n is a, c, g, or t
  misc_feature (370)..(370): n is a, c, g, or t
  misc_feature (372)..(372): n is a, c, g, or t
  misc_feature (459)..(459): n is a, c, g, or t
  misc_feature (480)..(480): n is a, c, g, or t
  misc_feature (493)..(493): n is a, c, g, or t
  misc_feature (497)..(497): n is a, c, g, or t
  misc_feature (525)..(525): n is a, c, g, or t
  misc_feature (536)..(536): n is a, c, g, or t
  misc_feature (539)..(539): n is a, c, g, or t
  misc_feature (595)..(595): n is a, c, g, or t
  misc_feature (606)..(606): n is a, c, g, or t
  misc_feature (623)..(623): n is a, c, g, or t
  misc_feature (632)..(632): n is a, c, g, or t
  misc_feature (699)..(699): n is a, c, g, or t
aggaagtnctgggccgcccagagggacagccctgccctggagcatgtcgccgggagggaagggaaacaagccccccccctcagtgcngaggaaaaggcactnggctgggtctcctcctgccctctccccatccgtgggaganacggggtccttgcctccttgcccctntcagccgcccagaagccggtcctggttcagcctctggaagaagcttttgccgaactcataggtgccgancatganggcacaggagggggcagccttgaagaaccgaggaaggaagcctgccaagagtccctnggtgcccgactcggcccggatcctccgcagcagcngccagggggagtncacangcagggggttcactctnanagcctccatcgctcccagagcgacccggcgttgggtctttaccacgtcaaagggtagagtaagcactgcagccaccgtcccttaaangccaccagccacaaagctcangcccacagaagtntggnccttcggcctgagcccattgagccagcncttcaccagcncanagttgaaccagttcagggctgagaagggcacaactcgaagggcagttgggccccancccagccacanttagccccaccaccctngagccactncagttcgaacacaggcacccagcacccggtacgacaaaagctgaacctgcagctttgttcgcataanctccaggggggtga

SEQ ID NO: 612316 - DNA, 3982 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgcaaaa

SEQ ID NO: 612317 - DNA, 263 bp, Homo sapiens
gaagttaaaattgtgttgacattcatgcgggcacaggttgacaagcttgccctaggcattatgtcgttcgtactctcagatgtattcgatatcatacttcagtattttctgttggacacaccctcacagtcacagttccaacagaatttccagcctatctaatctgttatgacgagagtcaatgtatctcatattgagccaatttagctctttcatactcccccatttattagtattgatcatatcagccttcattctctcac

SEQ ID NO: 612318 - DNA, 3011 bp, Homo sapiens
  misc_feature (2865)..(2865): n is a, c, g, or t
  misc_feature (2921)..(2921): n is a, c, g, or t
  misc_feature (2980)..(2980): n is a, c, g, or t
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccagggcagccactggcgaanccttaacccagctggatggagacaaccctcagcgtgccctgctatacaccactgtnttcctgatagacagcagtgcctcttgcactgagtggcccagtatcaactgagaggagtncaggccggggagagaagaggatgaggcctcc

SEQ ID NO: 612319 - DNA, 377 bp, Homo sapiens
accggtaagatgtacacagtcaaaaggcttatcgagctgttgagagttctttgagtgttctggatcagtgatctgctgtgaactttagtcacgctgaagacagtcttctcagttttcatgactgtgaagtgtgcaaatggtacgcatccttgatcttaggtgctgctgacctactttcccaaagcaaaactgtttaaaattcaaggcaatctgggaacggggactatttccaaacttccttaggcagcacttttcagtggacttccccgcacgctggtttccctggcacgaagcgcttggtctggttactaaagccacgtatcctgattttacagaaacgtgggcaggtccagccgtgccactggtgagctcccaga

SEQ ID NO: 612320 - DNA, 2580 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaa

SEQ ID NO: 612321 - DNA, 328 bp, Homo sapiens
  misc_feature (30)..(30): n is a, c, g, or t
  misc_feature (169)..(169): n is a, c, g, or t
  misc_feature (183)..(183): n is a, c, g, or t
  misc_feature (241)..(241): n is a, c, g, or t
  misc_feature (300)..(300): n is a, c, g, or t
  misc_feature (311)..(311): n is a, c, g, or t
  misc_feature (319)..(319): n is a, c, g, or t
  misc_feature (321)..(321): n is a, c, g, or t
tctatgttttagttttcatttttttaaaangcttcttaaaattcactaaattgggctaggtgtggctcatgcctgtaatcccagcactatgggaggctgaggtgagaggatcacttgagcccagaaggttgaaaccagcctgggcaacatagtgagaccccatctctanaaaaagttttaaanccaggtatggtggtgccctcctgtggtcccagctactcgggagtctgaggtgggaggnccacctgagcccaggagactgaggctgcagtaaggtgtgattgcactattgctctctancctggtaaacngagtgatntnctatctc

SEQ ID NO: 612322 - DNA, 364 bp, Homo sapiens
cgacggctcaaggtagagagcactctaataagtcttagagaatactcatattgtctaacgtgggctccacgggaattttgggtttaaatcctggtttgacaagctgcttcttataagcaggtatagagaagaaaggaaagaggaaaaggagaaggaagaggaaaaggaaaatagaagtatgaatcaattgtttaaaagatggtataataaagtctgcaggagactcatattctgtctaacatgggctccacaggaattttgggttaatatcctatcatgacaaattagaaaggcctaaataggaaacgactaaggataggcacatacagtattttcgtttacttcatttgttttgggtcgacgc

SEQ ID NO: 612323 - DNA, 278 bp, Homo sapiens
ccctctgcactatctccgccttcttcattccctccttcccatgtggccccaaacatttctctcgaatgcctattatgggcatatgtctctgctacgcacccatcagttgtccatgtgctgtgcaactgctaagttccttttagcacttgttccgttggcagccgtcttactcttccggggaaggacacagaaagtagttgtagtacaagggcggcacaaaagtgaatccggttacacatatggaagtaaggcggaaagtaaggcggcaattgtacacg

SEQ ID NO: 612324 - DNA, 827 bp, Homo sapiens
  misc_feature (60)..(60): n is a, c, g, or t
  misc_feature (233)..(233): n is a, c, g, or t
  misc_feature (493)..(493): n is a, c, g, or t
gcttcccacacacttggttttccttgggcattttatttatctctttccgtggggggttgngcccagggggggggggttttccccgggtttctctcccccccctcggtaggagttgttgtccccaaacaggggttcccaattgtgtcaccccccccctcccaagagggggggggggggggggggtgtttttaaaagactttttttagccccccgtttccgggaccccccccccntttttttctctcttaaaaacccggggcctcccccctccggtttctcattggccgggggggggtaatttttccccggggaaacattttcccttgggccttttggggccctttttaaacatttgtgtccaaaaacgggtggtggccgggcgggtatttccggggtttttttccccccggggcgcgggggggggggggggggtgtttttaaatttttcccccccgcagaaaacccccccttcttcgccccaaaatatgggganttttcccctcccccccaaaaacccccttaaagggggtggggtttgggggccccccctttttcccccccctttggggggggggggggggggggttccttttgtcccggggttttttcacccccctgggccccgggggacccccctttttttccaaaaaaaaaattttgccccggggggggggggggcccctggggtccccccttttggggggccccccttttttccagttttgggggcccccctccccccccccttttcccccccccggggtggggttccctttgggggcccccccccttttttttttttttttttttttccccgggggggttta

SEQ ID NO: 612325 - DNA, 386 bp, Homo sapiens
ccttgaatggtgctgaacaggaagagaatttattggtgagtaaaagaggggggcagcacattggaagccctcatgagtgcagggcccgccattatgtccaggagggccacgactggggatgtacttgaccccacagccatctgggatgagccgcttttcagccaccatgtcttcaaattcatcagcattgaacttggtgaagccccacttctttgagatgtggatcttctggcggccaggaaacttgaacttggccctgcgcagggcctcaatcacatgctccttgttctgcagcttggtgcggatggccttgataacttggccaatgtgaaccctggccacagtgccctgggcttttccaaaggcacctcgcttgcctgtttgga

SEQ ID NO: 612326 - DNA, 1293 bp, Homo sapiens
  misc_feature (177)..(177): n is a, c, g, or t
  misc_feature (236)..(236): n is a, c, g, or t
  misc_feature (239)..(239): n is a, c, g, or t
  misc_feature (1167)..(1167): n is a, c, g, or t
  misc_feature (1175)..(1175): n is a, c, g, or t
  misc_feature (1177)..(1177): n is a, c, g, or t
  misc_feature (1209)..(1209): n is a, c, g, or t
  misc_feature (1211)..(1211): n is a, c, g, or t
  misc_feature (1231)..(1231): n is a, c, g, or t
gccagatctttacaccagacaactttgtgttaggtcagtctggggcaggtaagaagctgggccagaggccactacacagagggcgccgagctggtgttgtattctgatcctggatggtggtacggaaggaggcggagagcgtgtgacttgcctgcagggtcttccatgctgacccantcactgggcgggggcacaggctctggaatgggcactctccttatctagtaagatccganagngaatacgcctgatcgcatcatgaataccttcagttgtggtgccttcacccaaagtgtctgacaccgtggtcgagccctacaatgccaccctctccgtccatcagttggtagagaatactgatgagacctattgcattgacaacgaggccctctatgatatctgttccgcactctgaagctgaccacaccaaactacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgccccttncctctccntnagaatttgtgtttgctgcctctatcttgtttntngttttttcttctgggggggnctagacagggcctgcacatagaggcgcttaataaaaactgttggtgaaaaaaaaaaatggcc

SEQ ID NO: 612327 - DNA, 243 bp, Homo sapiens
tcaactgtccagagatgacctggactaattcacggaacagcggtgaggtgagcacgcttggcaaaggatgcagcccctaagggggagtgtctacatctacgaccacctccgcctctcatggtgcctgaaatgagccccagtgtgtatcagattgacagacaggccggctggcgtgtggctctgtgtcgagggaagttacttcactccgaggcggtgactatgcctagctttcctctgacctgt

SEQ ID NO: 612328 - DNA, 139 bp, Homo sapiens
agagttccagaccagcctaggcaacacagtgagacccctgggtctacaaaacatatatatatgagagagagagagataaaaaaacacaaatgcatttaagccagacatagtggtacactcctgtagtcccagctacacc

SEQ ID NO: 612329 - DNA, 1141 bp, Homo sapiens
  misc_feature (131)..(131): n is a, c, g, or t
  misc_feature (190)..(190): n is a, c, g, or t
  misc_feature (193)..(193): n is a, c, g, or t
  misc_feature (1015)..(1015): n is a, c, g, or t
  misc_feature (1023)..(1023): n is a, c, g, or t
  misc_feature (1025)..(1025): n is a, c, g, or t
  misc_feature (1057)..(1057): n is a, c, g, or t
  misc_feature (1059)..(1059): n is a, c, g, or t
  misc_feature (1079)..(1079): n is a, c, g, or t
ggagccctacaatgccatcctctccgtgccatcgacgttggtagatgaatagtgatgatgagctattgactgttgaccatggaggcataaagctgtgaatgactgctgggcttcactaggtcgtgacccantcactgggcgggggcacaggctctggaatgggcactctccttatctagtaagatccganagngaatacgcctgatcgcatcatgaataccttcagttgtggtgccttcacccaaagtgtctgacaccgtggtcgagccctacgagggatgctgataccaggcttgttgcgtcatatcgatccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgccccttncctctccntnagaatttgtgtttgctgcctctatcttgtttntngttttttcttctgggggggnctagacagggcctgcacatagaggcgcttaataaaaactgttggtgaaaaaaaaaaatggcc

SEQ ID NO: 612330 - DNA, 190 bp, Homo sapiens
caagtggcgatatatcccttttagttacgaacatcactgtgggctccccatatgaatgaggagttcacaaaatatgtagtgacctaaagtctgctgctattgttatagcagatatctcttgacggaaggcacagagggaagcattaacatcaagctccatttatcaacgaagaactctatccaacactct

SEQ ID NO: 612331 - DNA, 731 bp, Homo sapiens
  misc_feature (353)..(353): n is a, c, g, or t
  misc_feature (541)..(541): n is a, c, g, or t
gcactacgatgttgcgatctggaaactctggtaaagactcaagctactgaatgccatgctcgttgacttgtgccaagagcaccattaggtctacaactatgacgcgttttcggtaaaggcataaagggtggctccacggtgaagtgtcactacatgagttcagtatgcatgggagtggcacgatagttgatactctaatcataaatcgttcccataattctctgaccaattctccgaattaacgacttagtgtgaactaagtactcgtcagttctccatatgggacctgctgcatagtaagagcatacatcagttaagtatccagattcgggcaaacctatcaacaatcgganctttctataatatcctataaatttcctgggggcattaattcctaacggttacacctttcttggttggcccccttaataatttcctaggaatattattttttctggttcaattgtacacaccatatgcaacatagcaatgcatacctaatcctgtgctctgtaccatgtctggtggctatctgcaatantcgaggcatacagaaagccaatttcacacggcgtggaagagtagactaccggaacaactttctcacaaaattttccaccggaaaatccataaccattagttccccaaacaccttttgttccctccaaatctccaacttttctttaaaacggtaaaaggcgggggccccgaaatggggctttatggccacg

SEQ ID NO: 612332 - DNA, 628 bp, Homo sapiens
taggtttgagggggaatgctggaaatggtaaggggtatggggacatatcatataagtaatgctagggtgagtggtaggaagttttttcataggaggtgtatgagtgggtcgtagcggaatcgggggtatagctggttcgaattcataagaacagggaggttagaagtagggtctgggtgacaaaatatgttggtgtagagttcaggggagatgtgcgtcatattgttgtccctaggaagattggtagtgggtgagggtgtttattattaataatggtttggtggtattcaggctatagaaaaatatgggcagaagggcgcctggcggcgtatctcagatgttagaacgcctgaagactagtctcgagactccccttcggcaatggtcagaagtggggtctcggttgggtctctggctagtggtgggaagataaatcatattatgggccaaggtgtcatagatgggcaggatgtaatccaagagggtggtccttggtggttggtggacaacagggtgggacgagtgttaaagggagccactttattagtaatggtcgatagtccgaatcgatggctagggtgacttcatatgagatggtcggggcactgctcgcaatgcccgatcaggc

SEQ ID NO: 612333 - DNA, 524 bp, Homo sapiens
cggaagcgccgggccgaagagtatgacgtccgctttggagaactacatcaagccgaactgtggccgttattacatcagatgtggagaatgatcgtgggaacactgagatacggttttgagccagacccattaattggattttggatgaaagccatgaacgagtattcagctcttcagagggggtagaacaagtggtactaggattatacattgtaagaggtgacaagtgcgagtcattggatgaaatcgatgaagaaacagattcgtgcgacttgattcggggaatattcgagcgagaaccttgtaaattctgtagcgacactgaggaaaaagctacgatagcttggagcatctgtaaagtctttgtacgagaaagtgatgattgctgaggatgatatatggagttttgatgaatgtgtcacgtggattatgactccttattggattcatgtgtagatatgtaagattaagaatatttcgtacagttcttattgaatggaaggagaagaaacaagaactaaagg

SEQ ID NO: 612334 - DNA, 130 bp, Homo sapiens
gatcagctgctgctgcgtcgactctaagatccccccctggatgtcaggtctggaatgacagagaagatggagattgggggcttagacggcagaatacagtgttaggttcttttatttcagatgcggtatc

SEQ ID NO: 612335 - DNA, 308 bp, Homo sapiens
  misc_feature (28)..(28): n is a, c, g, or t
  misc_feature (304)..(304): n is a, c, g, or t
gccctcatcctcagttgatgagatcacntgagggctcccggaagcgatcagtactgggacaaagatgtggtttgggaggcggatcacctgaggtcaggagttcgagaccagcctggccaacacggtgaagccctgtctctaataaaaataaaaaattagcccagcgtggtggcacacgcctgtaatcctagctacttgggaggctgaggcaggagaatcgcttgaacctgggaggcagaggttgcagtgagctgagatcgcactactgcactccagcctgggcaatagagcgagactctatctnaatt

SEQ ID NO: 612336 - DNA, 118 bp, Homo sapiens
atccccgaattttttaaaagtttaaataaggtaatcaaatatggacatatatttaaatatatgaattcttaaataagtggtattgctagttgaaaggaatttctgcaagcgtacaaga

SEQ ID NO: 612337 - DNA, 106 bp, Homo sapiens
cttcagcagggtaacttactcccaccctggtagcctccgtagacctcaccatcttactaacttaacaaacttagacaggtgtactaactactaatacttaaggggc

SEQ ID NO: 612338 - DNA, 136 bp, Homo sapiens
gttcagtttctacacataacagctgccagacgggtgtagctgcttcttgtgtaccccgcttgtttgtaaatcagccacaaggctaccaggggactgatggcattactcactgtcacttggtgtagaaatttgaact

SEQ ID NO: 612339 - DNA, 621 bp, Homo sapiens
gctcgcgttccggccggagggcttctccagccttgcccggaagctgcgctcggtacccgggtagcgggtcccggttgtggaagctcccgtggcgccgcgatggacctcgaggagtcggaagagttctagagaacgctgtactcagggtgctgctgtctcatggggtcttactgatgacaggctacatattattgcacttcttgccacagggttacagagagatatcaggaagttacaaagcacgtgatcttattcctaatacccaaagtacagagccctcaacgcgggggcttgaaatgaatagatagaagcatgtagttgaagagaaggctgggcatggggtcatgtgtgtgacggttccagtgatatcctgttatcaagacagcgagaagctttaaagaacctggagtaggcccagagttcacgaacgatgttcacgttaatttgggacagcgctaccttcagaagagcaagcggcttatggtagagaggcccaggtttgatacctcctggagtggaaacctacggtccttagacagataagtctaaggtcatccagactgggctagtgagcctgagctggtaagttgatgtcagggtcctcctttcttgaaagtggag

SEQ ID NO: 612340 - DNA, 120 bp, Homo sapiens
aggtacacgtcatgcttgggcctagaataccctgatgagacaacgacgaagaggaagggaggcatatctacaacacagcctctcggcactgtagctccttattttacacttgtctatgca

SEQ ID NO: 612341 - DNA, 2564 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggaggcagaaagaggaaggagacagtgccgagggagtgacagcaaggcagggaggtccctcggtagctagtctggtcattagtcgcacgcgtttgacattcgcatgctattcgttcattactaactctttttcatctcatcttggcatatatggcggaatgtcctggccaagtagtgaccagtgcctgtcgtatgcaacagatctcgatcatcgcaaataactcgtctgcacctcctggaagggtcgggagggtcattg

SEQ ID NO: 612342 - DNA, 944 bp, Homo sapiens
  misc_feature (426)..(426): n is a, c, g, or t
gccccattgtagattgccctgtgcagtaaactttcaaggtgtcggctgccccagattgcttcatttgctgggtgtggaaagagttgctatggccaggcatatgggatttggaagctcagcagaagtgacttctgctctgctggttgctgctccccggctttcacagacatggtatggcagccattcttttatctatttaaccaaaggaaggatgctggggaattgtgcgtcgcgtttgcctgtggggtgtgggtgtgctgtctatgttgttcgcgggggtggttgccattggtggggtcctaatttaagagcttctggtccccttcctttcccttggccaggttggaccccaggattgagacaggcttgtagtaccttaggtctctttcacctctcattgcctgtccctgcttcgagctggttgtnttgtgcgtgggacatgggccttcctatctgtgttttctcaaagtcaggagctgaccaggagcacactaaggtgtggtcatgcatcataaccaacattcactcatctgggacattcttaagatacatttatacaatcatttcagcagtagtactttgtatgtgtcgagagtttacagagctctttgacatacgcgatcttagtctttacaaataaggaaaacagctcagtttgggaagtatcagagatgggattcaaacccagatcctctggtccaagttgtatgtgcactgaactaatcaggcaggacacaaagcccgccactgttctcacagattgttctgtatattgtagcaaaatccttgaaaccattggggtcccttccagtctcatccatacaaaattggcactctgggctgggtgcgagggtccaggcctattatcccagggctttcaagggttaggcaagaggcctctgagaatagagtcaagacccagctgggaactagagatctgtctc

SEQ ID NO: 612343 - DNA, 359 bp, Homo sapiens
gctcgagcgatcctcccttctcagattacagtaggaagcactggggattacaggggtgagccactgtgcccagccttctcaatttttttacccctatatttgttctaaggatatagacagggtaacaggaaaactcaatatttcttttggaataaattgccctctaatcactgatagcatctctatcattattctgtgcctaaaatagagaattatctgctcagtcctattctgcagagtacaatgtcacattctaacctgttagggattgtcttcaaattaatactgttattactcattatgttggcaagtcactttgggcaaagcatattagggtggttcatatgtaggtctttgtg

SEQ ID NO: 612344 - DNA, 980 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggagaatcacctaaatctgggaggcagaggttgcagtgagccgagattgcaccactgcactccagcctgggtaacagagactctgtct

SEQ ID NO: 612345 - DNA, 954 bp, Homo sapiens
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggacaggttggtgtcttcatttagcactgaaggctcctcacactctgagtccagttcatttctcagtcttattcctgcccctttcctctctgatattcttatcattctctgagggggtcatagttttttttgttcttttttgtttgtttgttttgttttgtttttttgagactgagtctcgatctgtcgcccaggctggagtgcagtggagcgatctcggcttactgcaacctctaac

SEQ ID NO: 612346 - DNA, 225 bp, Homo sapiens
ggggccttccaaggttttttttttcccttttgggttcaaaaaaaaacccttgtggggggggtattttgggggggggcctgtgggggggaaatttgtgttccagggtaaaccctttttgggattggggtaatgtttttttgggtttttttgccccccgaaggggaaatgggacccccccccctgggggcgggtccccattttttaataaagggaccccccgggcca

SEQ ID NO: 612347 - DNA, 703 bp, Homo sapiens
  misc_feature (688)..(689): n is a, c, g, or t
ggcacgaggctttcacccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctgggtaagtggctaagcaccttcttgagctcatcactaattcttcccagttttcacttttccagtgagttcccagttagcctggtcaattcagcgtagcatttcacttttggtatttcttcgttctctggccaccccgcagccaaaaagaaaaaagagattttaaaaaaatacctaatttctcattacacttagtttaaaactcatctnnctaagtgatagaat

SEQ ID NO: 612348 - DNA, 143 bp, Homo sapiens
ccctggcaacctcgcctggccaatgcgagtcaccaccgtcgagcggctggtgtggcgttaggcgacgacattatcgagggtaaactgcagggtggcgatcgtctgccggctcaccgtacgctcgcctggcaattagagatcgg

SEQ ID NO: 612349 - DNA, 212 bp, Homo sapiens
gtagatctagcaattgcagcagcagcatttcatttttgtatattccacatcattctacaatggatttacaatagtttgcaatgatacacacaagtacaataaatagaagaaaataagaaacaataatagagcacgagaaaagccagaataaatagagaggcagagtccactggcttttctagtacataactccactggcagacctggtgtga

SEQ ID NO: 612350 - DNA, 863 bp, Homo sapiens
acactggattggtccgaaggagatctttctcttaccgagacactctgtgtgtgcccatttttcctcccggttcgcgtttaggccctcggataactatggggtataaccgtgccctcgagttcgacgttgcgtgggtcccctcccaggtcgccggggattcattgggtttctccccccccggtttgcttgaaatctgtgattatataggcaatattcacatttcttggaaaccccggtcctggagccctgtcctacaggacattaatccttcggggaccagccgtttttccccaggtattcaccttccctgagttcggttttcggccccttcccagtaccgccgtgatatttaagtacgggcgtcaaagccagcgaagtcaaggaataacccccgccccctactaccttaacggcacgatctctctgatttagactcctttttttatacgcgagccctgtttttcgccccccctctttgtgcccacatctcatctaaacactagtcctttacgcccggcgttgagtgggtcctctaatcccggctgactctcgccacccaccttcgggagcggcgaacgacacggtgcgacaccctgcggatcacacgagtgtgtgaagacagcctggggcaacacactagggggaaacctctattttgtcttcaaacaaaccccacgcaaattggcgggcaccagtacggggcacaccctctccatgtcccccaactcacctgcgggagagtcataaggcaaccggggaattctctggggaccccgtaggcccgaagggcatgacttctagtccccaaattctgtcccccgcccccccccccgcggggaccaaactacctcttccacaaaaca

SEQ ID NO: 612351 - DNA, 179 bp, Homo sapiens
tccagatacttcgctgtgtgtgaatcggtcagcttcctgatgataaaagaccacaggagacagagacccaggcgccagctgacctgtcaggtgagtgacccaggctaacacagaatcatgagaaatcataattcacagttatctaaaagcattaggttatggggtggtgtcttacatat

SEQ ID NO: 612352 - DNA, 636 bp, Homo sapiens
  misc_feature (66)..(66): n is a, c, g, or t
  misc_feature (81)..(81): n is a, c, g, or t
  misc_feature (611)..(611): n is a, c, g, or t
gcacaggatgtcagccctggtccaagtgcaagatagggacaggggacagccagcgagcgttcaggngtggtcaccagggantgttccaaccacaggggcagcatctcctccactccacatgctggccaagggaacagagctgccgtatcgcctgccaagggtgtggctcaatgctgctgccctggtcctgtatgggcccggggtgcgagaacagacagcaacctcacgcctggtcctttgagctttcttgatttcctcagagagcgcctccttcagctctggtaggcctggtccagcgtgtcgttaatgatgaccacatcaaacaggccgggctccttgctgctctccatgtcggcctgggcagcagcagccggcttcaccaggctctcctcggtttcagtgttgcgctgccgagccgctgctccagcacgtgcagtgaaggcggctgacgagagatgtagatggagcgcagatcggtggccttgatgttccgcacaccctgcaggtccacgtccagcacacagatgcggttcatggcctgcacggctttcagcggcaccttgctcgtgccatacaggttccccgaaactcggcatgctcgattaagtcgnccgctgctatgtcacgctgcatcac

SEQ ID NO: 612353 - DNA, 136 bp, Homo sapiens
gtataggcgatagaaatgagaactggcgcaatagatatagtaccgaaggggatgattataaccaagcataatatagcaaggactaacccctataccttctgcatagtgagggggagcgggcgggggttggagcggg

SEQ ID NO: 612354 - DNA, 106 bp, Homo sapiens
tgcctcaacctatcccctggccagtgtcactcacagggcagacaatttatcttcaccatctcacaattagttaaatctctaactccgatgcaggagctcgtgggaa

SEQ ID NO: 612355 - DNA, 141 bp, Homo sapiens
cacagacaggctcatgccttcatggggtagacaccggtcacacaacagcaggcggatctggttcacggcaaagtagtcacagctcaggctggagcagttccctgggatgtctgcacagcagtccatgcagtactcagacct

SEQ ID NO: 612356 - DNA, 247 bp, Homo sapiens
caccttatgccggggccaacttatgccggggcattctcagaccagagaggcttcgggaatggctcttgaagcgtgtggaaatttaggcagggggaagttctaggctatttaccaaacaggccttttctttatctgggtgggtaaaatagacatggcataatattggccactttaaccattggtaaggtataagttcagtagtcttaagtccgttgatgtggttctgcaaccagcagtaccatccatc

SEQ ID NO: 612357 - DNA, 438 bp, Homo sapiens
  misc_feature (81)..(81): n is a, c, g, or t
  misc_feature (98)..(98): n is a, c, g, or t
  misc_feature (107)..(107): n is a, c, g, or t
gcggccgcctactactactactgctcgaattcaagcttctaacgatgtacggggacatgacggggcaaatggaatttcaancaggcccgcaatgctgngaggacagntgcagcgcacaaccaggaacgccccacggtagtagtgacacccatccaggtacagaatgccggcggtctcagccctgcatctgagggcctgtcccattactcgctggcctgcccacaacctgcgcctatgatgccaggctcagccacgcacactgctgtcatgagtatcaggtgagccagtgcccctctggactgtgcagaatttgcttcactgacttacccaagcataaccagagcttatatggaggctgatcccaatgtacgtatagtgaccctattgcctggactgcggacatttgctgtcagggctttgtattgttgtgggaacagt

SEQ ID NO: 612358 - DNA, 239 bp, Homo sapiens
actccggggaggcagaatatattgaaaaggtagtatatactgtgaagcaaagtccagaagatgttaagaagactttagatggtgaacttgatgaaaagtataaaccgtagaaactttaattccaaaaaacctgaagagtcagctgatgccagacggaaagccgaaatgctacaaaatgaaggcaaaacttttttagctcaagcaaatagcaagctgccacctctcaaaggtttagacag

SEQ ID NO: 612359 - DNA, 243 bp, Homo sapiens
aagacataactgtctcgtctgtagcgggatcattcacagattaggatcgtgctgatgatatgttctgtagtcgggtgatcctctatagtctccccgttggcttttgagcccgcagggggtatccacgcagagcgtgatgcatgaatgggcaagacagaggcagcaccttgggtcccaagagcgacatattgtctatggtgttctgctctttccaccgagtcctttggctgctgaatgtgtctc

SEQ ID NO: 612360 - DNA, 320 bp, Homo sapiens
atatgtaaaccaaaataaatactggagatgacacacacatggatcaaaaacttctctgtcacatggaaagagtgagcggtcagactgacatccttcacataccaggtgggtcaccaggcacaaatcaagaagtagctaccaaactccaagaggcagagtcccatgtcccagcacagaagatcatcctggggcagagagagcccatgagatagtggaggggatactagtaagatgagccccagaagacagaaggatggaaggtgaagtgaaggcagcacagagacaccagtgcttgagcccagcatggacacagttgagct

SEQ ID NO: 612361 - DNA, 635 bp, Homo sapiens
  misc_feature (625)..(625): n is a, c, g, or t
tttgaagtttctgactcctttattgggttcctgcatcctttccccaccagaggctttcaaactgcccaaatgcttgctagtattcatgctttgttcttttaaacccctaaggtaggggcagtgcttgaggtctgccctgattttcttgccattgttcctgtgttgtcctccttattccatagtgtaagagggtgctccctgtgccatgttgtcctttctactcatccctcactcaataccatactggctagaattattgggatcccttgaggaagggtgttttgggtgtgaatgtatgaacgtggtggtccatagaacttcacccctgtaatctcagtactttgggagactgaggcaggcaaatcatgaggttaggagtttgagaccagcctggccaacatggtgaaaccccgtctctactaaaaatacaaaaaattagttgggtgtggtggcgcgtgcctctgagctcagctacttgggaaggaaagaaaagagttaactggtcatagtcgatgactggcccttcttcacatctcacctcccacgtagatactgacacagagggaagacttggtggtagcccctgcaggcatcacactgcatgaggcaaatgaaattctgcacngcagcacgaa

SEQ ID NO: 612362 - DNA, 402 bp, Homo sapiens
tgcacatacccgagtcttattaatgcccttagatcagttatgaccagtttacaaatgatatgcagagatttattgtcctaaccactagatctctcctaaagtccagacctacacctaggctacatgacgttcgtgcgcagttcagatgtctaaaaccaaagttaaagatcttccctaaaccttctcctaacatgttccctgctcattaaatgcggagaaccagaacccaggagtcaccctctgacacctcctcccaaagtgctgggattacatgaaatgagccactgtcggcagaccatggcttgatgtctaatagcagatagttggcatttagcaagcagtcattgataatattgaccaatttgatgtcatgtgagccttctaataattagtgtagaaatt

SEQ ID NO: 612363 - DNA, 223 bp, Homo sapiens
tgactgtcctgctgggcaactcttgctatgaatgtccccctcatctagcttgggctttggacccaaactctacctgcatgcctcctccccttgcctgggctctaaccatttggagtgcagtcatgcgccaggactccctgggacccaggctcctgtgctgcattgccacacctaagtgactctgggacatgggactgtgtgaggagtgtggagggctcgggga

SEQ ID NO: 612364 - DNA, 211 bp, Homo sapiens
cctttttttcagttgttctacatttgcataactcatttctctcatgattcaagtatgctgattgatttgtggactcacactagtcctgtgaagtacaactgaaggcagacgtgttaggcttttgcatctgatgttcattatcatggtattgatgcacctcagcgatcaaattagctagcccccaataagctgcatcatttgtcacatgcat

SEQ ID NO: 612365 - DNA, 303 bp, Homo sapiens
tagaggagcggtagctggcagccgacagagggaagaacaggcctttgatcaagcatggtcagcacgatgatcgaccagccccagttacccaggaggctgtggatatgttgcagcagccagaagatcggttgggcgatgaaccacaggaagccgtagtcgacggtcagttccaggcctggggacaactctttcagcttggactgaatcttcgggccggcgtacagcatggcgctggtttcgaccttgccgccagcaggcacgctgattacggggccggtgtagccaatgatgtagttaccctgg

SEQ ID NO: 612366 - DNA, 420 bp, Homo sapiens
tggaggttggctgggtgtactatgtctcctttggacctcatgccggaaaattggacgcgattgtagatgttgttgatcacaacagtggctttggtctgatggaccttgcactcaagtgaggagacaggccatgcctttcaagtgcatgcagctcactgatatcatcctcaagtataccgcacagtgcccaccagaagtatgtccgccaatgcctggcagaaggcagacatcaataccaaaggggcagccacacgatgggccacgacgattgaagccagagacaggaaagcacaagatgacagatttagatcgttctaaagttatgaaggcaaagaaaatgaggaacagaataatcaagaatgaagttcagacgcgtcaaaaggcagctctcctgtaaagcttctcccaccaagtgcctgg

SEQ ID NO: 612367 - DNA, 474 bp, Homo sapiens
aggatacgcgatcacgtgcattgtgggatttaaaagattattttagggcagttttaggtttacagcaaaattgagcagaaaatacagagttcccatataccctctgccctcacacatgcacagcctcccccattatcaacgtcccccatcagagttctacatttatcacaatcaatcaacctacattgacacaccattatcacccaaagttttccattggcttttaccttgtgcatgattcttcctctgtcattgaagtagtatacaggtgaatttaatgcttcagaaagtatgtaacagtcattaaaaattgaatttagtggaagacacacttctcctttctcctgataaacaaagccttctggaattcatttacagggttccactttccttgatgctagaaagacatgcctgacatagaacctctgttatctattaagtccatagaacctacgaccaccatggcacgtggat

SEQ ID NO: 612368 - DNA, 248 bp, Homo sapiens
  misc_feature (76)..(76): n is a, c, g, or t
tcgagatctcctccaacatcaccaaaacccggaaaacgaggatcctaagctcctcccagccaaatcagggcttggntgagctaacccgcagagcctctgactgcgtacactcagagtaagataaccagcaaggggctgagggaacggccagccgagtccagacatggacagatgtaactaaggaggacaggaaacagacaggtactgtccagctgtaggtaagagagggcagctaaggcagatctcga

SEQ ID NO: 612369 - DNA, 408 bp, Homo sapiens
tcctctggatgcaagtgtatatggagtagccattcttattcctttactttgttaagtaagatcttgctttggccttgatgggtgaactctaggctgaattctttcttgtgtaagatccaagaaccctcttttggggtctggatcgggaacctttcctgtaactctttgacataattttgctgagttcataaacacagattctgctacattcttacagtatcatgccccaggaggccaaaatcctagattactgttttcagaagtgtttacttcaaactcgttatcttgagtggagttgagccctgtctgtgattggccatgtttcataacatgcatgggaaaactgcaactgatagtcacagctctgttttcttgaggccttcttactggtttcttacttctattgtt

SEQ ID NO: 612370 - DNA, 117 bp, Homo sapiens
agagtatccctggcacgtggtaatcaggacttccaggtctaacagaagttagttcatttactgagtttggtgatggcttatcacttctttgtgtgaatgaaaccaacaaatgtaagc

SEQ ID NO: 612371 - DNA, 1662 bp, Homo sapiens
  misc_feature (288)..(288): n is a, c, g, or t
  misc_feature (546)..(546): n is a, c, g, or t
  misc_feature (779)..(779): n is a, c, g, or t
ggttcctcagatggaccagtttgccctctgcaggctcctgggattggaaccctgtcgtcctctgggatctcacagacgggccaccaccatcgaggcgatgagtggagccaatagcaaggcatggtgctgagatggtggccttctcgctctgactaaccggccggattagtctctggcatctcggagtataacaagccactcaaggtctattgcgatatacaccgtgaggctgggtgtgcaatatactacttgtcctatggactcgaagacgctcgatctctctagganagtgggttgtcattggttgtcctgctattcgtccgctcccaacgagctagtcgaagcccgtagtcgatcagtctttccgtgttgggcgttgagtggacaaggcgtcgcgttcaccacaagtcagtggcacgcccataggcatcatacttgcgtacagcatcgcaagcacctgaatcgcacacatttgggcgcacgcacgcacggcataatcatagcaacaatttggcggtacattgtcggtctcgcaatacaatcggntactcccctatctttgtcgccctctcagtgggaagcgaccgactaggcaatggcggccccatgggcacccaatggtctcactggggcggcagtccttccaaactccgaaagttgcaacatactcactcagtctctgacaacagcccttagcaatgggctggcgcggacccattcgcactctcaaacatgcacccctgttggcccctttcgaagcccacaattaaagccggggngtcacttctggaggctgtcggcttgtttgacttccggctcagtctgagagacacccactgaggtcggcaatcccaaagctagtccctggtgggcaatttgcaaggcaagggggtcacaacaagccatcccatttgtgtcgtcacaggacaaattggcaaaccacttgggaacaaggccgatacgggcaaaccggattgttaccttccaaagtctacacctcaaaggcgaacgcccaaccatgggcgcaatgcagaaccgccaagttccccccacaaggtctgggccacccacttgccctcggtgggggccactttgcgttcccttcggcactggcaggtgggtgtccaaaggaacctgcctcgaaatctcaggctcagggcgctcacctagctgtgggcacacacaaaccttcggcttcgccagaagttgtttgcggcacagagttccactccaattttgggcaaacctacagggcatattaagaggggttccaccaggggccggaggccatggatccagaacgtcatcattcaagcccaacactgtgtgtcttaccacaacgggactaggcatggcgaacaccacctgggacagcgccccagcagcgacctcgtaaacaactaccaggcgacaccacacacgagacactaacagagccgacgcacccaggcagctggtacaaaaagcgccaggcaaatacagcctaagcgcacccaccatacttatcacagcggcgaaaagagaggccaccaatagcgacgaaaaatatagcaccggcacacagcaccaagacaacagacaggcaaggagagcacccaaaacggccgacgccgcaacacaagaaagatagcatcacaacaacaggacacgacagagagaaaa

SEQ ID NO: 612372 - DNA, 965 bp, Homo sapiens
atgatgaggatgacgatctcgataccaagaagcagaagaccgacgaggatgactagcacagcaaaaaaggaaaagttaacactaacaaaaaaaaaggccgccgtgacctattcaccctccatttcccgtctcagaatctaaacgtggtcaccttcgagttaaagaggcccgccctgcccaccgtgggcagtgccacccagcagaatgacacgcgcatctccaccaccctaacccaaacccatgagaattgtgctaactagtggtgatggcaacaaaagacaccaaaactttccgaaggcccttgcattgttttatctctaagaagtacgtttcaatacaagtgaaatttcgttcttgtatttcttataatttaccagttcttactattttattgtacactatttggtaagaggatcatgccaatttctataatgatctcggattgaccaaagccaggccattcggaagacggtcacatctggtcctaacttctgacgttgtactgtgtgcgtgtgaccattgtttcatctataactctcaaagggaggaaaaaaaaccttgttacatagaacaacgcaaacaattgaccaacagaagagaacaagatcttattacctgagcatattcccagtttaacctattatagaggtgctaatgatacttaagcatgttactactcaagataagctatgggtcgcgctactgaacagtggcttacaaaaagtgcccaagagcactacgaagagtatacccttcaaaatctgcacccctgtaaatggggtcctcagttgacactgattgcccatgctcccacatcaccactgagtcgagacccctgcttctagacttgctaatggttgcttcacaccccaacatgtcgtgtctccaaacgatactaaaaccgcagggaactctcaatcgtcaggcctgcaatttgatcccacgacagagtcacaataacaatc

SEQ ID NO: 612373 - DNA, 952 bp, Homo sapiens
tagtaccctagacgggcccttccagggctgcgaggtggcatatcgtccatctattgatccgtactcatgttgaccatcatcgtggactaatacgtgtgtttctcttctttgttcaatggtgatgcagtcctcacgcttaccagaatccatgatcgttattgcacctggcacccttccctaatctccatggatgtcggttttctgccaacccacatgcatgccccctaacacttcgtactgtgggcatccaggcactcattgttaccagcaagagtggcgacaccctactgggctggtccacccccaagctctgcatgccctctccgttggcccatgctaaccgcaggcaaagtgggtctctccggcacatgggcagcgaggcccagcgtcacatttaagttcgacatgacccaggccatgctaacgtccggagtaactctacatacagttcaccttgaaacgcgctcagtctctaacatgctcgtcgtccttgcctccctgtcctctactgaccgtgtacgtgtcccttctctgcgacgtgaggagggggccttcaccccaagcccacctcccttgtcctcagcctaactgcagtccgtgagttaggtctctgctcttcttgttccaccagggatgggcacatggggacgcggaatggactttctcacaggggaagccacccagacctgtgggtcatggtctgtgagaggtggcaggaatgcgggaccctcaccccccaagcagcctgtgccctgctggccgcactgtgagctggatgtggtgtctgggtgtggcctggggctccctactgaggggcctctctcggcagcaacagccaagggtggaggcttcagtctccagcttctctgcttctcagctgccatctgccataacacccagaatgacagcgatataagtcatccgcacctgttttcggttcgtccatgctgtc

SEQ ID NO: 612374 - DNA, 149 bp, Homo sapiens
gctctgctcttcacccatgctggagtgcagtggttcaactcttggctcactgccgcctccatctcccgggtttaaagtattctcctgacctcaggctctccccggctagctgcggattactcggcactcgcccgatgacagcccggcgt

SEQ ID NO: 612375 - DNA, 898 bp, Homo sapiens
cgtgagctccagtgtacccacctctaatggatgaagcagtgtgtctcagaacaccctgatgtgcccctgctgagagaacctttgagaaggacaaccctcatgcaaggagccagtggcccagggagtgtcacctgtgggccaacaagcacaagggctgtgagccggcagggcctgctgcagaccttccatcttgccttgagtggctcttcagattcaatgagtgtccagccgtggagaaacatcctgggaccctcagacactgttgtttttcgggagaaaaaaccaaatgtgagtgtgactgggacggcttttcaagacgctgctccaaactcatcaactcctcccagctgctttaccatggagtatagttgatgttgtcctgaataagtgagatccatgatgccatgcatgctggcttggagagcactgtcctgatgatcaccctgtggctctatgctcctcctgctgtgcatgcctctggaatggccctggtctcctcctgagtcgtacctgcagctggctctccatggcctccagcggctccctctggcaggaaatccccgtggtgcgcaacagcaccgtgcttgtctccatgacccatgaagaccaaaatgcttgcaagagggtcaaatttgagctgatcgtgtccgaggcctcctagctgcgcagtctaaacatagcctgtggatcatttcccactttcaacttcgctccgggggcccacgtttccaccaggagcaccagtggctcttctctcggttaccggctttgcgagaccgtcagcgcccaggttccgtttcggaaccttggccggggtctttgcgcaccaatatcttctcgttccgggtttgtgacgtagtccttgtccgcggcccaggcttccgcggggctactgcct

SEQ ID NO: 612376 - DNA, 410 bp, Homo sapiens
aaagcgcagtggatgcatgacagtcccgaggctaaccataataagcttaatcaagatgatgctcgttatggtttccgtagctgccatatcaaaaacatttggactgctccgcttcctcttgagactgagctttctcgccaaatgacgacttctaccacatctattgacattatgggtctgcaagctgcttatgctaatttgcatactgaccaagaacgtgattacttcatgcagcgttaccgtgatgttatttcttcatttggaggtaaaacctcttatgacgctgacaaccgtcctttacttgtcatgcgctctaatctctgggcatctggctatgatgttgatggaactgaccaaacgtcgttagggtcgacgcggccgcgaatttagtagtagtagtaggcggccgc

SEQ ID NO: 612377 - DNA, 356 bp, Homo sapiens
  misc_feature (92)..(92): n is a, c, g, or t
ttttagccccttgttttttccaatgtcatatcccccaggacctggccccaactggcctgtgggtgatcccagctcttactaagaaaaggaanttaggttctggtgccaggggcccaggccctccaaccataaacagtccaggatggaacctggttcccccttcataccagctccaagccccaaaccatgggaactgtttgggatgttgatcccttaaaacttggccctgtgctttaaacccaaggaccccatttctgggctaggaaaaaaaaaacaaacaaaccggggctacctgcccccaggtggccccccagttgtggaagcccatttttaaataaaaactgctcttaaaatta

SEQ ID NO: 612378 - DNA, 391 bp, Homo sapiens
aaagcgcagtggatgcatgacagtcccgaggctaaccataataagcttaatcaagatgatgctcgttatggtttccgtagctgccatatcaaaaacatttggactgctccgcttcctcttgagactgagctttctcgccaaatgacgacttctaccacatctattgacattatgggtctgcaagctgcttatgctaatttgcatactgaccaagaacgtgattacttcatgcagcgttaccgtgatgttatttcttcatttggaggtaaaacctcttatgacgctgacaaccgtcctttacttgtcatgcgctctaatctctgggcatctggctatgatgttgatggaactgaccaaacgtcgttagggcagatcctctagagtcacccca

SEQ ID NO: 612379 - DNA, 143 bp, Homo sapiens
aaaaaggggacccttttgggggccccccgggggctggacctttaaaagggggccccgtcccccccccccttttttttttggggccccccccccctttgggggggggggggggggtttttattttttttatggaaaaatttcca

SEQ ID NO: 612380 - DNA, 639 bp, Homo sapiens
ccaattggccacaaatctgcaggagagcgtggcctgtagaggaatggggagaggggtctctgcatctggagagcatctggggctgtatgagacccacaccaggtcttggctgcttgctttgctttggcaatgacctaagattgaaaatggatgagtggcaatttgggagtctagcgaagatgctttgcaaatgaacacattgccgcagggcacccgttttcagcagtgaagccaggaataattttctatctcatgctacctaactcctggaagttatcatgagacccttgcaggtggataaacacagtctggagaggaatatttctccatttgtattgggacagcagtacctaaatctgggatgttcagagataatctgggcctctgcttgttagggagaggaagaggacattcccaagaccttagcatggattggcatagaaaccagagagttccacatgcatacacctgtctcagatcagggtttctcagtgtggtctgctgacctcgcacattagactcaccttaagcactgattaaaaatgggattccttccctgccttgagcctagttaaatgaatgaggtagtttttaaaaatgcagatgtagaaaaatctacaggttatgctaaacaaaaaa

SEQ ID NO: 612381 - DNA, 916 bp, Homo sapiens
  misc_feature (274)..(274): n is a, c, g, or t
  misc_feature (348)..(348): n is a, c, g, or t
agcggagcatgcgcgaactcctggagggacctacgcggtacgaagtttctactaagtgaaaaggaaggacgcgagggattcgtgtttctctgtggtctacaggcaggcaggcacgtagtgtagttaaagatattatggcacaagacaaccgtgtatatacaatcaagtggcatcttaaatattccgctggcaggctggagttcatgagactaaagatatctctttaaacacgaatccagagacatagtgccttattagatggcttattacaagntctgtattggcagttattacgttacattaatagttattcgcttagaaaaggtattctgcatagtgtgtatatantcgctagcatggaaggaaaataggaattggatcggggtgacagttccttcttagctggggtgtggtgtacgctaacatgggtgggagaatgtatgtagagagatacatggttgtgggtaagggtcaatggcatgctcaaagtgaaaccgagttgaagcgtagtagaatcttactttggagacaactgtcttgactgagaccgtgtagcctgtaacgtctacattacagatagcatatacgtatcaacataacttgagaaaaacgcgagtctttcgaggtggagctttagtttagggaatctttaatacaagaaggcgtttgtgttgctggattatggtaacacccagggatggttcgtcccgctgctgggagccagcccacaagggtctggggcttgttaccacgggcgggtcggtgtaactcggttcgaaattcatatcggggaacacgcaccttcaaggtaaaatccctggggggccaagacggtgggaagaaaccccctgggggcactcaaggcgcacccccgcatagaaggacgtctccagacaaagacagtagggggcccccc

SEQ ID NO: 612382 - DNA, 690 bp, Homo sapiens
ggttatcagcaagatgggagtgaaagtggaattaaaatgatgcatctattggattgttagatcaggtaacggctattaactttaaataatatgcattgaatgctagtggattggttctgaagaagtgatgcattagttttcactggagttttatattcttgattactttcttgcagaagtcatatttgctaaagatgtgaggatattagaaaccaccagaataaccaatctttctgacatcgtattgtaccataacgtaggcatagtacctgaccagatgaagtctgctaaactagtaatgtctcacgatactacactacctggcactgtatgatggtctggacttactcgtccgcaaggctaagctaaaactacatgcgacatgtggcagaggacgagcattcaacatctacatttgtccatcatctttacaatggtagtcatgcaggaaccccaagagcgccatcggtggcgcacaggtgctagcacgcgttcgcaattggcgttacacgtttgtcgcaggattcatctcacttagtcccgtctttaagactcgtaaatccttgcacccgccttagcttccgctttggcagacccaataaatttttatttactttagcgccgcaggtttcgatccttttaaggaacaagtatagttgttggcatgtcgagggtagtcaattcactgct

SEQ ID NO: 612383 - DNA, 221 bp, Homo sapiens
  misc_feature (2)..(2): n is a, c, g, or t
cnttccgcttgtgcctcatatttgtgttataacttgtcgttataattgcaggtctctgtttcggcccattttctctgccttctttccaagatcaggggttaaggtgcaagaatccatttcgggcagcataacaagtgacatgaagggcgggtcccattgtgtgtgtgtgctgctgtttcctgggctcttggtgagagggacaaaacaaggaatccagggtt

SEQ ID NO: 612384 - DNA, 184 bp, Homo sapiens
gcacatatcgtggcgaggctggagtgcagtggtggacgcatacgctcgctgcagcatcaacctcgagcaatcctcccacctcacgcttccccacgcagcatgggcactacacggtgcagtgccaccacgcccagcctacattttcactatttcattggttggacgacacaggctttttgccatg

SEQ ID NO: 612385 - DNA, 314 bp, Homo sapiens
ttccactatgataccaaaaacgtggacagcatcgtagtcactttcataatggcatctaaaaagtcttggtacagattgcatttaatgtcctcatttgaagaacacctggcatacccaatgaagcaggctatggaataaaagaaacaacaaatggattcattcattcatttgttcactcactcattcattgttgggaatacaaagggaattgatgcacagttcatgccctgcagaaaaatacagggaacacaaactcaaaagagtcgagaaatgtacattatcaggtgaacacacaaacccgagaagtctttccc

SEQ ID NO: 612386 - DNA, 745 bp, Homo sapiens
  misc_feature (316)..(316): n is a, c, g, or t
atcacagccacacacgttgctatgtaagcaccagtaaataagcttggcaatgttgtagcacctccacaaaaaagaatgagtttgtagagtggatataaagccaccggcacctccctacacattaaagaacgtgtacaagcctcagtttcagatatccatacaaagtatatgagaacacagcccagactgcttgataaacaacacttaaacagttccacgagtttagtattcgcctcgtggtaagatatgagccataccagagatgagtgacagagtcttcattatgatatcgtactccggcacagcctaggctcangcactaggtatgtcagaataagctgccaagtgtatatacacacggtgttgtgccaagatagcttattagagtctaattttgtgcgatattcttaaattacttcacagaaacaaataaggcacagaggacacttggtttccttaccagtagtggccttaagttacacactagcatgtgcagagtttagagatattcagtagcattagtggtgcaatagccattcatatctagtttcaggaagagtgtttagaaaaagaagaagagctcgccagaaaaggcttacaatctgaaggttaaatgcagaagaattcacacaacgactggaggcagcatgggggttgttaactagggagctgctgggaagagctgcattctgagtttttgtgaccattttcctgcagttttctcatgaagaactctggtcttctc

SEQ ID NO: 612387 - DNA, 961 bp, Homo sapiens
ggacttacatcctcattactatgtctgcctagacaaacatcaaactacgaatcgcactcacagatcgcatcataatccgtctctcaaggacttcaaactcatgctcccactaatagctctacgggaatgactctctagcaagtcctcggcataaccgtcgcacttaccccaccactattaacctacatgggagcaactctctgtgcatagataagaacacgtacctcctgcatccaactactcaactctcctacttacaggactcaaccatactagtcacagcacctatcactccctctacatcatttaccacaacaagaatggagagacatcactcacccaccacattcagcaacatcaaacaccacatcattcacaccgagaaaacacaccctcattgctccataccaactaatccaccagtctccatcctatccctcaacccccgacatcattaccatcgaacccaccaaaggccactaataaaacattaacataagcctacatctatcactatcacacccacatcatcctcaacccctcacccatatatcaacatcaacctaattcacaacacgaaccactagtaaactcaaccactctactacaacgcacaccacccacatgtgccacccaagctacacatactcattaactcaatcggacccatagctccatatacaatgccacaccgaacacactcagcgatccctcaccgaacttcacccaactgggaacacctcgtgccttaagatcaaaatagaatgaacggagtagccggagcagctcatcaaacaaggagtagcaaaaaacccgcgcaaaccgaggataaaaatcgcgaacacgcagaagggcagcaataaaaacactcaaaaaacatacaccagacacacagtggcagagacactagacccagcagagagatgtaacgccaagcgagagaggtacacgcacaatgaga

SEQ ID NO: 612388 - DNA, 148 bp, Homo sapiens
gtcctgggcaggagcctctggttccccggggtgggaggccccagccgagggtaagctttggtgggcccgaccccacttcgggcctccagaattgtcttgtgcttagtacctttgttatgtgcctcaagctgggacagggagttcacag

SEQ ID NO: 612389 - DNA, 1162 bp, Homo sapiens
tgaataaagtggaaaagacccaaacacccatcagcagtggaatgcgatcaacaaatgtgtgccggaattcctcgcctatctggtctttcatcgattgtgcaggcgcatctgttgaagcctcgggactgttcaccatgcaggaattgaggcacgcacacatcattcatcattgtattccaactgccatctgtgctgcaggacgccttgttgtagttcaagctcatttgcagacctcgctgcagctatgcaccctcagtggtgagacgatctcgaaggcaagagaagagcagtagtagcaaatcagaggactcagggtgatacgaccacagtgatatggcgatacgaaaggactgtgtaccatacgacctatccttcgtggcattccacgcgtgtactccaagcaagaggcactccgaaaacatgcgaggataaaggccgtgtagaggaaattcggtgatagcaagttagcaagcgaacaatatcgacacacatcgaaacgcacatagactttggtacagatgacagcaaataataccgacacagtggtgtacaattggcaaaagcatataaggggaccaagagaacgcatggaagccatgcacaggtcaaccacatattgttcacccggaagattcacagagagaatattcagacaagacaaaagtcagtactagggaaaagaggagaaagtagatgacaattaaccaatatgagaaaaagcaacactacacagaagactcaaacacagtacccatgacgaataataaacgtacagaggtacacagattgaaagatcgaacatgagaatgacaaatccaatgaacaccaatccaacgtacagtctaccatcaagaaaatacaccactgaccaaaaacaattatatccccgcagatatagaataacatggagcagaagaagagtaacgatacaagagatcaaccacaatccacaagatacaacacatagcactggaacaagaaattgagggacagttataaagacaaagagagcaaacaaaaaaagggtcagaaaccattagaaacgatagcaacacagtcacatgcattgaagacactaatcaagccattaccatcacacacgaagacaaaagagtacgacagccaaacgaataaagataacgcaacaaagagaagaacaaaa

SEQ ID NO: 612390 - DNA, 196 bp, Homo sapiens
gtttttgctggggggtaaaaaaagcaagttttttcttttcatggttatttaaaacattagccgcccgtaaataattcttgttataatgctctggaatgtgttgtaaaagttgtattagattagttttaaacccctgtttgaaaaccccattgttttggttatttctattaaattaaaaaattgaaaaagttttcca

SEQ ID NO: 612391 - DNA, 107 bp, Homo sapiens
ggcatctccatttttactcaacacaagcattctagacccatatagtgaaacacggcacaagccctaaaaaaatcaaagcgcaagaaattctaagagtgactagttct

SEQ ID NO: 612392 - DNA, 597 bp, Homo sapiens
  misc_feature (2)..(2): n is a, c, g, or t
  misc_feature (27)..(27): n is a, c, g, or t
  misc_feature (37)..(37): n is a, c, g, or t
  misc_feature (165)..(165): n is a, c, g, or t
anaacctcatcttttgcggaggtgctnggcctctacngtctcatcgtggccctaaatcctctccaacaaaagtagtcctttcccacccatccagtcaacaggataggatgtaaaagatcaccccctcctcattccaagaacgaacagcctgacacatgccaacgncagctgcccctcagtagttggtcttgtaaatgtgcagtgtcctagtgcccaattgtctgtcgcccccgccttgcccctactgcaccgtgctgtggacatacgggcccactcaatctcccaacccaggcccctgaccagtgacgaagtcagcctctggttaccccacccaatcgccctagagtgctcctgtgtataagaatgaactagagttgtcatttttctcttcactggatgtttatttataaaagatttgacctattcatgcgtctgtggagcagctcctgtctcccaactatatagtaatcattagtagactgttgccttgtggggttcctgttgctgagactccttggatggagccacccttccccctgccctgaacagccagggtggaggatagagtgctactgctcctcagagctggctcccagc

SEQ ID NO: 612393 - DNA, 681 bp, Homo sapiens
cggggggtaaaggggaaatttggagggaacccctttccccccgttttaaaaataaaaaagggttttagccaggttgttcctaaacgaggtttaatggatgtgtagggaaggcccccccccggggggggcgctgaattgtttttgtaccaacaagcccgggggaggggaagagaggacattttttttttcttggcggcccaagatgagcacctttttgttaaacaccccggcaaatttttgactgttcctgttaaatgggggggcaggtcttcaagcttctctttcccatgttgtcctgaaatgaaccaatgatcttagatgcgacttgggtcaactgggtgtcggtaaggtgtttatccatgaggctgcccgctccggggtcacaaaggagggagcgctgaagctctacaggcctgtgtataaggttgagctgcccaccccagacaaagggtttgaagcggcttggtccacgtttctagggtctatacacatgtttattcctttcaaggacggggtgtcccaaccctgagtcttattaatcattgaacaaaatggcaagtctccccagttcctgggaatggtgatgaaaccctttcaaagaaaactgcctgttgctcctcaagccctcccctccatccctggcccctccgtggatgacattaaaaaagggttgagctggaa

SEQ ID NO: 612394 - DNA, 87 bp, Homo sapiens
gcggccgcctactactactactgctcgaattcaagcttctaacgatgtacggggacatgataatgataataaaccttgtacagtggc

SEQ ID NO: 612395 - DNA, 303 bp, Homo sapiens
aatttagcctggatgctgactggcacccagagccaaagatcagcaacggacaagaagaggctggcgagggcttgaggtgcttcaaagaggaagctacacagatagtggataaatagcaggcatttcttgtacttttgccaccagaaaactcatagtgggttggcctatctatcacgctttttaaagaacaggcaaaaaaggattaactagggacaagtgctcttccacccacccctcaggagatcaatttcctctccctgacacatataaatacacacatcctcgaagggtgagttagaaagt

SEQ ID NO: 612396 - DNA, 420 bp, Homo sapiens
ttgggccaacgcaccgtgtccgagggcaccacggccgtcaccaagtatccagctccgagtgagcctcccgctgcataccagtaggtctttgtttttgtgttccggcgtgtctgacccaggtcgtatctgctccagttccttaatcaggctcctagatggccattgtgtaggatcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccg

SEQ ID NO: 612397 - DNA, 229 bp, Homo sapiens
ccccccccttttttagggggccccaaaccctattttctttttttaaatcataaaacggccgaacagatttgggttgttttgaaaaaaaaaaagccctataaaaataaatctaaattcccgggttttttttttaaaatttttaaaaacccaggtcctttggcttttttttttggggaaaatggaaaggttggttttaaaaccataaattaaggcccgaagttttattgga

SEQ ID NO: 612398 - DNA, 128 bp, Homo sapiens
aatagcagcagcagcagcggcggcagcggcgggcggccgcgcgggtgtttatgtcgggtcgcggggtctcgcggcagcatggcggactacctgatcagcggcggcaccggctacgtgcccgaggatgg

SEQ ID NO: 612399 - DNA, 528 bp, Homo sapiens
ccataggaaatcttagctcatcagacagatctcgctggcttcttctccttcagtgcgtgtctcgaattcctatcccctcatagtacaggtccccgatggctggtcagcttaggttgggtctgccagttgaagaaggcatcaggcagtttctggtagtcgatgtcactttagcccatcttaggccgaactttctctcgcattttggacttcatggtcttctgttctgccttctcctgcagggcctctcgcatctcctggatgcctgtgcgttggatgaagtctggcagttcgaaggggggctgctcaatgccctgttagccctgcaggtattggcgcttaaaacaccagtggcgtggcacaggcacagagtaccgagtggccttgcggtgaaccaagagcttagggtcctgcgctgtcaaatcgtgcatctccacgacatcgggccgagccaccagctgattgagttcagacccagtgaagcggatcattcggcgcaacttcttcttggccagctcgggggtcagctgt

SEQ ID NO: 612400 - DNA, 301 bp, Homo sapiens
tactgtcctttggcatgaagcctggtgaacctgataatgtagccttcaagttcccttattgagccttgggctcccttcaaagtatccaagccaaccctgttttgggaaactcccctagataatgccctgaaccccaataaagggtccagcccccaggtccctcccttttttttggtcccccccctttgggtgggcatgggggtcctcaatgtttccaagcccttccagtaagccctgcaaggtgggctggcccctgttttttggaatttgtgagtaataaacaatttttttgccattttga

SEQ ID NO: 612401 - DNA, 176 bp, Homo sapiens
tcgtaatcccagtgactcaggagactgagtgcagagaatcacctgaggccagtggtttaagaccagcccagtgcaacatagcaagaccctgtctctgaaaaaaatcaaacatttggccgagctgcatgtgtggctcatgcctgtaatcccagcaccttgagaagctgtggcggtcg

SEQ ID NO: 612402 - DNA, 310 bp, Homo sapiens
  misc_feature (47)..(47): n is a, c, g, or t
  misc_feature (81)..(81): n is a, c, g, or t
aggagagcaagatggggtaagcttcgcacattgagggctgtcacagngtctcacacctgtaatcccagccctttggggggntgaggcggcggatcacttgaggccaggatttcgagaccagcctggccaacatggtgaaaccctgtttttactaaaagtacaaaaattagccaggcgtggtggtgggtgcctgtaatcccagctactcgggaggctgacaggagaatcgcttgaacccggaaggcggagcttgcaatgagccaagatcgcgtcactgcactccagcctggacgacagagtgagactttgg

SEQ ID NO: 612403 - DNA, 114 bp, Homo sapiens
actagcttaggttcgagcttagaaggctgcagagttatatcaatgcctatcgaaacgagacatcttcatcgttaaaagcagtatgcaagcaatcaagcatcactgggagtccaa

SEQ ID NO: 612404 - DNA, 133 bp, Homo sapiens
ttttgcaaattttggggcccccctttttacaaaaggaatttcttccctttgtttttttttaaaaaatttgggaatttttttgggttttaaaaacttttattcctttaccccccgggtgggccctttgggttca

SEQ ID NO: 612405 - DNA, 189 bp, Homo sapiens
aaagtaggaatgtaagcccagagtgtcaaagcatgtaatgaactgtccccaaatggttcttgtcctacaagtgggtagaacaaataagcaggagcaagaatgaggaagaggctgggaaattcagtggggttcggccgtggaagtgtgtcctttgttcccgacgtagctgccacgtagcaactgctttgg

SEQ ID NO: 612406 - DNA, 199 bp, Homo sapiens
  misc_feature (55)..(55): n is a, c, g, or t
  misc_feature (95)..(95): n is a, c, g, or t
  misc_feature (130)..(130): n is a, c, g, or t
  misc_feature (165)..(165): n is a, c, g, or t
  misc_feature (198)..(198): n is a, c, g, or t
aggaggacttacagcggatcctgcagctgtcactcactgagcactgagccattancccgggagggctgccaggccactccctgcccgcttttgtnatttatttatttataaactctctgctgctgaagcnttggctggagccccaggaatgacgcacggcagggnagacgtgacgatggaataaagaaactgtagcanc

SEQ ID NO: 612407 - DNA, 1092 bp, Homo sapiens
gccttgtccctgtcacagcggcaggtcacccgaggaggagtcggggtcgagtccggcgatgtggcagagcacctagtaatggcctgtactcgtgtccggatgtccctaccggcgatgctcggggcccttggtattggccttggagagctggtggctacctgtctcgctctcttctgtccctccgtgcgtccgctggtgagaagtcagcagcctggttctggaccaggcatgagcctgcacgtagcactgttggccgggccagcgtagggtgcgcgcgatgctcaggctgtggtgactgcatgcactgcgtggagactgaccgggagccatgcagtgtggatcgacgatggacctgggagcatgttcaacacctctcttgcacctgacacgtcgtacaacaaagtcccagggttgcctgagaaacggaaggacttacattggtagctggcatggagatcggacactagagacccacgaaggggccaatgaaaagcccccagagagacatcaagattccattgcttcgagcaaacattacctgggaatcgtagcagtcaatttcacctgtcggccacattgctttcgcctccgattgcaattgcttccacgtgcattaccggccccataaatgaagccgatggcaggccacaaatggggactagtaatgggtgcataggtgggggagcattacgtgaggatagaacccgggggggaggttacgaacgcctcaagaagaaagggtggccccaaagtccgttaccgagaggatgacgtagccaagcaccgcattatgcacacaccggcagacggctcgcagtacaactttggcgtagtacctttgtcgcactccctgtggtgctgttgaggggcccctgggggaacaccgtggaactcctgaagcgttaacgcccgatccgagttggaacgcgaacttcccgtacgaagtgtggaacgcgtgaaggggtctttaaccaggagcatttacatacccaaccccgagacgtggccccgacacgacacgggtcgaaagacttcgggcggcagcaacgtaagccaccttcgacatggtgcaatgcaaaggcccatggttag

SEQ ID NO: 612408 - DNA, 118 bp, Homo sapiens
atacttcatttagccatatcgtgagctttctgggcagagttggctgacctttgcccagctccagccagcacattgcttgtccacatgtctttttacttacatcccatcgcgcaacctg

SEQ ID NO: 612409 - DNA, 207 bp, Homo sapiens
atggatatatggttagatgtgtagtgatagtaggcctagatatgaggagcgtaatggagtggaagtgaaatcacatggctaggccggaggtcattaggagggctgagagggccctgattaggggtcatgggatggggtttactatatgataggcatgtgattggtgggtcattatgtgtagtcgtgcaggtagaggcttagtagaag

SEQ ID NO: 612410 - DNA, 1101 bp, Homo sapiens
  misc_feature (1)..(1): n is a, c, g, or t
  misc_feature (566)..(566): n is a, c, g, or t
  misc_feature (601)..(601): n is a, c, g, or t
nctgttctgtggttccctcgttacaccccctggtttgtttataccccggtgtccctttcctcgggtgggctcccccacctcgttggtgtggcgcttcttgcccgtcgacccgtgggttgtctcgctttcgttgggttgcctcccccctgcgcgcgctcgtggcgtgggtttattgcgccaacaagcgcacacattctcttcctagtggtggcaccctccggctgcttctcacaaaggcgcgtgtccccgcctggcggccccttttgtgtgaggacctacaagcgatctgctttcttagctcgccaagagatgtggcgtccaccgagagattgtcttcgaaggggggcgcctcttaagagcggccccgagcgagctatacttgcccgtgtggacccacacccctctcgtgctgtcggcttctctcctttcggggacgagtaacctgtgctgttttttcttccagccgctcgtggaccctccccgcgtgggttggttaccccgctcctcccccgatttggctgctcccccgcggatatagggctgttctcttgtcgagggcacacacnagtatcgcagcttgttctgtctcgggtggccaacnccgcagagcactcggagacgacagagatgtcgccccccagaagaggccgtctttgggcgcacgcaccacgagagcccctttctctcccggggattatgtctgcgtcctctcttataggaagcctgtttctcccccccactgcagatgtggtgtacaaccttaccgcggagaagagccaccaggggtctctcttgtcagcccacatgtctcctgtaaccagagatgttgttgcgcccccacacacactaggggggcaaggttcaccaacgggctggaactcattcgaattcgctcagtcttgcccctcgtcgcgagcccgtcccgtaagacaattgtagtctagggaagcccaccggtaggtcacccctcggggcttccgtccggtgctccatggtttctgtccccggcccggtgggtgtgtcgtccccccctttccccccccccccccctcggtcaccccccccccccgggtgaaaaaatttttgttggttgggaaagta

SEQ ID NO: 612411 - DNA, 761 bp, Homo sapiens
  misc_feature (359)..(359): n is a, c, g, or t
  misc_feature (607)..(607): n is a, c, g, or t
  misc_feature (717)..(717): n is a, c, g, or t
  misc_feature (727)..(727): n is a, c, g, or t
tgggggcaagattccattggaggaaataactgctgatatggtgtgaatagcaagagaactagaattagaagtggagcctgaagatgtgactgaattgctgcaatcccatggtcaaacttgaagagataaggagttgtttcttatgggtgaacaaataagatggttcttgagatggaatctattcctggtgaagatgctgtgaaagttgttgaaatgacaacaaaggattgagaatattctgtaagcttcactgattaaggaactagcagggttggagatggttgctatcaagcagcatcacatgctacagagaaatattttgtgaaaggaagacttaatgcatcaaacttcattgttgncttattttaggaaattgtcacagacaccccaacctttaccaaccaccaccccagtgagtcagcagccactaacatgaatgcaagaccctctaccaatagaaagattatgacttgttgaaagactcagatggttattaatacgttttagcggtaaagtatttttaaattatgtacattgtttttttggacataatgctatcacacacttaataaactaagctacaatgtaaacttagttttaaacattntttttattattatttttttgagacagagtctctctctgtcgcccaagctggagtgcagtggcatgaatctcgctactgcaacctctgccttctgggttcagcgattctgngtctcacctnctgagtagctgggattacagcgcgcatccgcctg

SEQ ID NO: 612412 - DNA, 659 bp, Homo sapiens
  misc_feature (109)..(109): n is a, c, g, or t
  misc_feature (657)..(657): n is a, c, g, or t
ggaagatgcaagcagaaatttgtccatgtatgtctgtatcccttgacctactcagaaattgttgggatctgttttctataaaacataatttctcctttgtatctagtcntccttcttccacaaatgctctgatttttctttagtgatctaccccttccccatgtgcatcaggtgaggctgacttgcatccccaggacctctgggtctagccaagtagtcaccatgtactgttcctctggccatggggattgcttcaggaccagtgcaaaatcgagaccaatgagagctagtgaaacttaattaggaagctttggtttaatctttcagggaagctggatatgaaaatgaaagaatgtaggttgtgtagctgctgcagtctaggaatggagagaaggaaaagctgctcttttggccttgttgatccccagatcgtgctgcaccagtctacctctggactattttttttacaagacccaaaggattttctttgcaacagaaaggatcctaactgatggcagttattttccttttaggtgatgcacaataataagggtatcattatttggtatagaacccctgtctacacactgctcaaactagagtagtatattttaacttcttctaatcaagacacaaccatgaccttacaggataaantt

SEQ ID NO: 612413 - DNA, 327 bp, Homo sapiens
  misc_feature (7)..(7): n is a, c, g, or t
  misc_feature (24)..(24): n is a, c, g, or t
  misc_feature (215)..(215): n is a, c, g, or t
ccgcccntctaggtcgtaatgtgntgagagtcgggacccatggaaaggtgagaggaatctctacatcgaatcatcgtgtgggttgatcatccagtggggagcaatcttgggtaagatggcactgacaaggaagatgaagtttacccggcccttattcaaggatcttgctgcctttgacaaaatcccatgatcaagctgtcccgaacctacccaanggagcacaaaagcaaagcattgcaatcccgtgacttgcaaatgcttgggtggggggaaaaggactttaaaaaggtgggatttaaaaggaccctgcggttttttggatggaat

SEQ ID NO: 612414 - DNA, 148 bp, Homo sapiens
cagagagaaattagaaatgcctgtatagatgtctcgaggaactgttacttttgagtccccatgattttcttcatactcgggttccctttctacaacacaaccatgtacttaccatcacagtaatatactaatttctctcggaccaatg

SEQ ID NO: 612415 - DNA, 305 bp, Homo sapiens
gctcgacctggagtccacccagctctgcccaacctcccaacctcttgctgcctaccctggaataagcagaagcttccaagggaatgtggactcagccccggaattgcctgtggacttcctttccctggctcgtggcccccaactcctccccatttgtgcttcctgatgcctctacaggacatgcacggcttgtccagctgtccccgtgccatggtgggtttccgttcccaatctgccccttcaagaagcagaactgctccttccccaggaacgtgctacttcttaaagctctccacacaagctgg

SEQ ID NO: 612416 - DNA, 193 bp, Homo sapiens
agtaatcctcgtcggcttcagcttctgggaatcgagatcgtcatcctcatcatcttcagctgcccgctatgcccgtagctgactcagcttcctcatcttacatctccatcctcttcctcaccatcaccttcttctccctcctcctcttacctccccaccttcttcctcttcttcgtctacctcagcgtcctgg

SEQ ID NO: 612417 - DNA, 555 bp, Homo sapiens
  misc_feature (129)..(129): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (149)..(149): n is a, c, g, or t
  misc_feature (154)..(154): n is a, c, g, or t
  misc_feature (161)..(161): n is a, c, g, or t
  misc_feature (177)..(178): n is a, c, g, or t
  misc_feature (180)..(180): n is a, c, g, or t
  misc_feature (185)..(185): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (201)..(201): n is a, c, g, or t
  misc_feature (205)..(205): n is a, c, g, or t
  misc_feature (208)..(208): n is a, c, g, or t
  misc_feature (210)..(210): n is a, c, g, or t
  misc_feature (217)..(218): n is a, c, g, or t
  misc_feature (222)..(223): n is a, c, g, or t
  misc_feature (226)..(226): n is a, c, g, or t
  misc_feature (231)..(231): n is a, c, g, or t
  misc_feature (234)..(235): n is a, c, g, or t
  misc_feature (238)..(238): n is a, c, g, or t
  misc_feature (241)..(241): n is a, c, g, or t
  misc_feature (248)..(248): n is a, c, g, or t
  misc_feature (266)..(266): n is a, c, g, or t
  misc_feature (268)..(268): n is a, c, g, or t
  misc_feature (273)..(273): n is a, c, g, or t
  misc_feature (287)..(287): n is a, c, g, or t
  misc_feature (292)..(292): n is a, c, g, or t
  misc_feature (295)..(295): n is a, c, g, or t
  misc_feature (300)..(300): n is a, c, g, or t
  misc_feature (311)..(311): n is a, c, g, or t
  misc_feature (313)..(314): n is a, c, g, or t
  misc_feature (319)..(319): n is a, c, g, or t
  misc_feature (324)..(324): n is a, c, g, or t
  misc_feature (326)..(326): n is a, c, g, or t
  misc_feature (330)..(330): n is a, c, g, or t
  misc_feature (344)..(344): n is a, c, g, or t
  misc_feature (351)..(351): n is a, c, g, or t
  misc_feature (354)..(355): n is a, c, g, or t
  misc_feature (359)..(359): n is a, c, g, or t
  misc_feature (366)..(366): n is a, c, g, or t
  misc_feature (368)..(368): n is a, c, g, or t
  misc_feature (377)..(377): n is a, c, g, or t
  misc_feature (382)..(382): n is a, c, g, or t
  misc_feature (384)..(384): n is a, c, g, or t
  misc_feature (394)..(394): n is a, c, g, or t
  misc_feature (397)..(397): n is a, c, g, or t
  misc_feature (411)..(411): n is a, c, g, or t
  misc_feature (415)..(415): n is a, c, g, or t
  misc_feature (421)..(421): n is a, c, g, or t
  misc_feature (425)..(425): n is a, c, g, or t
  misc_feature (430)..(430): n is a, c, g, or t
  misc_feature (432)..(432): n is a, c, g, or t
  misc_feature (434)..(434): n is a, c, g, or t
  misc_feature (440)..(440): n is a, c, g, or t
  misc_feature (482)..(482): n is a, c, g, or t
  misc_feature (501)..(501): n is a, c, g, or t
  misc_feature (507)..(507): n is a, c, g, or t
  misc_feature (513)..(513): n is a, c, g, or t
cttgatagggaccctggtgcaactacaccaccggtacagtcgccgtaatgtggtcagtacagggagtggcatggctgaggccagcctggaacccagcatacgcccgggtagccagcccctggagatgtnccncattgggcngcngcagnccttnaagcccncagaggcatgaggaanncncctcnggccnantncnttgcncccngcngncctcccnngccnnggngaccnttnnccnccngcctggngcgcgcgacccggggccncngtttncccccccccccccnccccnccnccccngtggccccctncnnccccnggtgncnccgncaccccctgcggancctgaancanncccngacaagnanccccccccntctgncnttgcggcctnttnactcccccccccantgcncccccncacnccccnancncccacncccccccccccccccccttccccaacaccccacaccaccccncccacacaaacctgcccancccacncacccnccagcccaagatgagcagaaacaataaagtgagcatttttcc

SEQ ID NO: 612418 - DNA, 391 bp, Homo sapiens
  misc_feature (1)..(1): n is a, c, g, or t
ntggagcaagattgatagcagtcatgtgacgacggagataaataactcaggcaggatgtatagattaagcatgagacaccgaagctccctgcagaggccagggagagaacggaagaccttcatcttaacaaattgtatgaggagtctctgtccatttgttaaaggcattggatcagagacaagagggctcagtgtttctcttgaggcctgaatggctgaaggcggtgagttcccgaggggcgtcatgggttgtccagcctttcattaactgcacatagtgttagccagacaggtgtacgtgtttgtcatcccatctaagagactgaagcaggaggatcacctgtacatgactgcttctttcaacattttaaaatgtgtaacttctattaaa

SEQ ID NO: 612419 - DNA, 1842 bp, Homo sapiens
taaggcatggacaagctgaatctaaaatgtttatgacaaataatctataacagccaaataactttgaaagaacaaagttgaaagatttaaatcatatgacttcaacatttattataaagttatagtaatcaagacatgtagtaatgccaactaagatagacaaatcagagagtccagaaatagaaccacacatctatgataaatggtcaactgatttttcataaagtgaaaatgcagctcaggagaaaaagaatagttttttaaacagtgctggaccactggatacccataaacaaaaccaaaaattttaaaaactcattttggctgagtgcaatgccttatgccctgtaatcccagcactctggggaggcagaggtgggaggactgcttgaggccaggagtttgagacctgcctggtcaacatagtgaaaccccatctctacaaaagaaaaaaattagtcaggcacggttgcatgtgcctgtagtcccagctacttgggagcctgaggccaaccatcacttaagcccagcagtttggggctgcagtgagctatgatcccatcactgcactccagccttggtgacagagtgagaccccgtgtcaaaaaaaaaaaaaaaaattttgagcattctccaagtcttcgccttttctggttttaatttaaaacaaacaaacaaaaaaaacaaaacaaaacatagtgcatatgtagtttttgtctgcccagaatccctcttttctgcagaaaactgccttactcccactccacgtgttcctagtaagataacaatcacagtgccctttcagctacctggctctgggagtgggttcagtatcaacctattctttcagttcttctaaagtaaactgctgatggaatatttctttagtctttcaagagggcagagccatgcttcttccttaatatgtgtgttcatgacataaaacccttcaaacctctcctaatcttaaaagtattaaatgtttacatcttcctcaaacataatacttgattgacagtcaaggagttccaacacaaaactattaatatggcgagacagcaaacaccaacccttcttatccactcaattatactatgaaatgagttatggttgaatcatcagaatgttctggaatggctgggtacagtggcttacacctgtaatcccagcactgtaggcaggtggatcacttgagtctaggaggctggtcttgaaccctggaggcagagtttgccatttgccattgcattccagcctgggcaacaagggcgaaactccatctcaaaaaaaaaaaaaaaagactacagaccaggcatggtggttcatgcctgtaattccagcactatgggaggctgaggtgggaggaccacctgagcccaggagtttgagaccagcgtgggcaacaaagtgagataccatctccacaaataacaaacaaaaaacaagaaaacaagattgagaaagaggttgccataatctctagtagtctgtacagtcttcctcttcttctttttttttttttttttttttttttttttttttagacagagtgtcgctctgttacgcaggctggagtgcagtagggcaatcttggctcactgcaagctccgcctcctgggttcacgccattctcctgcctcagcctccaagtagctgggactacaggtgcccgccaccacgcccggctaatttttgtcagctggtggaatgtgcctgtggtctcagctactcggcagactgagatagatcactggatcactggagctctgggggtcaaggctgtagtgagccatgattacatcactgcactccagcctgtcagcagagggaagaccctgcctc

SEQ ID NO: 612420 - DNA, 661 bp, Homo sapiens
ccagcctgggtgacaagagcgaaactccatctcaaaaaaaaaaaaaaaaccaaagggaaacataaaaatcccctataaatatttcccaggaaatatttaatgggggctggatttaaataagggcgtggtatcatggatggataacgtgggaatcgattttatggtctttgggtatttaaatcactggagttaatcaaccactggcaaatcccattggacaaagattagcatggtaaaaaacagatacgggggtagatttctagaaattcattcacatttaagacttctaaaagggaataatagcctttggttttcatggagcatattcgcacccctatatgaattacagcatttaaggttcaaaatcagtaactttaaatctaggaaatggaaaaatattaagtggcaaagcaaaaaagggtacttctggaaaatactattcacggtgttacctagactatgaggtagtcccttaggtggtttgacctggaagtggagtgggtggaagctgtggccagtcggtggggggtgtgtactcgtatgaaagttctctacccctactgtgtgagtgcccacttcagatgtccagtctcagagctagtcgagagactcaattgggttaacccctcgctttgactgtcggacttaactcattaattac

SEQ ID NO: 612421 - DNA, 208 bp, Homo sapiens
ttgattggtggtattcgcagcaaccacgatgagattgaagactactattctctttttttgcttgtttttgagatggagtcttcctctgtcacccaggctggagtgcagtggcacgatcttggctcactccaacctccgtctcccaggttcaagtgatttaagattggagactattattctaagtgaagtaactcaggaatggaaaagc

SEQ ID NO: 612422 - DNA, 230 bp, Homo sapiens
  misc_feature (52)..(52): n is a, c, g, or t
  misc_feature (156)..(156): n is a, c, g, or t
  misc_feature (194)..(194): n is a, c, g, or t
gatccacaaaagaagtgaaagtagccttaactgatgacattccaccattgtnatttgttcctgccccacgctaactgataccatatattcttcccccgcccttgagaatgtactttgtacacctatcccaaacctataagaactaatgataatccnaccaccctttgctgactctctttttggactcagcccgnctgcacccaggtgaaataaacagccctgttgctcac

SEQ ID NO: 612423 - DNA, 433 bp, Homo sapiens
  misc_feature (276)..(277): n is a, c, g, or t
  misc_feature (292)..(292): n is a, c, g, or t
cctctgaagtgttctgtgagttgtggctgtgttcacgtctctccgtcagccagactgtgggtgccgtgtccctgagcctggaactcctccggccttttgcgatctgtgcattccctccagacggcagctcctcactcccaggcccctctactggggcaccagcaaggagggaggcagaggggccaggcactgagtaggggaggggctggcagggaccctctacctggccccttgggaaggacacagacccagatggagcctgtcccctcgacaccnngcctgggcccctccncagctctgctggaataaatcctcctgtaacaacctcccgctgtgtcccagcgtctggagaatgaacacagctccccataactttccaggcgctatccgatgggacagtttgtaataaaattgcttctaaaaacataaaaaa

SEQ ID NO: 612424 - DNA, 557 bp, Homo sapiens
gcagacacaatcagcaacaccacacagatacacaccgagcacgacatataccagacagatataaaccacacacaaccatacatcaccacacagatatacagcacacatagacacagaatcaccactcaacacacagatccacaccacgcgcagacaaggaccgacacagatacaaaccacacgcacacacgtacatcaggacacggctgcagagcacacacagacgacacaagcaacaaacaagacgcagatacacagcacacacagacacacacatatcaccacacagatacacaccacacacacactcccacacatcaccacaaaaatacacaccacacagagacacacacacctatcaccacagatacatgccacacacacacccatacatcaccacagataccacacacagacacacaatcaccacccatcacacagataccacacacacatcacacagatacacaccacacacacatcaccacatggatgcacaccacacacacatccttacatcaccacacagatacacagcacacacacacacacactta

SEQ ID NO: 612425 - DNA, 255 bp, Homo sapiens
caggcgaccgtagcttcagcaggggaggggaggcaaccaggagcgagctcgtgagacaggccacaggggatagagctgccgaagtgggcggctgtggtggtgcttctggaaggagcgagataccctgcatgtcagcatggggggctgcccaagcccctcaccctgagatgggagccgtcttcccagcccaacatccccatcgtgggcatcattgctggcctggttctctttgcagctgtgatcgctggagctgtg

SEQ ID NO: 612426 - DNA, 601 bp, Homo sapiens
gatggcagaggaggtgaggagggaggaagcgtccggagtggtggctggtgcccggactccgacccccgtgggcgcttcgagccccccagctggtcaccgatggcacctgccgcttcacccaggccagtagccgccccctcgctgcacccctggcccctgcctctacacgctgctgccctgatgctgagcccctggtgctccgcctcgtggcccagctgtgtgcgcaggggtcatgtgcgttcgtctctgtgtgtcctctgcggacaacgcgtgacgcatcccctgcattcgacacggcccactgggtcccctcgacttgcctgtgccactgctctgtggtgcgccgggagctgccacgggactggactcgggtgggtggcgtgtcccccttgcccccagacagaacagctgtggctggcctcgttcgcacagttgcagcgaaaccccgcggggagttattcacccatggtcgctttggcacttatacagcctgttagcgaacttctcctcctccgcgcagccatatttcggcaaccccccattcatccgccaacagcccaccggagagctttctccgtcggccccacttacaggtccaccg

SEQ ID NO: 612427 - DNA, 201 bp, Homo sapiens
ttcgcttgtgatgtcccggacgttgtaaagctgacacacgttatggtactatgttagccccatactttgtttgttccttttcaagacacttccataatctggactcctctgtccaggcactgctgcccagcctccaagctccatctccaatccaaattttttacagctgcctgcagatactttacctactatcaaatccgg

SEQ ID NO: 612428 - DNA, 234 bp, Homo sapiens
ggaccattattccttctttattgtagtgtactgggagtgtaaaaagaacttgtatgtataatgctattctatacaaggtatgtagcccaggaaatgaccaacctgatgtgtgttatgacccatctgagcctcccatgaccacagttttaaaaataagattaagtactgaggactggtgggggctcataaacgatatgacgtaaagtgttagccaataaagaacggacaactacg

SEQ ID NO: 612429 - DNA, 191 bp, Homo sapiens
gaattatcaaaacgaatgttcaaaaatatcactgaattctgtactttaccgtactattagcacggtaattacttagactgctactattctgaatttcatccagattgtataaaaacaatggcatcaattgttaattgaactaggtccggtgtataaatcttaagaactgtcagagaagtgtcccagacgtt

SEQ ID NO: 612430 - DNA, 1435 bp, Homo sapiens
tggaaaaaaacgaccttgatttcccaccctttggagtttacaactcgggaacaccgtgggaagaagggggaaagaagttgggaaggtgggaattgaagaacactaggagaggggcctcaacaagcgtgggaggctctagtctccacttataatttgtgtgtcacgtggaagaggtgcctcactgggccgcggtgtatctcagtgtgagagaagagacaccagcgtgtggcgagaagtgagagagggcttctcgtgtctcacaccgaaaaacagaggtgtgtctcgccagtgtgtggcccagagagagggccgacacgaaatctttacagagagttaaccccgcttcttttctcatccgcgtgggcgccaacacgagtctcgcggaggaaagagtggcgtatatgtgcgtgtggcgcgacatcacgaaagtgtgagcattaaacccccgagcgccagaaaacagagtctcgtgtgtgacagtgtgtgtggagaagtgttattcacgagtggaaccttctcgcgaggctatagaagccgcctcggagaggcgatttgtgctccccacggggcgctctcgccctgtggggagaagatctccatatagcgcgcccacggaggatgtgtgtgggcacaccgcggagtgtcgcgcccgcgttggtgcgtgtcatagggggtcttctctcaaaggtgtgcggcgcccctcccctcgtgaggacgtgctccctctctccaggcacgcccattctttctttctccctttcgcgcgagctttgttgggccccatggtggggtgccgtaaaaacagtctggggggtaagtaggagcacaagcctcgttgcgcacccagaattctccacaggtattcccccaagggataagtgggggccttaaagcaagcatccacagcgcggtgcgccatcatcacacctcaaaaaaagatttttacaaacaccaaaccacagattgtccaagtagtgtaaacgggggaccaaccccaagacgcattagagtcacccccgaagtcttcatgattccccctttaacagagggcctccaattctgtggaatatctccccctatgtgtggacaggcgcatttgcacccctcgcgagaattaatgccccgccgaaaacacctagtatactcccggactatacacacagagagtcccccggagaaaacatgtggcccctcacaggagtgtctcccgtggcaataaaacgccatttgaatagttcccccaagcgccgacgagtactcatatgtagccccgtgtgggccccgtgtgtaaaacccgcgtgaaggcgacccccgaaagagggtgtccgtagtcattcccgcagtgaggggataccgcccgtgtcatatcgacaccaaaaggagttctactgtagtccacccagacatacagttcgcgacgagcaagccgcacaat

SEQ ID NO: 612431 - DNA, 173 bp, Homo sapiens
  misc_feature (16)..(16): n is a, c, g, or t
  misc_feature (92)..(92): n is a, c, g, or t
agtgctccgccagganctcttttaccagggcaactcccagacagtgagaagagtggctcaacgtggccatcacccggaccctgcaccaggcngaggagagccttttagagctgacgaaacagatctgctctttcctgcagacagcaccagagcagttcccctccggagcaagt

SEQ ID NO: 612432 - DNA, 162 bp, Homo sapiens
atcccctagtgactgtcgccgctctctactgctgcatcacacggagcgctccaagtctgcgatgatggactcaacaccttccggacgagccttttagagctgacgaaacagatctgctctttcctgcagacagcaccagagcagttcccctccggagcaagt

SEQ ID NO: 612433 - DNA, 142 bp, Homo sapiens
ctattcaggtagttgtggcaaatattatggatactagtatatggagatcaggttcgtcctttagtgttgtgtatggttatcatttgtgtcgaggttagtttgattattcgttgttgggatgctgatcgctggggttcgtaag

SEQ ID NO: 612434 - DNA, 688 bp, Homo sapiens
  misc_feature (688)..(688): n is a, c, g, or t
tcccaaaatcaaacggctttcctatactttatggatataaatacggcaaatctcaataagccccagctaccatttaccccctacaacaacaagaaaacaaagtttcaaaagaattattaatatttaatgtgcaaagaagttaaaccaacagaaagtgcgttctcacatctccacttagtagtctccctcttactacagcaaagcagcactccatagctatacctgtgcgatcacagactgtggccttactacagtgtggttataaaactcatctgtgactagtagaagccagaggatgtgagatttgtacaatctcacacacctctctctaatattgtctctctacagggtgggcacaaaatgtgcctcccttcttttccatctcaacacacgcggtgcgttgtggcagttattccccccgcactctctcaaagaccgattcaattttctccacaaacgaggtgtggcgctacattttgcgagaggaagaatacaccaccccgatagtctcgagcggggtttatcccggggcgcgccccgggcgtcgtgtgactttctatataaatatatatctcctctttgtgagaaaaaccacagagaaaagggggatctccccccaaggtatatatatctctgtgtgtataaagatggctctccacaaaaaaatatattacggcccctctgtccn

SEQ ID NO: 612435 - DNA, 293 bp, Homo sapiens
ccacggtatgtcttacgtgtacgaaataatgcttttgaccatgacaatttaaaaatcggaattgatgaagcccacgctttgggtaaaaagttttatgttgtggtgaatatccagccacataacagcaaattaaaaaactttattcgtgatcttgagccgattgtggctatgcagccagatgctttgattatgtctgatcccggcttaattatgatggtacgtgagcattttccagaaatgcaaattcatctatcggttcaagccaacgctattaactgggccactgcgtaaga

SEQ ID NO: 612436 - DNA, 219 bp, Homo sapiens
ccacagccggaccccaacgagggcgctgtacctgaggacaacttgtaccatgatggagcattgaattcgactatcgcatctggtgggcagtctgctgcacaatgcgtggttgagaacaatcatcagcccatcttcgcggagatcagtaggatggtgaagacctacgagaaactcacctgagatcatccccaagtcagccgtggggttccggctgtctga

SEQ ID NO: 612437 - DNA, 407 bp, Homo sapiens
cgaattgcatgtagaatatagccgtagtgccggaagaacttgtgggacttactgaagcctgcgaggacgccgtgaatagtatgtggctattggctatcgccaagcctagtgccacctgcagatatgccatccttaagtaagcaggctgtgcctacatgctgggtgctcagtgcaagtctgattctgggatgattactgttgctgagcggcatatgcctacatctgccatgggtggtgctaccccagcgtgctcgtatcgtagtgcttcagctcgtacaggtacagaccgagtgcatgcctgacgaagctgctcccacatgctccactagttgatctaggcccagatactcactatagtactacactctatgactacgagtatacatagcagctagatcctggcttct

SEQ ID NO: 612438 - DNA, 158 bp, Homo sapiens
gtaatgactcagacatacaggacacattaaagagtttacaacattgttagaatcctgaagccacagaaaacggattgcaaagaacgtctacgtcatccttcttcattatgtcatcttgttatatgtcatattataaacgataataggcgccgggacga

SEQ ID NO: 612439 - DNA, 413 bp, Homo sapiens
  misc_feature (153)..(153): n is a, c, g, or t
  misc_feature (171)..(171): n is a, c, g, or t
  misc_feature (234)..(234): n is a, c, g, or t
  misc_feature (238)..(238): n is a, c, g, or t
caccactcctatagatcagttaggaggctactgcaatagtgtagatgaggcctaaaggttacttggcaaagggagaaagaagtgagaagagaggatattgagtgaggctatgcttttgtttcaataatttcaaatttattttttaaaaagcanaaataaaaataggacaanaagcacccatacacactttaccagagatcacctatcaatatttacctattgtcaacactttanctancaaacatacacaaatgggtgtgtgtgtgtgtgtgtgtgtgtgtgtgtgtgtatagctgtagaaattgttgggtgctgttgtttaatatcttcccagagtgggtgtgtcaatttacactgctgccaacgggtgccctacatccgtgccattattaaattataaaatttatattttt

SEQ ID NO: 612440 - DNA, 1041 bp, Homo sapiens
gagcggagcatgcgtgctggggtctgggtgctgcagagcagcggcgggaggaggcggacactgtgtgcaacagcgtgtagcacgccctgggcggctgggcagcaacatgcggcggccggcaatcgtgccctgagcctgccgtgcctgacactaccaggcacataatcatagaaacatgtaatgccagacaagtattttcacaataccagcttgtggatttcgcgcacatagagatagcacagatcgatttcgagacctagaggcagacatatgaatcatagtagaatatataactcatctagactatcatcacaaacaggacaagcgaccaccccagggctagaccagagggcaaaccatagaatgccaccacagcacagcggcatagtgggtgacaaccgcggacgcgtctcagggacaagattgatcgtaaacgatactataaaagacaccataggcagcgagcactatgggtatcaaattgataataacatctggatgattacacctcgctaacgctgcgtccagaaacaatgatcgtgacaagacatgagatacgacaccagacgagcacccaactgcggccacttgaagacacgactgctcggagcgacagacgcacgaggattccatgactacgactggcggcaaatgcacacgtgaccactacacgtgacatggatgtacagaccccccctacgagccacggaacagaccgacaccgctacgtcccggctcagagaacctctaacatcggcgatacacaacatacgtagagtgactcggcaaatgaccacagcagaggatggaacatcaatcgaaacacaaagacatacgattgcaacataacgatgaacgcatcgagactgcatggataaggacaggacaacgctaggccgacagcacacgcaaggacaaaggaagaataaatatcacaaaaagagcactaaacaatcgctaaacaatccctcgagcggcaattgacatccacgacgctaagggtgcagcgaatggcaaaataatgagccagatccacagagg

SEQ ID NO: 612441 - DNA, 883 bp, Homo sapiens
tggcacaatgggtcctaaagcatcaagttaggtacaatcccagtatggtaagaaccatcatcaggatagttgatacaagtctgctttgctattctttttgggcgtaaatactcctatcattttctgaattacctggtaggttagaactccgtagcaccacggggaagaatagaggtatcatcagaaacgtggcaaagtcttcttttcaggcaataattataagaggcatgattccacagctttttctgggatgttcgagattctttttttagtactaagcaacattctcatcacagaatgtagcccaggccaattcagaactagaatctctattccgttcggatgatgcttctaaaaacagcattgataggttaaagaagcttgggtatgtctcaagttttactttcaagtgatttagctccaggcttgcttaactggagttggaaatcctgtgatatgtacattggattcatgactgtgcagcattttatagttatgtggtgttttgcgccacgaatgacaataagggttgttcccccattttggtttcaggaggacacgcatagtgtgtttattgtaaactcctcatacacttttaaaaccagacatcttttgttcatagaattcgcttggtagtgttttgtccaggtaccttaactgtagcttgtgtaatggtgatgaatatctgtatcttaacggcttccataactggctagttgatatttcaaggaacctgagttttctgtgatatcttgaaggggtggggaaaaaaatagcacctaagtgataactttgttaaaggcatagttgcttccagattctgactgtgtgagggtaaatactgtcaccaatgaaatctccgatacttcctggacacgaatcc

SEQ ID NO: 612442 - DNA, 408 bp, Homo sapiens
tccctgggccccgcacatttagaggtggtgaaaaggccaatggttggggttaacccccctgcccccggggttcctccctggggtcggggaattttggatgccccgtggggaattttgggtccaaaaacccccccaggcggggggggtttccctgcttggggggggcccccggggggggtgcctttttttttttcttttcggggccgaacccgcccgggggtgaacccccccctgggtggtgtggcccttttcttttttcccggttccccttcccccccaagggggcctcgggttttttaggggccccctttttttttttttggtcttttgggggcccggggccccgccccccccccctttgggggtttttttttttgggggtttaggcccccttttttccccccccca

SEQ ID NO: 612443 - DNA, 290 bp, Homo sapiens
gttccccaaggtggtcgatccagacatctgccttacaaaaccgcctcctgggaccaccttcccatggacagctggataccacctgcttgacttgtcccactgacccccacacccacatggaccatgccgatatcctacccacaccgacccctctcagtcacagcgtgagtccccggggctcatgcctgcttgctctaaaccccccagttagaacctccaggggaaacctgcatagatgacaccttgggccccagtgaaggctttggctcatagctccctgcgaggggtac

SEQ ID NO: 612444 - DNA, 994 bp, Homo sapiens
ggtgaacagacaggtttcctatatgtcgtcggaggtcaggaaatgggtatccccgtaagccgacaattgtgtcatgtgacgttaagtggaaccttccgttttctcaccattagttagcgctttttgctccacggagttaaagaggggccacttaacaagtgcccagggcgaagggaacgtgcggtctcttcagtgcccaaagtggagtcaggactctacggcgaaatgacccgtatagccattccttacactttcgctatgaggaaccacattgtgaataagctcaatttaatgtctttgttcacaaatgtgtactttcataccttgatttttaaatgtacacttataacctgtatggtatttgtatttaaaggagataaacagccacaatagcagactaggtcactgaatgataagatttgcaccttagaacaataatcattttaaggataacaagtatatgtctgaaaggcactgaggggctttagttgcctttacctcatatgagtctttgatcttgaactcgatactgtttggatctcattgttgatatacctgaatgtactattgtaagagaattgctaacttcacttcatgctgatgatgtatcaaaggtcattttatagaaagagttaaagtgtcttctttactggaagtgatatatgtcaaattagcatcttgcctacatgcagctagtttgatgcagggatcagttccatttgttggtgagaatgtttttgaccgggacgtgagtggtctcatgcctgtagatcctcagtacattgggaggccaaggcaggctggatcactctgaggtcatagtagctctcgaggccagccttggccaacatggggaaaccctgtctctactaaaaatacaaatacttggccgggctgtgatggtgggcgccttgtaatcccagccacttccagaggctgaggcaggagaatcgcttgaacctggcgagaagcgactcagcattgagtctacata

SEQ ID NO: 612445 - DNA, 473 bp, Homo sapiens
  misc_feature (420)..(420): n is a, c, g, or t
  misc_feature (451)..(451): n is a, c, g, or t
gccaggaggaagctgctgagccatgggcgcctacgacgcgggcttcgtggggtctgcgctcgcaggctgcactggactcagtcacggcccctaggaccgatgtcccgcagccctgccggccaccgcatcgccgcactctcatgctttgttcctgtttgtatgctggtcggactgccgagtgactcgtggcctggtgggatgacagagactatgctcgccacagttgccagtcctgaatcagtgcctgaagctgtgtcgacctgtccttgccatcgagcacacagttgatcgacagtaggcgctcggcctgcagaacagcctgtggagcacacggtactgtgttagttggatactcacagagcatgagcgatcacagtcgagcgccaggctagtagcgacgtgacactactctgcgagctncgtgctccaatcctgcgttgccctctgacgngtgtccagcagtccccctagcc

SEQ ID NO: 612446 - DNA, 142 bp, Homo sapiens
  misc_feature (38)..(38): n is a, c, g, or t
  misc_feature (101)..(101): n is a, c, g, or t
  misc_feature (104)..(104): n is a, c, g, or t
  misc_feature (113)..(114): n is a, c, g, or t
cgccgttgacagtcatcttgcgccccctgctggtggangatggtgtctgcaggcagttcaagctacccccgttggcagctgtggtggccccactggctgtngantggggattnntggaggtagggtgggtggctggaagccc

SEQ ID NO: 612447 - DNA, 394 bp, Homo sapiens
tgatttgcacattttgacattattgatgctttgcaagggcctaaaagtacaaggcgtacaggttatatgtgtcccagaaacccagcctttgtggcaacagtggtaataaacttgcgcagaggggactcagacccctttattaatccaaacatcatttttatctatggcctgtacgccacattagtcaatttcatgtttgatgtaaagaaatcaacattttttgtgtaaattaactctgggcttaactctgtaaattgctttgagcttcaaaactaacaaacgtatattggtgcacttttaatttcatagcgctcaaaaccatataataataaatgcaacttttgcggatcagctttgagattaaatttttgcttttgttgcagattttattgca

SEQ ID NO: 612448 - DNA, 102 bp, Homo sapiens
gttgcactcccagatttgtgggcaggctctgggtgattttcatccacatgcgggtgtgtcacataggcctcctcggttcaagtcacaccaacatgcctcgtg

SEQ ID NO: 612449 - DNA, 345 bp, Homo sapiens
aactgttcgtctctggagcgagatgagtataagattaaggttggaattacaagcttcggcgctgtcttttcacattgcttgggcacttagattatattcgcacccacgttttttccatcaatgaaatattcctgggattctgagtggctcccgatgatcagaccatccgagtgtggaattggcaatctagaacctgtgtttgtgtgttaacagggcacaaccatttattgttgatggtgtagctccaggtttccaacccccaacagaaagacttgtgtagtatcaggccagcctggtaccacgactgtgcgcggtttgggatatttctgggtctgaggaaaaaaa

SEQ ID NO: 612450 - DNA, 176 bp, Homo sapiens
tctcatgtgaactcccttcgtttcatgtcagctatttatatgtggactgggctgtgtttagggaaagtagtggccgtctgaaaacaacacagtcgtttagtgtgtcatggaaataggatgtggacctcagaaagaagagagtcttgattttgtcatcacatatcttggaatagctg

SEQ ID NO: 612451 - DNA, 1323 bp, Homo sapiens
  misc_feature (497)..(497): n is a, c, g, or t
agattttgtgtcccccaccacattttgtgtaaaaggaccaccaccttgtgggccacggcgcaccctgcgtacacatcatattatcgtttctttctgtggtcgacaatatattttcaaagcgcggcccacacaagatttcgttgggtaaaatgaagtgattagaaaagtgttgtgtggtgtgttcaccccccgtcgtgaagaaaaacacgtttgctcaacaacagataggggggcgcttctaacacatttcatataataagactccttgtcccatcgtcccgctcttttaaatatcgtgtcggccaacagctattcttcccccccccaccacgaggttgtttcctcaacgagcgaagtcactgtgtgtgagatgaatctctcttctctcattccacacccccgtcgtgtattggacaaccaccaggtgtgctcatcaagcgagttacacacctcatcctcctcggggcggtgaatcaacacaactacgtgtgaggtcncgacacaacacacaccactcctcgttggcgggcttcttcattatgattagtggggagtaagagtgtagtcgccatctcccaacatcgaagagagggctaacaccgccccccctcgcgtgtgtggtgtaaaacaacatcatgggttgtataattaaataataccgcgcgcgtcgtgtgtgtagagaggaagacacctctccagctcgttcgtctaccacattaaacacattttgtcttccgcgtctcatcttttttattacacccaccgcacactattagtagagaggagcggcgggctccacagaagtgatagtgacttatatattggtatagagaccacaacctgttcctcgcgggtgcacatactgtgataaaacctcctctgtgtgaggagaacccctcgtcctctgtttccccaagaaacacacgaggggagagccaacaaagacactctttcactattgttgtgtggagaaaaacacgaatgatttctcattcttctccctctgatatgaagcaaaacctcgctgtgaacttgtgctgctgtataccacagaagagttctcttgaaccacctctggctgcactggaatgcgtttgcccccgtgctgcttcaaggaataatagatggggggccctctcagagtgcccgcggccccatgcttcaatgacctcttctctgggcctctcccccggagtaactgggacctctccccctctaatgtgccacggggaacaatagagaggttgtgggggaattttaacgggaagcaaagattttccctctccttttccagggccccaaaaaatttttaaaagaagccca

SEQ ID NO: 612452 - DNA, 216 bp, Homo sapiens
tcacttctctcaggccagtctgttctcatgtaagctaattccttctatgctcagctccttggaatccagagggtttgtcatggtagctgttatcaaggagaagggcgtgcgaagatgtggagaacacccgtgatctcttccctaacgaggtgtaccggccgatgcccccttcgtctacacagattcatacgctcccttatgctgtcagtaaaggtg

SEQ ID NO: 612453 - DNA, 1033 bp, Homo sapiens
  misc_feature (723)..(723): n is a, c, g, or t
agcggaagaatttaatggactgtgaatttcaaaaaaaaaaaaaaagactgtcaaatgaacttttacagaatgctttaaaaaaaaaaaaacccctgtgtcggccaaaacaattggctactttatcatttttgggtattaaaagggaaataagtcttttccttttttggggtaaatttttggaaaaattattggctaaaagttgcattttagggagatggggagacaatttagcagaagggagaaagtaagtctttttttttcccaaatttatttaattggtcccgtgggtctctattgtatccctctatagccgtgtccattttggggacacttttcccgggttcccaaacccagtatttattccgggggtcctattaataagagttggatatataatctctgggacttctttagaaacccgtggtgtttctctattaacaattttttgtgtttcctgccaagaaatttaaaaccgtgagttcccctgtgaaaaattccctatgaggaagagaaccttagaactcttttaaaaggggcgcatctctccagaagtagtgcaagtggaaaacgcgccacttaccaggtggggcgtgcaccccaaaattttttcagaggcgtgaaagagttgcgaaagcctcactctctaattgtgagaaggacaagcggcgggaggaaacccccactattttacacatttatatttttcccccctataacctggtngcctccttcccccccaaataaggaaaaccccgttggaacacaaccccttaacctttcttcaacacacacttcttttctatgagcaaaggggtcaagacagttgcacctcgtggtgggggacatttataattgagggcacggcccaaaggggaatttggttgtccccaggaaaacaaactgtgccgtgaaagggtttttgggaacattacaaacgtgttgaacatcttggtgtgacaacttcgtgcaatgtggggctccccggcttataagttccttggaaatgttgtccttttgaaaaaactccctaata

SEQ ID NO: 612454 - DNA, 1357 bp, Homo sapiens
gtgagccgtgcgacgcgctgtgcactggcccagtgcgcgcctccgacccgccgtgtgctcggagctggtgcgcgagccgtggttgcggcatgctgcactgacagtagcgcactgagacagacggagccagccgtagcggcatctacatccagacgcagctgctaggctccggcccttcgcttgccagccgatcgcccgatcgacggcgcgaccgctgccaggctgctagctggaccggccagcaggcgctcatgcgtcacacgcctagttgcctgatcagccgacatgtcgcgccataccctgctgccagcagccgcccaggctccaggcaaatgcctagctgagtcgagaggacagaccgacagcggcccggcacgtgtggagaggacccagtcccggtctcccagcaaccgacacccgggatgtcttgactcccagagtatccaagacccccttccatctcaacagcattactcatcatccaaggaaagggtgccttgcctaaccagacagaccagacggctaacaacacgtctgactaacggcagtctccacgagccacacgattacccccagacaacttcctatccctccgaagctccaaagcgcagaagaccacgcacactatggtcccctggcccgccagaggacactggcagaccagcactgcaatccacctgcccgcttacactacacaatgacactcgcagtccccacggcagatagtcacaccatccacccccaactgcaccaacagcacagggggcactcccactaagaaacacaccaacatcgttcgccccctatacccaaaggcgccagcgacacagcgacgcgagcttccacgctagctgcgactgcaatcaggctctggggaagagccccacctcgccaggcatacctcccaacccacggcgcgcccaacgcacgcacactaaccctgcacatcaccacgatcacaacccacgactataaacgacactatcctgccacggacacacgcctcacgcctaaccatttccttaactaagcccaacaccacgccccggaacactccacaacaacacctgccacagccccacccaccatcccaggccggcgcgacacgacccccccacccaccccgactctcaaccacgacccccacaacaccctcgcctctctccccgcacctcacaaccctccacaacacccgacaacacacacgaacaatcccacacccacccccacccccccactacagacatcccaacatccgctaccacatcccaccacacaacaccaacacgccatacaccatccccccacacaagaaacaacccacccaccacaccctctaccaccacactacacaaaa

SEQ ID NO: 612455 - DNA, 660 bp, Homo sapiens
aggcagtaacgactaggcctcctctgcccagtatttaacaatctaagttacgccctgtactgactcacgctagactcatatctgctctcacaccatcattctgttatctgccatgacgtgtcctgctactcaggattgctcacaatgaactggtactgacttgtaacaggactaggaggaccttagggtcactaggatcgaacacctgtagctgtaagataacgatctgaaggagatcaggctcttggacaaggcacttataccagacttgagagactaactgtgtaagctccacatcaggaccaagctgactgtacttgaccgagacatatggcatgaccaattcctagatagagcctgccaggacgactcgaacgtgatctacaccggctgaatcattcatgactcaggaggaactcacaaacagttcatcatgaatgtcaatgttagaggcacccacttactagatgaggcctgctgacaaaccagagcgccaatatacatctacaccggtgcccttcgagtacaagggcacaattcaaacaggcatgcttccacaacgccaaccatagagagcttctggacaacacagagccaactccttgaccaacctatcaagagcctgctgtgaaacagcgcatgcggatactggattgcata

SEQ ID NO: 612456 - DNA, 314 bp, Homo sapiens
cccctccccgggtacctgaagcgaattgccaccaaagctgtggctgaattgccgcagttctagcttaaccttggggaggttccccttggacaaaagcgcactaaaccgcctccaggttcgaagcattcagcaaacaatggcaaggcagatccaccaaaaacgtacacctgattttcatgacaaatacggcaatgctgtattagctagtggagccactttctgtattgttacatggacatatagagcaacacaagccggaatagaacgaaacctgtcccttgttgtcagagtaacccggggaggggggggtactg

SEQ ID NO: 612457 - DNA, 887 bp, Homo sapiens
ggggcacatagccaggcggacaacagtcttcacggccactgaacggaaccgtgattcgactacgtcaagctccgccgctcgcgtatcgaccgacgctcccggcaccttccgcggccagaggtgtgttttataggcagaagcaatgttgtgaaaatcatctctagatcaaggcttttaatttatcacatggtcgccctgtaggttgaagtcagagtctccaaagaaaaccaggactacacaggagaaacatgaatttcttgcaaagttggaaacacgatttgacagtggtggacatgccaggcttatggctttagagcacctgagagattctctgttgacattggtcccagacctaatctaacacagaacgaaggaacttgagagagacacagttttgtatcaggtggcatagcgtctgttggaattcaaacacagacagtagcagatattgccatagaacatgtgtgaagcataatttgcattaccgtgtatgtgatgtgtcattaacaaaagacaatggagcagaagtcttccagagggagcatcgtttgagaaaacagagtgcttcagcatccagcaaatttgttcaacagtgcaaaactcagaggcatgttttcctcagttgttttcctgtaagtgctgtgaccttttctggaatccacctgtttgagatgctttactagccagtgtaacaggaaatcttgaactaaatggttcccggttttagctgaagattcaaaaaggccaaaaaatatgctcggaggcatcttctccggtgcgcaccaaagggtccgaaccggcccttggccatgttgtcccggaccattccttgaccagtggaaaacgccggccccaaggaggggataatcgcacaccgtatctcgcca

SEQ ID NO: 612458 - DNA, 188 bp, Homo sapiens
actagagacaggatttcaccatgttgcccagagtggtctcgaactcatgagatcaggcgatccgcgtgcattggcctcacacaatgataggattataggcgtgagccaccacggccagtcaaattctattttggtaaaagacaactcaacccagaaatgcacagtggggtcccttctgtcgtcttctc

SEQ ID NO: 612459 - DNA, 116 bp, Homo sapiens
attccaagatctgcatggagactaggttcctctccgatactcactgtacccatccgattccggcttgcgtgcatcatctgtatgggcacgagcttggtggtacttaagatccattg

SEQ ID NO: 612460 - DNA, 158 bp, Homo sapiens
tgccaaagcgtagtacccaaaaaaataaaaaaaaaagaaactgaagctaagagaagtgaaacaaccctcagagttatgccttcgtgtgggctgctcgttgtggttttggaactgtgggggaactgtctgtgtttggggtactacgcttgggcaggggt

SEQ ID NO: 612461 - DNA, 426 bp, Homo sapiens
tagcgacaccgtacgtgcaggagatgtcactcgaagatgagctgcaggcactcctcaaatgcctgcgacacaaggggacctctaaaccccaaactgcggcaggcgaaggattaccatccgtgttgcaacaactgagacaaataggcggaatgatgagaatccgcacgggaagactgtcggtgttcaacgcatttgagcctgccgacactcgtgacatctttgacttccatcactgggctcagaccaacctttcgcccgttcaaggggcagttatttcaatccttgtaccgctgagggctcactgatggaacggttcttctcttggcgaaacctggaacactgtccctcgcacggcagcattgagaccttggtgctctgttacaaacgttgccaactgaccgaagggaatgtgtctgccgatgtgga

SEQ ID NO: 612462 - DNA, 165 bp, Homo sapiens
actcttcaagaagtgggatgggggcagtgcctggagctgtagggggcagccgtggtgtaacacctcgcgcttaataggcgtggttagagactgaagagggactcgccgcgcagcagccccagcctgtaccgctcgcgagtgtactcttccttgatcgaggcaatc

SEQ ID NO: 612463 - DNA, 147 bp, Homo sapiens
ccgtctagcggtgcccggtacttggggggaatcgcctccccggaggggttaggagggccagccccgccccgccccgcccctccccgaactgggtgggggccggggaggactggaaaccctgcccgttcgccaaggccggaaagttta

SEQ ID NO: 612464 - DNA, 315 bp, Homo sapiens
tcacagcttcctgatgtcgatgttacagttcatgatgctgttgtaggtggtctcgtgaatgaccgccgactccataccgattaaggagtggctggaagatgcgtctccaggcagtggaagcgctcgttgccgatggtgatgacctggccgtctggcagctcgtatttcttttccagggaggaggaggaggcggtcgtcgccatctcgttctcgaagtccagggccacgtagcacagtgttctccttgatgtcgcgcacgatctcgcgctcagctgtggtcacgaaggagtagctcacgctcagtgaggatcttca

SEQ ID NO: 612465 - DNA, 289 bp, Homo sapiens
gtacttagaggatcccaggccgcggctgaactgaaaacaaaaaaaaataaagtagctgggggtggtaacatgcacctgtggtcccagctattgggagggtgaggtaggaggacttattgagcctgggaggtggaggctgcagtgagctgagatggttccactgcactccaacctgggcaatggagcgagactctgtttcagaaaaagagagaggaagccaggcgtggtggctcacgcctgtaatcccagcactttgggaggccgaagcgggtggatcacctgaggtcag

SEQ ID NO: 612466 - DNA, 355 bp, Homo sapiens
accccctgtgctcattgcgtacattgaccaagacccttcaacctgcggatcaagatgtcccagctttctttccagcgaaggcccttgagttcatgtggcaaaagtcctgtgtccctgtaggtaatgtgggcacagcgtgttgaacacgtggcacgcgaagaagtccgaggccacccacagggcgctgaaaatgctcctctgaagctgggacgtgcacaggtggtcgtttatgtgctgcaggaccacagggaccaagaggatttgaaaggtgagtgcggcacagtatagtggtagagaaagagtgtcttctccctcagaaagcacgagatgtagttctctgcacagccctcgtgcc

SEQ ID NO: 612467 - DNA, 478 bp, Homo sapiens
  misc_feature (3)..(3): n is a, c, g, or t
  misc_feature (15)..(15): n is a, c, g, or t
  misc_feature (38)..(38): n is a, c, g, or t
  misc_feature (60)..(60): n is a, c, g, or t
  misc_feature (77)..(77): n is a, c, g, or t
  misc_feature (470)..(470): n is a, c, g, or t
ttnaaggttgtgaanggtgaacccccctaccccccaangtcacaaaactgggccatcctnagcccccaaggagtccncctgaggccataagatcacagagaaatttgccataagccttattaaatattaatgtgttccgatcccttgaaatgaccatagatgtggtgtttcctgaagtcattttgaaaatgggttttggcccacatggggtagctcatgccctgtaatcccagaacgtttggaggttgaggtgggatcacttgagctcaggagtttgagaccagcctgggcagcgtggtgaaactgtgtctctataaaaaatgcaaaaattagccaagtgtggtggtgtgcgcctgtactcccagctcccgggaggctgaggtgggaggatcgcttgagcctaggaggcagagattgcaatgagctgagatcacgcctctgcactccagcctgagtgacagagtgagaanatgtctcc

SEQ ID NO: 612468 - DNA, 168 bp, Homo sapiens
  misc_feature (90)..(90): n is a, c, g, or t
ccccccctttttttgggggtttaaaaggggggaaaaaagggttaaaactttcccttttgtgggggggcttgggggggaaatcccctgggntttttttaaccccttgaaaaactcccccccccccggttgggggttttcggaaaaaaaaaattggggttttttttttta

SEQ ID NO: 612469 - DNA, 183 bp, Homo sapiens
  misc_feature (14)..(14): n is a, c, g, or t
tgaggatccagcgncacagccagcggtggaagtcattctgatatggagttggcattggaagcttattcttttgttcacggcagcagagcagagaactgttcacagttcatctgtgtctcaattatctgcattttttacatagtgtctctgtggtcttatttagcccctcttaaacgggtaccg

SEQ ID NO: 612470 - DNA, 567 bp, Homo sapiens
ggccgggcgcggtggctcacgcctgtaatcccagctctcagggaggctaagaggcgggaggatagcttgagcccgggagttcgagacctgcctgggcaatatagcgagaccccgttctcctgaaaaaaaaaaaaaaaaaaaaaaaaaaaaaattgggggggcgcgccggggccccgaaaaagttttcaaaaccacatgcgggggggggcgcgggggccccagtgggtaagagggaacccgggggccaaagcgggtctcccagagagaaaaccggggccgagagaacaagggggcggggatttccccccatttaaaaagagcgcccggggggacaccgcgaagggtttcggagaacaactcccaagaggggagagccgagaggcgccaacaacgggggcgccatactcaccggggagccccaaggggagaggcccgagaattctaaaattaaggcccccggggcggggggggtgacgtatagggagaggagaagacagacaatcaaccagaacaagatccagggtgaacaacagaaaagaaacaaaaatagcaggaacacagaagacc

SEQ ID NO: 612471 - DNA, 239 bp, Homo sapiens
tgcgaggttataatagtatccgtagaggtacaacggcatgccgtactactcaacttagactccgagcacacaggaccctacgtactatctcgcaccctgaaacacgctaacatgagtaacacccttgatcccatccaccctcctctccctaggaggcctgcccccggataaacacggcttttggcccaaatgggccaattatcgaaaaatacacaaaaaccaatagccgtcatcatccc

SEQ ID NO: 612472 - DNA, 151 bp, Homo sapiens
cacaggatctccggaatgtgtggtgttatggatctctacgaacattactatcaacgtgcacccacgtgcacgagacactaactacgtgcaaacacgtggaaaccgctaatctatgtatgtgtacgtacgcatacgcacaacacacacaatt

SEQ ID NO: 612473 - DNA, 403 bp, Homo sapiens
taacatggccttgactgtcagacataatgtgagctcatcggcaaatacgccatggagactagtccacaggcttccatggagggaacaacagcaacaacactgcaagcaaggccatgtcggatgacgcagtgacagctgtctgctgcacactgcacgaaggtgttaccaagaacatggagaacgccaaggccttacgggatgccggaggcttcggagaagttggtcggcatctccaaaagcaaaggagataagcactctccaaaagtggtcaagggttgcatctcaggtcctcaacagcatgttgcactaccgagatctgaggagtctctacaaacaggatggatggtcactataccacttggtagcctcgtcttcaaccatcgagagggaccggctaaggccc

SEQ ID NO: 612474 - DNA, 392 bp, Homo sapiens
taaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaccaatcagggttgtgatgatagtgaatatcaacagagtgagtcatgggtgtcctcacggtagctcttagtgagaaagatccacgctttggctgttctccaaatagagcatcatcatttccagagggagagaaaatatgaaaggaaacagttagcagtgctgcccaggtatgtgcatgcacctcatattactagtggtcctctttgc

SEQ ID NO: 612475 - DNA, 143 bp, Homo sapiens
  misc_feature (80)..(80): n is a, c, g, or t
actgcagcccctgcttgtcactgcagccagctgcatgcagcagccttgcaaggccctcccagttttccaggcatcatgtngtcccagggtcccgcaagctggagccatcttctgcaggtgtccctgcagctctgcacattctg

SEQ ID NO: 612476 - DNA, 239 bp, Homo sapiens
ccacactcgaagatgataaaagcagtgtcattatttatacagagtgtacagctctcgcactaagctatacaagctggtgcacactgacaacactgctcgctcccacaagaactataaccacacatccccagacagtataaatatatggtcgaactaacatcaatacacatcaccaatttatcaattacatactacaacaactggccccgctatccaaatatgaagctacacagctcacg

SEQ ID NO: 612477 - DNA, 523 bp, Homo sapiens
  misc_feature (260)..(261): n is a, c, g, or t
  misc_feature (268)..(268): n is a, c, g, or t
  misc_feature (291)..(292): n is a, c, g, or t
  misc_feature (307)..(308): n is a, c, g, or t
  misc_feature (359)..(360): n is a, c, g, or t
  misc_feature (375)..(376): n is a, c, g, or t
  misc_feature (384)..(385): n is a, c, g, or t
  misc_feature (522)..(522): n is a, c, g, or t
atacttgaagatagcttagtgtaaacacagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttaagtcaggtaccaaatttgttcatttgnngtctcantatagcaattaatgcaggctatnntatcagacacagcanngcagggatgaaagccaacctgcagggtattaacctcagtttcctggtcccnncaaggttcttgactnncaatcaannctctaagttttccaaagggaagggaccaatagggttcttttttattaggcagcccagaatgggtaagtgaaggaccaattttattaatactttcatgaccccaataaaagggagcttttgactgacgggtaaaaaana

SEQ ID NO: 612478 - DNA, 1067 bp, Homo sapiens
gcacgagcacgccttcaccactaattagcagtcatgtggctgcgaacgcccaagccgtaccgctacaaaacaacaatcgcaatactagcaacggggataacggcagtaatgttaaccacgataataacaatggcagtaccaacacaccgcaattgagtcttaccccatatgcaaacaattcagcccccaatgggaaattcgattctgtgccggttgatgcatcctcgatcgaatttgaaactatgtcctgttgctttaaaggtggtagaacaacatcgtgggtcagagaggatggctcgttcaagtcaattgatagatccttactggacaggttcattgccgcatacttcaaacacaatcaccgtctatttcccatgattgataaaatagcattcctaaatgacgccgcgacaattaccgatttcgaaaggttatatgacaacaaaaactaccctgacagctttgttttcaaagtatacatgatcatggctattggttgtacaactttacagcgtgctggtatggtttctcaggacgaagagtgtctgagtgaacatttggcttttttggccatgaaaaaatttcgtagtgttataatttttcaagatatcgaaactgtacgatgcctattgttgttgggtatttattcgttttttgagccaaagggctcctcgtcatggacaattagtggtatcatcatgcgattgaccataggattaggtttaaatagagagttaaccgccaaaaaactcaagagcatgtctgctttagaagcagaggcaagatatagagtgttttggagtgcttactgctttgaaaggctagtatgcacctcgttgggtcgtatatccgggatcgacgacgaagacatcactgtgccactaccgagggcgttgtatgtggatgaaagagacgatttagagatgacgaagttgatgatatcattaaggaaaatgggcggtcgcatttataaacaagtccactctgtaagtgcagggcggcaaaagttaaccatcgaacaaaagcaggaaatcataagtggattacgcaaggagctagacgaaatt

SEQ ID NO: 612479 - DNA, 133 bp, Homo sapiens
cgggtctggcatcttgtacatggcaaatgctggacccaacacaaatggttcccagtttatcatcttgcactgccaagactgagtggttggatggcaatgcatgtggtgtatggcaaatgtgaaagcaaggcat

SEQ ID NO: 612480 - DNA, 632 bp, Homo sapiens
gtcgaaggtgaccggtggaccggagcatttcacgatctgctcgtgtacacctggtgcaccattcaccatgttggctgctgaggctggtgtgtctccgtgatcatctagccttctagggtttgccacccaggtttcatcaatggcctcccctgttgtgacgaattccatcacgaagaatcaatggctgtgaacacctagcagggaatatgccaccaaagcaagaatggggatccggcgtgggaagcaacttggccaggaatattcaaaggaggccaacatggggaaccattcgatggaacaaaatatttaaaaattgatcagaatgcggcaagcatggcttcggtagcatgagagggcgctgctgttgggatctttggccagcattgtgctaactatggctttggagacctgttctacatggagactttgcgacggctattggacaaacagggcttggaaatttgtgggcacttccagttaatggtccaaatggcattaaggaaacttacaattttccctacccctaaataattgatacctataggacacaggggacgatacttggagctttaacccacgcctcttatggtcttggccaattaggccacattcaacggcacgaaactgccttg

SEQ ID NO: 612481 - DNA, 255 bp, Homo sapiens
  misc_feature (198)..(198): n is a, c, g, or t
  misc_feature (234)..(234): n is a, c, g, or t
gctggacctctctcacactgggtgtgttctgtcatccaggctgagtgtagtggtgtgatcgtgctcactgcagcctctacctcccaggctcaagcactcctcccacctcaggctttagagtagatgggatgacaggcatgtgctgctaggcctggataattttttaatttttttgtagagacggagtttcactatgtntgcccggtgctgttttcaacactcctgtgcctcaangcggtccttctagcctcagcc

SEQ ID NO: 612482 - DNA, 161 bp, Homo sapiens
tgtgtactctactaactgtattatgtgaaatcgttctgccaccatctgcacgcaccactgcctacctgctgtacgtactgcatttgccccttgatccaggtggatgtttaccgtgtgttatataacttcctggctccttcactgctatgccattcttgctg

SEQ ID NO: 612483 - DNA, 669 bp, Homo sapiens
actacgaaatgcctattccaaggattcccaaatcagacccgcacatccacagtaggcggagggtgtttatgcctaattctaagacgcatctcaaaaaatagactgttcagctgcctaatgggaggaaaagagctagcacccggaagaacccagggattcttccaccgagttatatctacactaagcttctaccgcgactgctccgtctaccgcgagagcctgggtacccagaggcctacttttaagtagagggggcggcgtccacgttacgagcttcaacgtaacatccctacgaataaaaagcgacctcctaagagccgactacaaatccccccgttgtacatatccgagaatagttggaaaaagggggtgtagtaaccaccaaacgagcgtataagactataagatcgtcctcttcaccctactcataaaaactctaccctttagtagcagcggcctccaccgactactaagaggaatagggcaaaacatcttccgcgtaccccgcttcgttcctccgagttaccgagacctcctagaaaaggtagtcaggataagacccaggggggaactcgatctaagacgggttcgagggcgtccttaatgcctgaacaaagggcgcagaccgagcccatacctaagaccgacccctaccacaaaatgaccgta

SEQ ID NO: 612484 - DNA, 109 bp, Homo sapiens
gtacactccccctcataatccattccccattcatcaacgcaccagcacacaaaacattcaactcagagtctcaatcatccctcatcattctctctcttccgtgctcggt

SEQ ID NO: 612485 - DNA, 353 bp, Homo sapiens
  misc_feature (9)..(9): n is a, c, g, or t
  misc_feature (12)..(12): n is a, c, g, or t
  misc_feature (113)..(113): n is a, c, g, or t
  misc_feature (177)..(177): n is a, c, g, or t
  misc_feature (249)..(249): n is a, c, g, or t
ctcgtgccnagnaatcatagctcagtgcagcctcaaactcctgggctcaagccatccttccacgtcagcctcccaggtagctgggactacaggcacacaccacaacacctggntaattttttaaattttttgtagagatgaggtctcactgtgttgcccacggtgatctcgaactcntagcctcaagcgatcctcctgcttcggtctcccaaagtgttgggattacaggcatgagccaccactcctggncaggagtttatatgtatactgtggatactagatcctcatgtgatttgcaaaaactttatttatttatttatttatttttgaaatggatcttgctctttggcagg

SEQ ID NO: 612486 - DNA, 114 bp, Homo sapiens
ctagctaattttttgtattctggtagaaacggggtttacacccatgctggaccaggctggtctcaatcgcctcccagcacttaggataccgcaggggcagtgagccgagattca

SEQ ID NO: 612487 - DNA, 291 bp, Homo sapiens
ggcatcggcggtaataatattttagaaaaggttgggaatttaagaaatacctggggttactaattggaataccccatatcggggcaatggaaaaataaaaaccccaaggtggtttaactagccggggggtggtttttccggaataataaacccaaagaatagttgggttcttcaattcttaagagaatccccataaaagaagaaactattttttaaaaattcacttcaaaaaatccaatgggtaaaatcccagattttttctttaaataaaaataggtcattttaataact

SEQ ID NO: 612488 - DNA, 577 bp, Homo sapiens
cggtatgccacaagccgcgatgaacatgctgtgtaatggacagaaaataggcatctgttttccttgctgtctagaggtctgcatggtgaagagacttgtaagatttaatgtccttctgagatcgcagtaggaagtatgtcatgttcgcagtaggaagtgtgtcatgatcgcagtaggaagtgtgccatgatcgaattaggaaatgtgtcatgactgaagtaggaagtgtgtcatggtcgcagtaggaaatacgtcatgaggctgtatcatatccatctgagatcacagtaggaagtgtgtcatgatcatagtaggaagtatgtcatgatcacagtaggaagtgtgtcatgatcacagtaggaagtgtgtcatgatcgtagtaggaagtatgtcatgatcacagtaggaagtgtgtcatgatcgcagtaggaagtgtgtcatgagactatcatatccgtctgagatcgcagtaggaagtgtgcatgattgcagtaggaggtatgtcatcgcagtaggaagtatgtcatcgcagtaggaagtatgtcatgctcacagtaggaagtgttactgatcccac

SEQ ID NO: 612489 - DNA, 114 bp, Homo sapiens
acgataggcagtgatggcgcagttttggtaatagcacacgcgtgagtgccatgctgatagtaatgaagtatataccgatacggtcatttgtaccctagtacacagaaagaaata

SEQ ID NO: 612490 - DNA, 630 bp, Homo sapiens
gttccccatgatcccccccggacatctgccatatggattccagaaaggcaatagtaccctccatacttaaaatagtcttccccccacaataccttatttctgatctatacccattttccgaaggttattttctttatccttgctaaactgatgacttaccctgggatggggtcccagtccccatgacccttggggtaccaattgtaaacctagagttttatccactttggtgacaccagttttggccataatagtccatttctacttctggaagtcatctccattccccctgttggtattatataattccaggagaatatgataacaccctgccctcttgtggtgccttgaaagaagagatgagaaatgatgaaaaggttgccctgaaaaatgggagaccgcctcttacttgcccagaaaatgaagggattggaccgagctgggaaaccttccctttacccagatgctgactggccctggtggtttttgctctcgacagtatcccccatagctgacggctgggtgtttcagtttggaaatattttgttgccttcatcttcactgccattttgtgtaaatttttccaagatctgaattaaataaattaaattcatttctacagacccccca

SEQ ID NO: 612491 - DNA, 166 bp, Homo sapiens
tcaagtagcacatcccttagactccctagtctgtccaaggcatcattgagtttcctccttctattacaacgccaggagccagacttgctgccatatgctcaccagtaagtttaccctaggattatttggtttcacatttgtgtctgtgacccagagggatacaagc

SEQ ID NO: 612492 - DNA, 860 bp, Homo sapiens
  misc_feature (30)..(30): n is a, c, g, or t
  misc_feature (300)..(300): n is a, c, g, or t
tggggcatggagagagcgggggtaatcggncgaggatggcagcagggtactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgaccccatcctcaacttcctgcgcaccaaagagttggatcccaggggtgtncacggttccagcactcgctccatgaagcccagtatctatgggctcactcctctaggtatcgtcagaccatgcagcattcgagaggagtaggatcgatgcttcttgtggaaacgtcctcttcaagtggttacctgccgtcgaccagtagttcccagctgaaagcggcggaaccgagcacagcctagtaggggcctcaggcagctcaggagtgacggccagtcccctgtccgacggagcaagcacgatgaccccccaagcttggcaaatgcagggctgcttgggccgaatgctggatgagaaaatccctccctcaccctcaggacaacctgtaggagccggggatggtgcgcctggtgtgtggacagccataatcggatcgctgtggctatacccagtttctagtctgctacaggttgcaggaagcctctggctggcactggtgtattccaggtccccggctggacgtggcccatcgaacgactggcgctcacaggccgggttgcatggtggggccttgggtgaacctgaccagattgttggaccagcacaccgcgccgaaa

SEQ ID NO: 612493 - DNA, 377 bp, Homo sapiens
  misc_feature (2)..(2): n is a, c, g, or t
  misc_feature (17)..(17): n is a, c, g, or t
  misc_feature (90)..(90): n is a, c, g, or t
  misc_feature (119)..(119): n is a, c, g, or t
  misc_feature (192)..(192): n is a, c, g, or t
  misc_feature (261)..(261): n is a, c, g, or t
  misc_feature (273)..(273): n is a, c, g, or t
  misc_feature (322)..(322): n is a, c, g, or t
  misc_feature (346)..(346): n is a, c, g, or t
tntttaatacggactcncctatagggggaattttggccctcggagggccaagaattcgggcaccgagaactgggacgcaaccctaaacanaaatgaggggagggtactgggcttctgcntcaggggcttctgcacatgctctcttcccttgcactgaacactgccctcaccccctgcccacatcttcacggntcttaagttgttgctctaacgccaccctccctcgaggcccgcccctaaccactctacttaaaaacagcnccagactgggcntggtgctcatgcctgtaatcccagcactttgggagcccaggcgggcagntcacttgagattaggagttcgagnccagcctggccaacatgacaaaaccccatct

SEQ ID NO: 612494 - DNA, 783 bp, Homo sapiens
gctggcgtgtggctggctgtgttgtggccgatggcaggctggccgcaggtggccgagtgtggctggactgctgtagcatggtggaagggacgtggagggagcctgcagtgcgcagacccaccctgccatgaagccccccgcagcctgtgcaggatgacattggctgtgactgcatgcatctccgatgctctgtgtgtaaaacgacctgtcggtgggacctgagtgcccagcagatagaggagcgcaccagggagctcatcgagcatgaccagagcgcgtgtatgaccaggtaggcacccaggagttttgaggacgtgtcctacgagagcacgctcaaggcgctggccgatgtggaggtcacctacacagttcagcacggaatatccttgacttcccccagcatgtatccccctccaagggacatccggacagccagcacagaggccgacaagaagctctctgagttcgacgtggacgcatgagcatgagggaggacgtgtaccagaggatcgtgtggctccaggagaaagttcagaaggactcactgagggccgcagggctgcgcgagtacctggcagcggcctaatcaagctggagccggagacaatgggcttcaacctccccagagagactcaggacaacatcacaacgcatcaagaagaagctgagacttctgtgactcgacttcaacaagaacctgaacgaggaacgaccttctgacacttagccccaggagctaagagggctcccgacggactttctgaacatcccggaaaaattgca

SEQ ID NO: 612495 - DNA, 368 bp, Homo sapiens
cgaatctaaaagagcccccccccttcccgggtagggggcttgctattactttgaaagttttaacaggaaataaacgacatgtacccgtagggggagcaacagaaattgaatgagccaaacggatcacatcatatgcagagacatgtcctgtactggaacagaaggcactgaaaaagtttgtggaggcaatggaggctatcccccgggcactggaagaaaactttggagttaaggccaatgaagtaatctctaaactttatgcgggactttaagacggaattaaaacctttgtattggatattgagactgaagaccctgctgtaaagaacatactggaagctggcattctatatacacacccgaggagg

SEQ ID NO: 612496 - DNA, 784 bp, Homo sapiens
  misc_feature (250)..(250): n is a, c, g, or t
  misc_feature (441)..(441): n is a, c, g, or t
cagtttgcgcaaagtggagcggggaccctggctctgggcagcccctggcggtgcttccagtgccttccagccctcgctgtggctggtgcagccgcggcccatggagcccgctggcccggcccccggccgcctcgtggcctgctgctctgcctgctgctcgccgcgtcctgcgcctggtcaggagtggcgggtgaggaggagctgcaggtgattcagcctgacaagtccgtatcagttgcagctggaagcngcatctgcactgcactgtgactccctgatccctgtggggcccatccagtggttcagaggagctggaccagcccgggaattaatctacaatcaaaaagaaggccacttcccccgggtaacaactgtttcagagtccacaaagagagaaaacatggacttttccatcagcatcagtaacatcaccccagagangccggcacctactactgtgtgaagttccggaaagggagccctgacacggagtttaagtctggcagcaggcactgagctgtctgtgcgtgccaaagcctctgcccccgtggtatcgggccctgcggcgagggccagagcctcagcgacacagtgagctttcagcttgcgaggtcccgactggctttctacgacccagaaggacatcacccctgaaagtggttcggaaaattgcggaattgggcgtctccagaacttccatgaacaacgtggaaccccggtagggagaggcgccgtgtcgctaccgcagtcccagcagcacagccaagggtgtgtgatgagccgg

SEQ ID NO: 612497 - DNA, 301 bp, Homo sapiens
  misc_feature (83)..(83): n is a, c, g, or t
  misc_feature (106)..(106): n is a, c, g, or t
  misc_feature (115)..(115): n is a, c, g, or t
  misc_feature (179)..(180): n is a, c, g, or t
  misc_feature (216)..(216): n is a, c, g, or t
  misc_feature (256)..(256): n is a, c, g, or t
  misc_feature (266)..(266): n is a, c, g, or t
ttgtgcacagaagagtagaccacagagctgctccttctcctccggtctgctggggccccgagagagtctgcagcccttggcanggaccggctgacacaggagaacnaaagacctnaggctgggataacatggtggtgcagttcatcctctggagctccctgtgagatcagactggagcnngtctccagctgagaccacatctcacttagctccttncctgccatatcctgttttccttactcctatctcctgaganttcttcctgnatgacacacccggggtaccagctcgattcgtatct

SEQ ID NO: 612498 - DNA, 146 bp, Homo sapiens
actattaaagtatctgctcggcagaccctctgctcaactcatgcacacacaaaagacaatgagatgcagaatggtgggtgccaggcgctggaagggtggagggttcagagagtcagtgtttaatgggtacagagcttcttcatcct

SEQ ID NO: 612499 - DNA, 413 bp, Homo sapiens
gtctccctgagaccaggagatgttttccgaggtgtgctctccaggtggcacgagcagagtgacatatgggactggaccaggaagcttctatcctacaacaggcacagatgatgctctgaaggaccgcaagagtgatatcaccagcgagctgagtaccacaattattgattggcatccatgcgcattgtgcgcacggtgtatgggaaattttggatactaaattacctttcagaataggggttaaggaacattatcatctattattcagaatgactctgatacaagagaagcaggtgtgactacttatttgagtaccgagcctgaagatctgaaacctgactttagacagactaaagatcctttctgcacaagtgcatatctgttggaaaccagagaggtctgtcggactcctg

SEQ ID NO: 612500 - DNA, 183 bp, Homo sapiens
cggcatgcgctctgtagggtcggcagctctcgcggcagcggacggcgccccggtatctgccggcgcaccctcagggtcgcagtgggtgctgatcggacacaggctgtactccgcggtgctcatcaccttggagaactgactcctgcctgacgacaagctccgtttcacgccgtccatgtcgag

SEQ ID NO: 612501 - DNA, 203 bp, Homo sapiens
cccagtctcctctatccgcccactctcctcttaccgggttcaagtgatcttcccagctgggctttccaaagtgctgggattaaacgttgtgagccactgtgcctggccttgggattcttcatttttttattttgttaacagtctaatttccaggttcattattgtgaccgctgagcctttgggtaccccacgcacattccgta

SEQ ID NO: 612502 - DNA, 175 bp, Homo sapiens
cgttaaagccgagacacggtctgaaagctgggcctctgcaccacagttgtgaatgcaaaggaaaagttctgcaaggagattaaaaagtgctagtccagtgaacacagcaatgatgagaaagcaaaacagccttcttgctgacagaaagttttggtggtctgaatagaagatcaaa

SEQ ID NO: 612503 - DNA, 1477 bp, Homo sapiens
ggaccttcaacatgcccgtgccatgtactggtggccgtccatgggccgtgcgtgtccctctacgcctctgggccgcaccagtggcgattgtcatggactcatggagacgtgggtcacaccacatcggtgacccgagtctacagagggctactgccctccctccacagccgatccgtggcgctctggacgctgtcgtgcggccgtgggaccttgtaccgactttaccgtacgatgaacagcatccgtcgactggagccgaggcttcactaggcgtatcaccaaccaaacggccagagccgggcagacatcagttgcgcgacgatcagacggggaaggctgtgccgtagcgttcgccccgggcagcttcgaggccaggacgatgggccaccgagcgaattcctccgtgcttcctctggcaagacggagactatcgaggcatgagcccgaatgggccacaggttcgagtcgacccaatagggtccaccatggacgctggcgttcacctggtggttctcgggagcacgagcccgcataggttttcccgaaagcccccattttcccctttgccccttggcgggagtacttcgggaaaattccatatcgccgaggggtcaccttccacaccagaaggaaccaccttacacgttggtccaatccatgccccattaccattccgacaccgttagtttgaactcggctagggacacagaattgcggaagggcggagagaaggaaagcggcattgggttaaccggacacccgaaaggccgaaacagaggttaggcattggatacacgacgaggacgcgtggccgtaacccaacgcgccggagtgggcttaatttctcccggggggcgcccacattgtgggcgtttcggcaccacacggggcacttggcccaacggaaacacgggggcaaggcgaattccaaaacccgcggcccccccattgtggccgggcccctcataatgggacaaccccccaaatttgtgacacacgccaaatttcccaaacacgggacaattccaagtttcctgggcagaagcagccccacagcccaaaggaaacgcgcagggcacaacagggcttcaaccctttcccggacagcatatagcttcggagacactttcccagggaggcttggaggggcattcctcccaagatttccccgcttggggtcggatcccccttcccaagccagtttggatttccagcaagcacacctgtttttcccaccagagggcgcctggggcaagtggggtttgggagcgcaccttttttaaaccgaacaaaagcagtccaaacgcaggacaaagggtttaatccagagaaaccgggaacagggtctttccgggcgggcggcgcgccaccccgtttcaccccactagttttcgaggatgtccacagagacccccgggtcagcaacacaattgggagcttcttccttttaacaagaccgggcgagacccttttcaag

SEQ ID NO: 612504 - DNA, 365 bp, Homo sapiens
  misc_feature (350)..(350): n is a, c, g, or t
gactgtggccataacttttgcagttttagatgcaacagcaaaactaacattaatttttccttcttcttcacaatttcatgggtagatttgttcttaccgtagatcttagcaacctcagcatatgatgttttttcttttgagaactttcaccttttcccttaaagaaagcactttacagcttctctttgacatatctcaactgccatcatcactgctcttgaactttggggccattattaagtcaggaaaagggttacttggaaaacaaggcactgaggataccaccagagtccatctggataactaaggatgggtaacttacatggacttaacagggctgggtgacgttntacaggctggggata

SEQ ID NO: 612505 - DNA, 1467 bp, Homo sapiens
aaccccagacagctaaaacacacagtggtgaaaaatacaccgatcctttcaaactcggtcggctgagacttgaaacggtctgtactgaggacattagtaaaggaactgctctatatacaagcatcagactacttaaggacaagtgtctgagatactacctgtgtgactgggacaacgggacacaggccatttcgacccaacttacttgtggcgcctacactgagcccgacggcattcaaatatagcaatcactaagcaatagtacccgacactgatgcacagaccagccaaggcagacgaccaatagaccttacattgacaagataatgactcccacaacgtgcctacgtcatgagttccacagaaatgcaccgttaactaagaacagactgccacataagttctcatcccgaagccgacgccgacccaaccaccaccaagatcatacaatcaacgcaatacatgagaggctagactacaaagcacacgagcttgggaacacatatggactgacgcggactatatatacctaaccatatatcttgacatcgcacaccttcgtacttaggccgttccctggagtccacagacgaagattagggacaatacttaaccaagaacgcatgactattaattagtattcctaacattaatatatatccgcataaaggataaaatatatggaacacgcacttacggacatgccagatatgtgtataggcaacatcattcacttgccaagtacattccagagagcatcaacacaaaatcggacatcgtaatttgcaacagacacaatggaccaaaaagaaaatacagggaaaaacgacaagaagaaccctcaggaacgcaaaagaaacaaattgcaaacagcaataagaacacccggacctaagacaccaaggaacacacagacaaacaaaagagaaataggcataaaaccagacacacagaaaaaccatgagaaaaccacagcagcaatggaacacacaagtacacacaacagagaggaacagagcacagcgacaaaaacacggcgacgcataagacagagaaaacacgggcgacaagccaacaccctagcatcacggacacaaatacagcacgacaaggcacgaaccagaaaacaagacaaaagtcacaccgatacacatgagacaccactaacaccaactccacgcaacacgaactcccaagagatcccacagacaactagacgaacacacatacacaccaacagcaatcacgaactagaaatgaagagaaacgcacagaggaaacagaacacacaagaagcaccaaggcaaccacgagacagcgcaagcacgcaccaacaacatccaccagcaaaaagcatcactagcagaccaagaaccaacgagtcaaaacactagacatgaaaaaacatgaacacaaaatagacacaacacgacaacagcacaaccaagcaataaggaaagaaacgaa

SEQ ID NO: 612506 - DNA, 89 bp, Homo sapiens
ccccgtcagaacaatcagtttgtacttgtagttgggcttatctcgggtcaaggccttacatcagtttgatttttgatctatccctccac

SEQ ID NO: 612507 - DNA, 346 bp, Homo sapiens
atcgatctagaggaccccgtagtctttagttgtgatgttatgttgttaaattgagatctttctaactttttgatgtgggcatttagtgctacaaatttccctcttaacattgccttagctgtgtcccagaaattctggcatgttgtatctttgttctcattagtttcaaataacttcttgatttctgccctaaattcattatttaccccaaaatcattcagaagcaagttattcaatttccatgtgattgtatggtttgaagtgatttttttagtcttgtcttgtaatttgattgtgctgtggtctgagagattgtctttccttttttttttttgggaaaggaatt

SEQ ID NO: 612508 - DNA, 331 bp, Homo sapiens
tcccgggttcaagcaattctcctgcctcagcctccctagtagctgggattacagaagtgtgccaccatgcctggctaatttttttgtactattagtagagatggggtttcaccactgttggccagcctggtctcaaactcttgacctcaggtgatccacccacctcggcctcccaaagtgctgggattacaggtgtgagccactgcacccggactttttttttttggggaaaagtctcgctcaatggcccaggcggaagtgcagggttgcacttttgggctcacgtgaacctctgcttcccgcattccaagcaatcctggtgcctcagact

SEQ ID NO: 612509 - DNA, 206 bp, Homo sapiens
ggaacttggagcttagagacggttactgactgccctgcttcaggacacaggactactcacgtgctccactccactgccctgccccaagctcagtgatggcctccaggcagggggaaggctgctgctgggataagtacaagtgatggcttttaccttacatgctttatgtgggttacctcatctcatccttaaaacagtcctgggag

SEQ ID NO: 612510 - DNA, 268 bp, Homo sapiens
  misc_feature (12)..(12): n is a, c, g, or t
  misc_feature (91)..(91): n is a, c, g, or t
  misc_feature (120)..(120): n is a, c, g, or t
  misc_feature (132)..(132): n is a, c, g, or t
  misc_feature (176)..(176): n is a, c, g, or t
  misc_feature (223)..(223): n is a, c, g, or t
  misc_feature (256)..(256): n is a, c, g, or t
aaagggggaaanaaagccaaccggaaaagaaaatgattatcatgagacaaacaatgtgtcagcaccaaacaaacatgttaacccagaagancagtgtttttatttgtcagggccaggaangcccatgttggngggagttggtgcttcccccctcccagagaaaagatgggaaatgntgcaggtgtttagacacagttcgtgaggtgatggggcccagcgtctnccaaaggggaaatgttgcagcccagcgtagtcncatagtgccttt

SEQ ID NO: 612511 - DNA, 190 bp, Homo sapiens
tttaatcatctgtaaaatgattatgcaaaacaaacaaaaaaataaacatggtatctgtttgttaaactctgcaatgaacacatgtattagcttcccgctgcggcaacaaattatgaccacttggtggcttgaagtaacacaaatttggggagttttattttatttatttcattttatagagatgtcgacg

SEQ ID NO: 612512 - DNA, 292 bp, Homo sapiens
cactgcaatctccgcctcccggtgagaggtgaagccagctggacttcctgggtcgagtggggacttggagaacttttctgtctagctaaagatttgtaaatgcaccaatcagtgctgtgtctagctaaagtttgtaaacgtaccaatcagcgctctgtaaaaatgggccaatcagcactctgtaaaatggaccaatcagcactctgtaaaatggaccagtcagcaggatgtgggcggggtcaaataaaggaataaaaagctggtagccgagccggcagtggcaaaaaaaaaa

SEQ ID NO: 612513 - DNA, 212 bp, Homo sapiens
gtcaactagtcaaaaagattcagatatctgctgggcacagtggctcacgcctggattctcagcacttggggaggccgaggcaggtgggtcacctgaggtcaggagttgagaccagccttgccaacatggtgaaaccctgtgtctagcacaaatacagaaattagctgggtgtggtggtgcatgcctgtaatctgagctactggggggccagg

SEQ ID NO: 612514 - DNA, 170 bp, Homo sapiens
acgtgtacttgttagtgggacccaacatggagtggtattgcaacagtgtgacatctttggttcatctgtattatcttctcacatctcttttaggaatctatatagaaggcacagccctaccttgtctccctcagctgagactgcaagaatccctagctgaataatctcaa

SEQ ID NO: 612515 - DNA, 898 bp, Homo sapiens
tcggtatccgtgcggaccgttcgcctgggtacgcgcgcgaaggtttataccccccataagccgtgctcgccccccgagcctggcgcccgtgctcttgggcgtggaccgcgcccaaactctgcgttagcaccccttatccgagtttccctgcgccgttccggacaattgcccgcgcttttggccttttctgcgccgacaccccacaatggcggttatagcaccttttcagccgccgtcgcggctattgtgagcgctgggtgatatttctggcccgcccccctactcctttgggcctcggtgtgcgccgctcgcaattcccgttgccgacccttgttcaatacaagcgggggggttacgagctcccgttcccttgcgcgaccacaatcaatgggccgccccccacatggttgcctggaccttccgggttctcccgttttccgcggggttattttctcacgtcgccgacaaacggttcgccgccccgtatttgtgcttgtaccccggcgggccttgcggaaactctctcttgagccgtgtgcccacaaccggagagttgtgtcctcccccggttggagcggcccccccttccggtttattgattgccatccccagggcggctttgccctctctgcgcgtgggcccgccccccttatggcgctttacgaccgaagcccaattctcgcggaccgtgttgtacgcgcaccccctttctgcccgcgtacaccggccccggggtaatactccccggtcccaatcgtctctgtaatcctgtggacgcccaacccccacgtgttctatgcccccctgttccctaaggagttattcccccgtaaaattttttaataggggcccctttttcccctttgccccccctttcccccttttgggcccaaaaaaa

SEQ ID NO: 612516 - DNA, 254 bp, Homo sapiens
cgaactgagctcttacccctaattgcttcttcgatgacgaagtatggtacccatgtaagaaactgtaatataatttaagagatttgactactatataaaaatattttaaaaaatgcattagcagacaaaactcagagacggaaagtagaatagtggttgctatggtaggggtaggggaaaaagaggcgttagtctttaatgcgtacagagcgtcatcgaagaaccaattagggagtaccgagctggaattgtat

SEQ ID NO: 612517 - DNA, 844 bp, Homo sapiens
agcggggacaggcatggaggagccaaacttacaagggactctccagggagggcagtgaaaatacctcacccctgcatgcacacacacaggctctctcgctctctctctgtcacacacacacacacacacacacacacacacacacacagacaagatgctccacaatataccagagcgaggcctgtggagacagagtagagaggaagagggtggtggggtggtggtatgggggatgtgtgtgtgtgaagtgggtatgtgtgagtgacacgagagaagtgcgtcgtcagtgggttacgtgtcgtgggctttcctcgtgtgtccagcgctcacgcgggagggagggcctccgagtgtcatagagccgtttggccctgtaatgtctcatgagtggagtgtgtgtgtgtcatctttctctttgagggtcctggaggtgggtcctagaggacagagggtgagaagaagaggggcgtgcaattagggggcagggaaagaggaggcgggatgacacatatcacttagaggggagtggacccatgtgatagtgggaaccactcccagggagctaagggattcttctacagcaccttccattgtgcaacagggagctggaacgtggggcagaaagctctgtcagagagatctggagatgcagggaggtgactctgaacagatagaccctgaccccaatataattcaacgtggtgtgtggacaggtggaggggagatatcttacgtgatgacaagagtctcgaagcggggcaaactcagagggggtgagggtttcccgtatgaacaaaaaaaaaaagagaaaagaggtagtgagttcattaatagagaaaacacg

SEQ ID NO: 612518 - DNA, 868 bp, Homo sapiens
gggcgcggtggctcacgcttgtaatcccagcactttgggaggccgaggcgggcggatcacgaggtcatgagatcgagaccatcctggctaacacggtgaaaccccgtctctactaaaaatacaaaaaaattagccgggcgtgatggcgggcgcctgtagtcccagctactcaggaggctgaggcaggagaatggcgtgaacccgggaggcggagcttgcagtgagccgagattgcgccactgcacttccacctgggccacagagcgagactccgtcgcaaaaaaaaaaaaaaaaaaaaaaaaaaatttttggggggcctgggcctgaaaaaggtttttaaaaaccaactctcggtgggggggcgggccaagttggggtacggcgacacacgcgccaaaggcggtcccaaagagagaccgggccatgaaataggcggtgggcgtttctcacaattaaaaaacgccgggggggacaccgaggcgctttgaacaactccaaagggcgtctggacggccgtcacggggcgcctctcacggggagtccaggggagccgatataaatacacgcccgcgtgtgaaaaaaagagacggcaaggagcaagaaaagaagcaggagtaagaaagaagaggacaaagacggcgaaagagagagagacgagagaggaaagaagacaggaagagggagggaggcaggaaaacaggagacaaagaaaaagacagaaagagcgagacgaaagagaagaacagaagagagaaagcacagaagagagaagcaacgaatcgtaacaaagacccaaacgacaaagcagaaaaaaagaagaaggagaacaggaagagagagcagagaacgaggacaccaagaagatgaa

SEQ ID NO: 612519 - DNA, 176 bp, Homo sapiens
taataaaggtaaaccaatcgagtggctgggtaaagtcgtccaaagtttttgaggtctaagagtcccagattaaagtttacatactggctgtgtggcctctgggaagatcctttaatctctttggactggtttcctcgtaatatttacatagggttattgtgaagagtaagatagcc

SEQ ID NO: 612520 - DNA, 709 bp, Homo sapiens
  misc_feature (173)..(173): n is a, c, g, or t
  misc_feature (177)..(177): n is a, c, g, or t
  misc_feature (185)..(185): n is a, c, g, or t
  misc_feature (194)..(194): n is a, c, g, or t
  misc_feature (241)..(241): n is a, c, g, or t
  misc_feature (262)..(262): n is a, c, g, or t
  misc_feature (284)..(284): n is a, c, g, or t
  misc_feature (290)..(291): n is a, c, g, or t
  misc_feature (296)..(296): n is a, c, g, or t
  misc_feature (302)..(302): n is a, c, g, or t
  misc_feature (309)..(311): n is a, c, g, or t
tctcacggagcaggcttctgtggtggggggtccctgtgcagtacttgctcggggctgtggccggggaagatggagcagtataagctggtcgggcccagaagggaggagggctggggactccttaaaacctactgagggcctgggcaccgtggctcacacctgtaatcccagcncttngggaggcngaggcgggnggatcacatgagcccaggagttcgagaccatgcctggccaacatggngaaaccccgtctctactaaanataaaaaaattagccgggcgtngtgggnncctgnagtccnagctacnnnggaggctgaagcagcagaatggcgtgaacccgggaggcggagcttgcagtgagccgagattgtgccactgcactccagcctgggcgacagagcgagactctgtctcaaaaaaaaaaaaaaaaagagaagggaaagaaatggccgggtgctatactttgcggtttcccagaataaagcagttttactaaaataaaaaaacaatgcgggagagaggaccctactctgttttttccccatttattttccaagtgtggtgggagcgacggttactacttttgggacaccgttgtaagggagctctctcggcgatattggagttgcgcgtttggggaagcctctggggttgaactcactaagtggccagaattggaggtctttccgaaatttcaactcgttga

SEQ ID NO: 612521 - DNA, 868 bp, Homo sapiens
  misc_feature (648)..(648): n is a, c, g, or t
tctcacggagcaggcttctgtggtggggggtccctgtgcagtacttgctcggggctgtggccggggaagatggagcagtataagctggtcgggcccagaagggaggagggctggggactccttaaaacctactgagggcctgggcaccgtggctcacacctgtaatctgcagtcgactcggagagtcggaccgcgagatcgtgggtaattgctgcatggtcgctgcagactgtcaagcaattggtctggacggtggccgggaagcgcaggcccggtcgggtgaggggtccgcgaggtgtgaataaaacaactgagtgtgaatgaaaagtagagattctgtgaaggctgatgtctccagtgacgcttcgagagaatgaagtagcaacacatcacttatgaagcctttctttgacctgacagatttctatcacttctggagagttcctgtgaagaactcggatcctgaaaagccatctgatgtcactttctgcgaagcctggacttcagtgtaaggtcggtccttgatgatatccttgctgggaaggacataaaacgaagaaagaaatgcaacagggcctgaattttaaacttcactggaggttttactatgatcctgcctgatgtgccagacattattattggagatantaaaactcagtaccacatggggtatttcagggattctcctgatgaatttcctgtatatgttggtataaatgaagcatagaaaaaggcgtatattgttcctaatgggataatgtattgtgcagggcagattattttgacgaaaaagttatagaaataggataaaaggaaatcagctcttgaagaaacattgattgaaaatcaaggagcggcagagaattgg

SEQ ID NO: 612522 - DNA, 648 bp, Homo sapiens
  misc_feature (173)..(173): n is a, c, g, or t
  misc_feature (177)..(177): n is a, c, g, or t
  misc_feature (185)..(185): n is a, c, g, or t
  misc_feature (194)..(194): n is a, c, g, or t
  misc_feature (241)..(241): n is a, c, g, or t
  misc_feature (262)..(262): n is a, c, g, or t
tctcacggagcaggcttctgtggtggggggtccctgtgcagtacttgctcggggctgtggccggggaagatggagcagtataagctggtcgggcccagaagggaggagggctggggactccttaaaacctactgagggcctgggcaccgtggctcacacctgtaatcccagcncttngggaggcngaggcgggnggatcacatgagcccaggagttcgagaccatgcctggccaacatggngaaaccccgtctctactaaanataaaaaaaaaaaaaaaaaaaaaaaacattgtgggtgggcggcctcgggccccggaaaggttttaaaaacccactgggttggggggccggggggcccaaggggtaaggggggaccgttgggccccacagcgtgtcccaaaggaaaaccgggggtcagacacaacgtggggggggttcgtccacccaagtaaaaaacggccggggggggaccccggagcgggttgttggaacacctccacaagggggggtccgggaggggccgaagccgggtcctacaaacaggaggtccaacgagagtccgattacaaattacgccggcgcgggtgaaagagacagaagcgcgccacacgacccggcaacacgcaaccaccagcgacgacgacggc

SEQ ID NO: 612523 - DNA, 473 bp, Homo sapiens
ctctagtgagccaggagtattccagaaggaaaaatctggacatgtcaaacatcggaaggaacaaactccagacacactatctttaagaactgtaacactacaacgtgagggtcccgcggattcattcttggaagtcagtgaagacaagaaaccaccaatttcgggaacacctggaattctttggaaggctgaagccagaggatcatttgaggccaggagtttgagaaattctatgtgatataaagcagatgcttaaaatttgcccacatctggcacttacttataaaatgtttttttcaagagactggaacttctagtgcataaatacagtttgggtttaaaaacccagaatcctgaaaaaactggctctacttaaaaaacgactgtattcggtagttgaacagtaatttaaagggctcttcagtgacgttagaaatcattaaatccaattctttccttttaaatgtaaggaa

SEQ ID NO: 612524 - DNA, 752 bp, Homo sapiens
gcgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccaggaggcagagtttgcagtgagccaagatcacaccactgcactccagcttggacgacagagcgagactctgtctcaaaaaataataggccaggcatggtggctcaaggtctgtaatcccagcactttgggaggccgaggtgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaatacatgaacacacatgctgctgagtccgcaggggggcagagcagaggacagcgtgctttagtgtac

SEQ ID NO: 612525 - DNA, 328 bp, Homo sapiens
  misc_feature (108)..(108): n is a, c, g, or t
gaaaacagccatcggagtaattatctaccattgctctgcattaaaaccatcaactaggaagttttcaccagaatcctcaggagatccagacattattattggagatantaaaactcagtaccacatggggtatttcagggattctcctgatgaatttcctgtatatgttggtataaatgaagcatagaaaaaggcgtatattgttcctaatgggataatgtattgtgcagggcagattattttgacgaaaaagttatagaaataggataaaaggaaatcagctcttgaagaaacattgattgaaaatcaaggagcggcagagaattgg

SEQ ID NO: 612526 - DNA, 109 bp, Homo sapiens
atgtttttatgtttcatgctaaaagacatattgggcttcacacgcttacagctgggaagaatgcatattttggcaaagaaggctcgagtaatctctgcacgttcacacg

SEQ ID NO: 612527 - DNA, 213 bp, Homo sapiens
tagatgacacagagtggcactatataacatagtagatgacataggactaacacccggcaatatatccagaactactatactccaggatttccatataaataaagcagagaacaaagcacaacgaaaataaaaggggagggggtaagacaaggaaaaagaataaaaaagaaagcaactactagtctaaataatagacaaaacaataactatgga

SEQ ID NO: 612528 - DNA, 313 bp, Homo sapiens
ttggactacgacgaacaacaaggtagtggcaatgagtcatgaagacagagtcgtctccctgtacggctgtcgtctgcttctctgcaaacccaggctctgaccttgcaacaggcctccagcacagctggccatgtggccttacagctgtcatcagcctggactttactcttgatagtgaggacccattagattcgagagatgttgtgaaaaattgtgctttgtctcttcatagcttgacattggcatgcattgtccaagtgtttacaaatctttgaccgtagagtgtagcaattaaaactgatatctgagccat

SEQ ID NO: 612529 - DNA, 134 bp, Homo sapiens
  misc_feature (57)..(57): n is a, c, g, or t
  misc_feature (91)..(91): n is a, c, g, or t
ctaaaaaagaatattaagtgtggacagccctatttcaaaggagcttaattgatctcncttgttttagttctgacccagggagatcaccccnctaattatttctgaacttggttaataaaagtttataagatttt

SEQ ID NO: 612530 - DNA, 475 bp, Homo sapiens
actctgcaagaagtagcccaccatgacaaagctgcctttgcttttatcgctttgcaaaacaaaggggacatgttgggaacaggccccccaatgtggccataaactggctccaaaactggccataaacaaaatctctgcagcactgtgacatgctcgtgatggccatgacgcccatgctggaagattgtcggtttaccagaatgagggcaagggacacctggcccacccagggtggaaaaccgtttaaggcgttcttaaaccacaaacaatagcatgagtgatctgtgccttaaggacatgctcctgctgcagataactagctagagcccgtccctttgtttcccataaggaatacttttagtaaatcttaccactggcttgctgtcaataaatatgtgggtaaatctctgttcaaggctctcagctctgaaggctgtgagacccctgatttcccacttcacatgctgtaaaaaaa

SEQ ID NO: 612531 - DNA, 106 bp, Homo sapiens
acggcagtttcgcgtcggtgaggagccggggttggggggagcggctcgtggaggctactgcagcactggggtgtcagttttttggtccgcccagaaccgtttcagt

SEQ ID NO: 612532 - DNA, 540 bp, Homo sapiens
ggacgcgtgggtcggacgcgtggtcgatccacgcgtgcgaccacgcgtccgcgtaagacggatgtctctttccttgctaacgcagcatggatcgtggtcccaagaagcctctgagccgctgtggcagttccacagctgcatgctgggataatgaccggtgtgtttgctcctcgtccatccaccggtccccataagttgagagaagtgtctacccctcatcattttacctgaggaagagacttttaagtagtgcccctgacgggagatgaagctcacagaagatttgcatgccagcgggtaaccagatacaaacttcgatggggcacgtggtcccgatgaggataataacgcctaccccttgcctggactccactggaatgatcattcaggaaagttgactaaagaacggggacgaaaaattttaccggacgaagaatctagtgacacaccaaatgggatcagttttgccacagcacatcgatatacacaccttgacggcagggcccaggttacaagttgtgcacagtgacgaacagatca

SEQ ID NO: 612533 - DNA, 749 bp, Homo sapiens
tttaagctcctgcaccatcacttctgcgtctcttcatcctgacattgaatttcttgttgcaggcggggaagatcttagactgtatacttatgattataatagtggagatgatttataatcctacaagggacacatttggtcctattcactgtgtgagatttagtcctgatggagaactctatgccagtggttcacaagatggaacattgagactatggcaaactgtggtatgaaatacgtatgggctttggaaatgtgcgcttcctgaagaagatagtggcgagctggctaagccaaagattggttttccagagacaacagaagaggagctagaagaaatcgcttcagagaattcacattgcatctttccttcaggtcctgatgttaaggcctgagcgttaatcatatgttgcagttagtataccgctgtctaaaacaagcgcgcttataatagcattagccttccagggttactgtctgcttaaggcggactcatccacgaatattgaggaaaatcacctcgcttctacgccggcacacccaattaactagctggcgcgtgagtgggtgtgctcaagagttatatgatcccacttggtttttttggtggccgcgttaatcccccccgttcttctcatgtcttcctccgcccgcgtttgttcttttattttttccttcttagcgttcatcctcgttatacccgcggaccactaccctcccatccctctgtttcccttccccccccgccc

SEQ ID NO: 612534 - DNA, 1414 bp, Homo sapiens
ggggggcggcgggggggtgcgcacgacaataggaagagaacaacgagcagcgatttggcggacccgtgtgttgctgtgtagtagtcgccggcgtgggtgctgttctgagtatagtaacccggggggtgttcgcaggggccggagcgcgctgccggaggatgagatggccgcgccgatcgagtgtgtgggttgatctcgtcgtcgagctgcggggggtgggcggtgggctaggggttgcgcttgtggggtcggtcgctgggaagtgctcgctgcgtcgtgtgggtgggtgcgtggtgtagtgggggtggcgtgtgtgctgtgcggtcggggtcggggggttgtgctgccgcgggtgtgcggtgttgtggggtgcgtggtgtgtggtgtgttgtggtggggggcctggcgggcgtggggtgggggctggcggggggtgtgtggttgggggtcggtgtgtgtcatctggttgggccggtgtgctccgtggtggtgcacggtcggtgccgggtgcgcgtgtgctgtggtcggtcgcggggggggtgcagggggtcggggccggcggcggtgtgcgcctggtggggtctggttgcgcgctcgtatgtgtgctggcgcgggtggggggggtgggcgggtgggggggtgtgtgcgggggtgcggtggggtgccgcgtgcggtgtgggctggtggggggggtttgctggggtcgtgtggggcgggggtggtgggtgtggtgtggggcgtgggtggcggcgtggtcttccggcggggtgggggcggtgcggacgcgctggggggggggtgggcgtggtcgggggcgtgtggttggtgttttgggggcgtgctgggctgtgcggtgggcggtgcgtgttgtttttctctcgggctcgcgcgcctctgggcttggtgtgtgtggtttgccgccgtttcgtgtggggtcgtgtgcttttggtgtggcgtggtgggtgtggtggcatgtgtcgcggagggggcgttggggggtgggcgtcgcgtgcgcttgccggcggggggggaggtagttgtggggctgggaggggcgggtggtggcctgtggcagcggttggtgggtgtgtgttgttgtgttggtgtttctggtggccctgttgcggctcacctccctctcctgttcccgcggcgtggtaggcgcacccctgatgggtctttttgatctcctccacccccgcccgcggcggcgtagcggcgtgcgatcacacttcctccgtgttcgtgttaggagctcggcgtgagtaagatccgttcacttatttgtgtgacggacgtagcaatacaaaaacaacaaagaaaagaacaagagaacaaacaaaatcaaatagataagagtaaacgaacaacataacataaaaaaacaattcaaataaaaataaagtatcaatca

SEQ ID NO: 612535 - DNA, 404 bp, Homo sapiens
tctgaatccctcccactggctggcttcgcagatcataagggatttagtatatcaaggtcgtgacttataaaacggatcacgtagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagt

SEQ ID NO: 612536 - DNA, 971 bp, Homo sapiens
  misc_feature (6)..(6): n is a, c, g, or t
  misc_feature (131)..(131): n is a, c, g, or t
  misc_feature (226)..(226): n is a, c, g, or t
  misc_feature (313)..(313): n is a, c, g, or t
  misc_feature (349)..(349): n is a, c, g, or t
  misc_feature (373)..(373): n is a, c, g, or t
  misc_feature (409)..(409): n is a, c, g, or t
  misc_feature (420)..(420): n is a, c, g, or t
  misc_feature (449)..(449): n is a, c, g, or t
  misc_feature (463)..(463): n is a, c, g, or t
  misc_feature (652)..(653): n is a, c, g, or t
  misc_feature (663)..(663): n is a, c, g, or t
  misc_feature (676)..(676): n is a, c, g, or t
  misc_feature (693)..(693): n is a, c, g, or t
  misc_feature (754)..(754): n is a, c, g, or t
  misc_feature (757)..(757): n is a, c, g, or t
  misc_feature (790)..(790): n is a, c, g, or t
  misc_feature (794)..(794): n is a, c, g, or t
  misc_feature (825)..(825): n is a, c, g, or t
  misc_feature (835)..(835): n is a, c, g, or t
  misc_feature (847)..(847): n is a, c, g, or t
  misc_feature (856)..(856): n is a, c, g, or t
  misc_feature (863)..(863): n is a, c, g, or t
  misc_feature (879)..(879): n is a, c, g, or t
  misc_feature (884)..(884): n is a, c, g, or t
  misc_feature (886)..(886): n is a, c, g, or t
  misc_feature (899)..(899): n is a, c, g, or t
  misc_feature (909)..(909): n is a, c, g, or t
  misc_feature (937)..(937): n is a, c, g, or t
tattgnggttttatttgtataatgtaaaaatatattttaaataagaataatcacatactttacaatgttacaaatatatatatgtatgaaagaattatgaaggcatttgatataaaatataaaaagtatgntattttaatatataaatgtttaaaagaaaatttagttataagaattataaaattattaataatttataaaacgttttcatttttcttaaaggctnacattctcatcctttgggcatgtacaaaaattatgtggctttacacagttttatttatatttaaaatatcacgttttgaatgttttnagcatagcatgtacagtataaaatgtttccataggnacacaaaagaaactgttactagtngcctgctgttagatggcttctaattcattagttagncatttttaggncactagtttagcttattgctacaatcttnaagttgttctagtnacccaaattataatgaattcaatgtataccagaatttaccaataaaggctcaaagagttatataatatacaccaatatacacaaaacagctattctgagtaaaatgaatattccatacttaaataagaaccaagaatagtaattttaggctactctattatccttgtgattggtatttttaaaattttnngcaaagtgcncagtgaatgaaanagtcagcagacacgatncttctgtgtactctcaaattcctgccttagaatcacgtcacctgagaaatgagaaccttgnganctggtgcatatcaaatagcttcacatgtcaaanacanagggccgcttggaggcacattcatgggtcanaggaggtcanactgctccttcnaaaatggcnccattcnctgtacagggcccctntgtanangcagcagaaccancctccagganatcaatgctgtcttaatttagagcaaanatggcatccttcagccatattccagcgttggtgg

SEQ ID NO: 612537 - DNA, 406 bp, Homo sapiens
  misc_feature (325)..(325): n is a, c, g, or t
  misc_feature (368)..(368): n is a, c, g, or t
  misc_feature (393)..(393): n is a, c, g, or t
caagggtgtccttcgccagatcactgttaatgatttgcctgtgggacgctccgtggatgaggctctgcggctggtccgattaagaaaaccaagagaggccgggcacggtgactcacgcctgtaatcccagcactttgggaggccgaggtggcggatcatgaggtcaggagattgagaccatcctggctaacacagtgaaaccccgtctctactaaaaatacaaaaaaattagctgggcatggtggcacgcgattgtagtcccagctactagagaggctaaggcaggtgaatcgcttgaatccaggaggtgggggtttcaatgagnccgagatcgtaccactgcactccagcctggggcaacagagtangacttcgtaacccccaaccaacccnccaaccccccgcc

SEQ ID NO: 612538 - DNA, 129 bp, Homo sapiens
ttctctctcagatacatggcacagaggcaacagcgtgagagacacgatggctgaactcaccagatacttacatgagagtgatgtgcctcaggagtctcggacgagagaccagtccccgaaccagatacc

SEQ ID NO: 612539 - DNA, 147 bp, Homo sapiens
tgattctgaggatcaccctatctggagccggagcgaagattcgtgtgtgagactgggagcagagctacagcccggtggctgtgcagcagcgtctgtctgatgggacccaggaatctatcatcaccctgtccccagctcaaccagacg

SEQ ID NO: 612540 - DNA, 346 bp, Homo sapiens
acagaatataagaagtaggagtctccaggggagtgaggctcttgtggttagaagaggctatatcggccgggcgcggtggctcatgtgtgtcatcccagcattttgggaggccaaggcgggcggaccacaaggtcaggagatcgagaccatcccggccaacacggtgaaaccccgtctccactaaaaatacaaaaaaagtagctgggtgtggtggcaggtgcctgtagtcccagctgcttgggaggctgaggcaggagaatggggcgaacccgggaggcagagcctgcagtgagccaagatcgcgccactgcactccagcctgggtgacagagcgagactctgtctc

SEQ ID NO: 612541 - DNA, 101 bp, Homo sapiens
gaaggaggtgcatgaaggatgtttgcttggaggtcgcggatggacttgttgaggatggccacgtatgagtccaccaggttgcgaatggtctccacctgccg

SEQ ID NO: 612542 - DNA, 179 bp, Homo sapiens
  misc_feature (29)..(30): n is a, c, g, or t
  misc_feature (103)..(103): n is a, c, g, or t
acgagccacaaccagttttaggacttttnntttgtttttagtagagacggggtctcaccgtgtgatccacctcggcctcccaaagtgctgggattataggcgngacatcagcgcccagcctataacatttttatcacccccaaaatgaaatccttcacccattagcagtcattccccat

SEQ ID NO: 612543 - DNA, 2157 bp, Homo sapiens
ggagaagagagagagagaactagtctcgagattttttttgatatttatttttctcttctctctctctctcgggccgcggtcgtcgaggaccacgacgaccgaaagctagagaataggataacaacaaccagaggaaaagaggactatgacagactaagcatagaaaaaaaagagaacagaaaaaacgaaaggaacgattccccaccgcgcagaccagccagacgcggagccagcggcgcgggacggacgacgaccccaccgagcagcgacggacaaaggacacggacacggcaggagaaccgtgccgggcgacgcccgaccgcgacacgcgagacgacgagggagagaaagaagacagcagaaccacgtgcatacggacacacgccgcaccgcgccagcccgagaaacgtgaacagaggagagcagagcactccggacgggggcgcgcactccctgacagggaacaggacgccgcaccggacacgccgccaagcaggctgcgccagaagcgacaagcgagagaagacgacacaagcagagcacacccgccaccagacgcgacaccggacacagcagccagcgccgcaggagagagaaagcacgcagcgccccgcacgcgcgagacgacaagaacgacggagcgcagacagaaagaaccaagagtcgaagaccaagggactagcagcgcgacagcagacgagcacgcacgatcaagcggagaagactgccacgagccaacacaaacgagagcggcagccgccgcggacggcggcgcagggacacgccagacgccggcggcagcgcagccgaagagacgagcgagaacgacagccaccacgacgtaggagcggtacgcgagcaacgaggtcaggcgctagcgagagcgagaaccagcagagaagacacgagagcaagcaccgaagagcaggcagacagtagagcgcgagacgaacacagaagccacggaagagggagccgacagacaccgacgacggagcagcacccacacgagtcagacggcgacgcacgaccaagcgaacaacacagcgagcgagtgcacaacggagctcggagcggatcgccacccacagcataccgacgaggacgacacaagagacacccacaccagcctgtgcagccagaccctaacacacaccggcaccgcgacgactgcaagccagacagaccacacgacagacagcgagggccacgacaaaccagcgcgcgacccgacaggacgcgcctgcgagagcgccaccggcccacaccgacctccacgacgaacacggcaccaccgacaaacaagagggagcacgacgacgatacaacacgcacaaaagcacgaacggtctgcactcgagatgacccagcgacacgagctgtagtgcgctgaggacggccgcacggcctgccggtagagcaccgctctactgacaacgcgagacaggatcaagccagactacaaacgagacttacaaccgtgactcacgcagactccacaagagcacaacctagaacgagagaccgcagaacggaatacgactagataagagtggatatagcaggcaagagagctggcgcacgtctagtgacctactctggacgctacgcacgagcccacggcggcatgtcaggctcactacagaaccatatatcacataataccagctatctatataccatctaagataataatcaaacagactacataatagacaaacacaacaataccaacacaaccaaccatcacatcacatgattcccatcatacatctcacacagacgagtatgcatcactaacactcagaagaaatctacacacagtccccacaacctataccattctacacacttacgctgagggagcgcgatgcccgcggtcgcggctgtctgcagtgcgtatgactaggccagcgaagctcaaacgctcgagcacgccggagcagggcgcgcaggatcgcaccgagcgagcaaggcggtagcgacagccgaggaatgaatagaatgcagtgcgaagtccagcagcccgggcatcgtggaggtcgcgcggctgacgggcgagctgcgaggatgcggtgagtcgcgtgtgtagtgagcggaagaagcagtagcaaaagaagagggtcgccacgcgcaggcaggaggtagggaggcgcc

SEQ ID NO: 612544 - DNA, 450 bp, Homo sapiens
tccacgtttaagcgcatgccatggatcctttgagtaattcctgcggtgcatagagacaacctgtcgtgagcaaatcccgcgccgttcctggcacgtagcggatcagaaataacggttcggacatgccttcgcgcaaacgcaacggacaataaacagacgccggatagcttaagcggttcgatgaacaaggcaaattgattgatggcgggatgatggcgttgcatgtgcaacaagacatttccagcatcgcaggatgacgttacatctggaagcactctagatcgcggctttttggcacttagttttacgctggaagcctattggtcctacgaacccaagtgtctggaggctacgaatgaatacccgtggattgctcgatcagttgctcaagtctggccaggacatgttgcaaaacaaggccggcggccaacgcaaatccaatgacaaggg

SEQ ID NO: 612545 - DNA, 118 bp, Homo sapiens
cagttaagcatgagaggataaggatacttggctcagtcatcgttccacagctccacttgcatcttctcaccgaagccttccatggatgcacagggagcttctttctccttatcctgtt

SEQ ID NO: 612546 - DNA, 428 bp, Homo sapiens
ggcagggtatagggagatcacaagggttagtgcagtttcctgagactgctaacatggcctgtttcccctaggactgaagaaggtccctggaggggagggaatgggaagatacaggttctggaaatctcagtgaggctgaggagtgagttcctcccaagaacctggaaataagggtggctcctgagagttacaaaaaacccgtctagaacacatgtgggagtaaatccaaaatggctggtctgtaaatgtgtgactgagtgtttgggaaccaactaaagtctgtcaagggtggtggctgaggacgcctcggggaggttgggctggagggggaccctattgggtgaacagaaatcccaattgtattaagtaaactaataaaggtaaagcgtttactgtagtgtccatcactcagcaagcactaaaaaaaa

SEQ ID NO: 612547 - DNA, 236 bp, Homo sapiens
tttgtatttttcagtaagatggggtttgccatgttggccaggcaggtcttgagctcctggcctcaagtgatctgccctcctcggcctcccaaagtgctgggattacagacgtgagccgccatgcccagacacctatgtatgtcttgatgcttagtcacaatgttctgattagttgaggcggtctttttctttcaggaaaggtatgtttaacattccacactgaagatgtaattgtc

SEQ ID NO: 612548 - DNA, 460 bp, Homo sapiens
caattcaatgtccatcggcaccaaagggaagtcacatttcctcttgggagacagaaatccgcacctgaacacagagtaagttaggaaaaaatgacccctgtagtttattacaattggtgattcttagatctaggatttctaatatactatatccttcaggaaagttgctatccaacaaagcgttgataacatgattcagctctttccaattgaaattcagtgcccgtgaatcctcgaccaatgtctaacatgtacaatgtaaagccaatttctccagaccatgtcaaacacacatcgagcatcagatagagcatgtacatatacttgaagattctttgcaagcactcgaaacatgaaaattaaccccaattatttggacatcaagttccttagcacattccaagagatgcctacagttcttccgggtagtgccaaacttcatgttaccctcttcacctcc

SEQ ID NO: 612549 - DNA, 238 bp, Homo sapiens
ataggtgaatgagttgatctagaggatcccaacgacacgtgtgtatacataactgggcgtgctgactattagggcggaaaatcgttccttcaatgtgctttaacacttccagaagctgcagccaaaacagcccgtgctccgctgtgtagctctggcgagcgtggccagagtgctgactagcaatatggactctagtgtttgttcttgcttgcactgccctgcgattcacctgcgctcc

SEQ ID NO: 612550 - DNA, 326 bp, Homo sapiens
tctgtccctcgattctccctctgccctcttctcccttcctacttctctgctcccctttcactctgtgaatgtgagctttggccccattccataagccgagataaaaatgctaggcatgacaaatttgtgactgctactaacatttaggattgttctttgagatggagtttcactcatgttgcccaggctgagtgccatggcgcgatctcagctcactgcaacctctgccttccgggttcaagcaattctcctgccacagcctcgcaagtaactgggactacaggcgcatgccaacatgcccggctaatttcttttgtattttcagc

SEQ ID NO: 612551 - DNA, 997 bp, Homo sapiens
gcaaccttcaacaccaccttcttcgagcccgtcggaggaggagatcacattctataccaagaccatattctgattctcggtcaccctgcaagtaaatgtcttatcctacgcaggcttcggaactaatcttcccatatgtgtaacattactacctccggaaaaacaaagtaaccattatggattacatcggttatggatcatgaacgtaatgattatcatcattggctgtccgagcgggttgaatccggtgtgaagcacgacccatgatcatctgagcgagtaggaagtagacgtacacacacagaaaacaatatttgcaaacatacgtgtaccataatcaatcgctagtccccaagcgggcgtccaagagtattgaggctgactcgcacactagcatccactggaagcaatgatgaaatgctctgatggcagtgcatcgtgagccctaaggataacatcttgctttgtcaccgtgggctggccgtgatgtgggggatagtattaaacaaagctcatcagtagaacatcgtagttacacgacaccgtactacagtagtagctcaaatgcccactgatgtcgcttattcaatagggaagcggtactttggctatcactagagaggcgaacattcacgtgtagtatcccctatccgtcagggcgtagatcctaaaacaaactaacggccactagtccagtttggcctagtcatattcatcgggcagaaatctaagcttacttacacagcaaagaatttacgggctaattcggagagtgcccgacggtaattagaagaaccccgatagagtaaagccaaattgacatagtcgtattaggttgaaggctccatcatggtgttaaaagaaagtacactacatactccatagaggagaagaccactgaagcaacaaaccacattagagaaacccaaacatgatcgaatagggtcccaactacatagagacgcgtataatcacaggagtagaccccaaggtacgc

SEQ ID NO: 612552 - DNA, 715 bp, Homo sapiens
cggaacccggcgctcgttccccaccccggacggccgcctatatacagccgtccgacacctcttgaccgcaccctcggactgcccaaaggccctggacaccgctctagcacctggcaagcaccatcgacgacaacgtctatgcttactcagacacgtgacgaccgagtgcacctgacaggtgcgccaaacctactaccatgactcagaggccgccatcaaccgtcgcatcaacctggaactatgcgcctgctacaatgacctggccatgtgtaactactcggaccgcgatgatatgggctcaaacaactctgccctatgggtggactcgcgatgtaatggggacaggggggcgggctgacaagctgatgaacctgtacaacccacgaggaggcacgaatcgtacttaggatctcaagaaaccctactggaataactgatagaacaggctgaatgcaactgggtggacattacattcggaaaccaatgtggatcactgactactggaactgggcacactgagcactgacggaaatgactccggaatgtgtgacaacagtgtgacacactagctgaatgagcaggttaaagccatagcgtaattggtgaccacgagaccaactttcgcgagatgggagcgcaccagtctagctgggcggaatatgtcttggacgagttcagcatcgcgggacagtgcgtggcgtgaggcttggcgtgg

SEQ ID NO: 612553 - DNA, 228 bp, Homo sapiens
ttctgacccactagaccagtcatctggctcaaccagttccgcatcccgatcccaggagcagaagacagcaagaaaaactcactttgaccccctatgaatccatctccaatacggaccaaccagcattccccagtttctgagcccctacctgccaaagttatctttaaaaactctgatccccaaatgctcggggagacccttttgagtaatggtgggtcagaacataag

SEQ ID NO: 612554 - DNA, 109 bp, Homo sapiens
tcggacaccagacagcggtcaagtggatagagcgcacacagggctcagctgagcatgttcgctcatcatcccaggtttgcatcacaggatggaggattgggcgcagtgc

SEQ ID NO: 612555 - DNA, 116 bp, Homo sapiens
ctgggggcagcctctccccagtgcctggctgggtggccccagtgcaggctcggggtgcagcctctccccagcctccccgtgccaaatcttttcattaaagaatgttttggaacttt

SEQ ID NO: 612556 - DNA, 159 bp, Homo sapiens
  misc_feature (105)..(105): n is a, c, g, or t
  misc_feature (136)..(136): n is a, c, g, or t
  misc_feature (153)..(153): n is a, c, g, or t
accctcgggagccttaacctggggggtttgtattcagtgagtgacagaaattccaggcatggtatggaaagctcaggtggttgtcctcagacatctgtgcattcntggaagtaggacaacggtgcaggtaactctngtcacttggagcaactngtatag

SEQ ID NO: 612557 - DNA, 107 bp, Homo sapiens
gatcggagctgcgcggaaccgctgtcgcccgccccgctccacccgtcgtggcccgaggcagccgggatgacagctctccccaggaatcctgctgcctgctgagaaac

SEQ ID NO: 612558 - DNA, 166 bp, Homo sapiens
gcctatcatatagtaaaacccagcccatgacccctaacagggggcctctcagccctcctaatgacctccgcctagccatgtgatttcacttccactccataacggtgctcatactagggcgtcttaccaacacactaaccatataccactgatggcgcgatgtaca

SEQ ID NO: 612559 - DNA, 229 bp, Homo sapiens
caagaatagagatgtgggtctgtataccgaggatgagccagctatccttcctcagccacaggagtagtgagcgtgagcaccctaggatagggtagtagaggactagcgtactagtggggcggcccttacccaactactataggctagtgccacaggaagcaccttactaaggggcacaaggggcatggcccctacttatagatgaagaaccaaggggaaatccaaacct

SEQ ID NO: 612560 - DNA, 835 bp, Homo sapiens
cgaatggtctcgtgcagtgtgcgcagcgtgcctgctgcccgtcgcccgggactccccgtccctccctcgcgaccccgcgcctggggctgtgtgcggcgcttgcggctgggcatgggtgtgctggtgcagggtgagatgggggctctgtcctgtgtgggtatgcctgcgcttccttctagcatgtcctgtccttgctgccttcgagatgcctcttgactctgccttcctgtccatctttacctccatgctgtgctctcattccctgctctctcctgtagtcactctgttccatcacctgacctgtccatcgcgtcctgtccggcgtccctcctgtgttgtgacttgctctcttgtgccgtgacccgtggcgtgatcgtgtggtgtggcctcagcttcagctgttctgatctctgaccctgtcgtctgtgcgtctgtcgctctgtgcacctgtgctcctgtgtgatgtgctagttgcagtttgccgccctttgctttgccactgctgtgctggctcacacatgcagtgctatgcctccgtattctcgcatgataggtcgagtcattgtgcatgggtgagcaggtcgaatgcttgtgcgtgtagctagacttcggaggtagtactgtgaacactgttgcagcctgttgatactgttgcaggggtcttccttctagtccaactgacatgctgccgtacctgctaaagccctagccctggtgccctggatgtgacaggcatgctgcctgttgcccctcacgtgcatccttctagctctgcttggcctgccgggggtccccctgtgctcggtggcaaagacatcgtgtattggtggacctg

SEQ ID NO: 612561 - DNA, 400 bp, Homo sapiens
ttaaaagaccataccaaaaatttaaaacctgttatattaaagtttaaatttttaaaaatttaaaaatttaaacctgtttaatggctttcgcatgcacttgatctcaatcaacttaatttggatatacctcatccatacatacatactatatccaaactcaccctatccaaggcacctttttacaagccaagtagaccactgtgtgtgatccactaatgaaaccaacccacagtacaagccagtatttgtgtgtgtttgaccaaagcgctttacttcatgtaagagaaaatataaagcaacacaagcccagtgttcacagtgcgctcacgcctgtaatcacagcactctgaaagcacaacacaggcgtattcacagaggagttgagcacagtgtcgctcgt

SEQ ID NO: 612562 - DNA, 192 bp, Homo sapiens
cactgggtggataggatgactggcaactcccacaagggcagaagcgtcccgaggggtgagggctgtgtaatcgtatcactgtgcgaggctgaggcaggaggatcacatgagtccaatcttcaaggccagtcgggccgcatagtgagacccaagtctctatttatatattaataagaattgtttttaacttca

SEQ ID NO: 612563 - DNA, 135 bp, Homo sapiens
  misc_feature (10)..(10): n is a, c, g, or t
  misc_feature (15)..(15): n is a, c, g, or t
  misc_feature (24)..(24): n is a, c, g, or t
  misc_feature (35)..(35): n is a, c, g, or t
  misc_feature (61)..(61): n is a, c, g, or t
  misc_feature (92)..(92): n is a, c, g, or t
  misc_feature (104)..(104): n is a, c, g, or t
  misc_feature (108)..(108): n is a, c, g, or t
gtaacttttnagctnagatgtggncatcgccactnctgtgagcctttagatgcattaaatnccacaaatgtttgccctaaatgagtttactncagcttgttaancttncaagaatattaaatgatttataataaa

SEQ ID NO: 612564 - DNA, 164 bp, Homo sapiens
aaaagaggtttaattgactcccagttttgtaggctttacagtaagcatggctggcaggcctcagaaacttaaaatcatggcggaaggcaaaggagaagcaggccctttttttccatggcagaacaggaaagggaaagaaagtgagatgggaagtgcccccccca

SEQ ID NO: 612565 - DNA, 231 bp, Homo sapiens
tcaatttctacaccttatgtgtgtatgttagatgctgaagcttggtgctgctattgaagatactgtggaactggagacataggaaatgttgaaagcctttgtgtaatgaaaacagccttcagcttaactaggtccacctcagaacgaccaagtaaggacatagtaggactgaaggactagtgtctgtcggcaggagcatcgtgcttctccagcctccgcgtatcgtgagtc

SEQ ID NO: 612566 - DNA, 101 bp, Homo sapiens
ctggggttttgccaaccccttgatggcggtttagtgggaccccttttgggcttttggtttttgggacggtaagataataaatttgttttttgaggccccca

SEQ ID NO: 612567 - DNA, 1911 bp, Homo sapiens
  misc_feature (162)..(162): n is a, c, g, or t
  misc_feature (265)..(265): n is a, c, g, or t
  misc_feature (520)..(520): n is a, c, g, or t
  misc_feature (950)..(950): n is a, c, g, or t
gcctgcggcggacgcgatctgtgtgcgcgttgcggcgggcgtcttggaggctccttgcaggcgtgcggactgccgtgtcgctctgcagcgcggcgatatgcgcggatcagacgcgaccatggctgccccgtcatgcactatcacatatagcctctacagttnggtcgtgcgcgctgagagagtcttcaagattgaagcgggacatccacgtgagctcttaccataggtcagctcttttacctcatcacatgacatgttgctagancgacacatatgaggtggacagagatagagacagcccctagatcgcactaccgtcctttcttcattgtcaccccacctctcacagagtaacttaccaaggaactcgatggggtcggggccgatgagacgggcctcggccccgaccttgactttggaggacgtaggaagcgtacgccatggcctttgttaaacccagctcgtcatacacttagccaacagggggccagttccctgttccgagatgtaagtgtgtgcncccgcacacagacaggttgtctgtgcaccacgacacgagagcagagacatcgccggggatagcgccagctcagaggtgcgtgcattcgggtgtttgcgtcattaagatgcgtatcgccaagaggctagttgcgttgacttggctgcggcgcaagggggcactaggggccacaggcaggacgtacgtccaacatgcgcatcgtcgatggttgtcggcttgcaattcactaaagctcgccgaacactgaagaacccaggggacctgtcgatacatacaggtttggttgtccttggactggacgacttcgcggcagcacggcttatggcagacggacgttgcctttcgaaccacgctgtgtcgtcggtcccacacggcgactggcgcacagcaggggcaagggggaccgcattaacgcaagaaccgccgaaantttccacaccttgcccacgcgcggcacttcgccacggatcgaacgaacaacgcgtgacgtcgatctttgccacagacaattggctcttggcgatactcggaggttacacacatctaggaggggccaagttgtgtaccacacccccgcggggggcgcccaacaatggagaattccgcacgaactggctacaccctgttgcagcaaaaagaacatggccctgtggtccaccgagacccctggtgaaaaagccttgagttttcaaacgctggggcaaactttgctgttgtgcaactttccatcgacttgtctacgaaggcatttcaaccaccgtggttgggtgtcacagccaggacccatgtgtggacctgtccacaacatgagtgggcccactcgcgaccggccgaacccacagtcagagtagagcagatactccccctatggagaggacaacacagcacgaccgacgtgtgtgagttgatgtcatcgagagaacaacgacatctatcgaacacaaacataaccaacccacacggtcaggactcatccagaagcacgaggacatagaacacacctaatccaacggccgcgcaaccgacgctcagtagctcacacaacaaacagaggcgagagtagcgaagccaacattacgataaacacaaacactacgacacaacactaaacatacaacaccgtcacacagtgatgacatacacatacctaaccaaaaacactgccaacgaccaaacagcatgactataacaacagagatcaacaacacaacaaaatatgacatcaacgcgtgccttcagccctcctccctactatccttgcacaagcacacagctactctcaaacacacaacaaccaactactacactcactaccatacacatacctaacccacctataacagagaaacacatacacacatacagcacagcgacagcagcactatacgatc

SEQ ID NO: 612568 - DNA, 426 bp, Homo sapiens
accggagtatgccggaatctcagctcattgcactcacctctcgggttcaagcaattctcctggcctcagcctcccaagtagctgggattacaggtgcccaccaccacacccagctaatttttgtatttttaatagagatgaggtttcactcctgttggccaggctggtctcgagctcctgtcctcgtgatccacgcacgtcagcctcccaaagtgctgggattaccggtgtgagccactgtgcccagcctctcagtgatttttgatgcaaattcatttactgtgttcacgaagtggccaatcttgggacctttagcatcacttgcccttttagtgtcttacatatgtatgattaccatcagcactagaaattccaggtacttcaagcttaaaagtaagagctctagagtgtattgtcttgtattat

SEQ ID NO: 612569 - DNA, 1229 bp, Homo sapiens
  misc_feature (1229)..(1229): n is a, c, g, or t
gaggcccgagcggcaggagctgcagcgcgggagcggctgagccaggcgcccagtcgcgagaagctgccgccgcctctgccctgccctgtgctgcctgcagccccgggcggtccatgggtgcgtggcacggcgtcgctgcagtgcgcctgtgcagcccttggagggcagccggcttaggcgctgcgctcttgtccccgcaggtcgcagccaggggcgggcggtggcgctgcccaggccccggtgccccttgtgagctgcccggccggctggtccccaaccttccattggacgcctttcaaaggggggggcattgagccttggagcgggttgcctgggaggggggctccgggccgggcctgcccggccctgccaacccctattgaactattgcggggccctgccttcccacccttgtgccccggggccctgcctgaacccccggcagatgcccggcttcggagaaacttccggccaagcggaggtcggtcttggaacacggggagctttgcccaggagcaagggaggcggcggggcgggggaaacccccaaggggggggcccggaaggaccagttggttgcgggagaagggcacggggtgctttgcggggcggtgcctgcaagaacggaaacccaagccaaagaaagaaagaaagccaagcgggcgggccaaacgcggtacggcactttcacaaaggccaagcagtttggcaagaagcctaggagggccaacggtttcccaagaagggaaaccgggataacccccggactatttgacgccatttaagcgcgcaagggaacggatcgggcgggttgtttggaacccaaacctttcaacccggaagcccgtctggcgttcgcaggcgctccgtgggttcccaaggaaaacgcgggggcgtgaaggccagaaggttggggcagtataaaagcgcgccagagaggcgggttaaccccagggcaaggctttgggacccttgtttgccaagaggggcgttagggcaataccgtgttgcgccagcaagagtaccaaacacgggggggcacataaagtttggcccaggccccttaacggacgagcacagcgttgttataaacggccacaggaccggaggaataataatttccctttataaacaacaacacgcttgtgggggcgcgacacaaaagaaaagccttttggggtagcaccaaaggagaccaggattcttccaaaaccaaaggagagacgttcn

SEQ ID NO: 612570 - DNA, 764 bp, Homo sapiens
aaattacacttacctttgtactgtaaaagaaaagtcatgtaagtacatattagtactcgtgtgaaaggatttcccatcaagactagtcttggatgtagtagacattcgtttggtgacgtgcaacgaaggatataacagttatgtgtgagaatcatttagctattgtacaatgagcaaaatcgataattcattgtgaggaatcattgtattttatatgagacaatccattttaagttctgtaagataacagaagtgacgcaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcttcttcagttttagaggtttacttctcccttgcctttgactcattggactagtgcagaggctttaagtagtttaaaatgggcttttgcttttctaggtcattaacgtttttatttagtttctttagccaatagtggctgagtttcgcacttgattttcaatattttatagtaagaaatgacaaactgctttggttcatttcataaacaaactctgcatttagataactattaaaggttgttaagatgaacgatttactgtgtctttgttactcgtagagtacagctgttggtcttacttgcacatttgtacatatacttaatgttttca

SEQ ID NO: 612571 - DNA, 156 bp, Homo sapiens
cctcagtcgcctcgggcctgcagttccccggctttaacccccaaccagtaaccaaagacttgaccactaaaagtccagctcccaagaaaatgctcgaaatggaaaccggtgtgattaaggtggttaaatgtcactctcaccatccggctacttatg

SEQ ID NO: 612572 - DNA, 470 bp, Homo sapiens
tagacatccccatggccggtgaagagatacgaggcaagccttctgacggcaaaacgacgtagcagaggaagatagaagaggagggacgtctcgacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtccgtgtgtgacccgatttttcctggattctggaaaagagctcggaatacagaaagctgtcccctggtcctttgcccttgtgaaaaagcaaaaggtccattgagctggttaacactccagctgtctgtggtggccaagctgaaagagctttgtaacactggggttgcaggcacccacctttatacgcttccgcagagccagagc

SEQ ID NO: 612573 - DNA, 191 bp, Homo sapiens
  misc_feature (78)..(78): n is a, c, g, or t
  misc_feature (118)..(118): n is a, c, g, or t
ttaggattcgtagatcgaaccgatctgattactccggtctgaactcagatcacgtaggactttaatcggttgaacaanacgaaccctttaatagctggctgcacccatcgtgtttgtncctgatcccaacatcggaggtcgtaaaacccttatttgttggataatgcgactctagaaatacggatttgcgc

SEQ ID NO: 612574 - DNA, 382 bp, Homo sapiens
  misc_feature (336)..(336): n is a, c, g, or t
  misc_feature (382)..(382): n is a, c, g, or t
cctagatggtcatcagtggtgggctggataaagaaaaagtggtacgtatacactatagaatactatacagccataaaaagaacaaaatcatgtcctctgtagcaacatgaatggagctgaaggtcaatatcctaagcgaaataatgcaggagcagaaaaccaaatattgcatgttctcacttatgagaaggtgctaaacatagagtacacatagacatgaaggaagggaacaatatacacaagggcctatcttgaggatgggagagtaaggagggagggttgagggtttgaaaactaccttatttgttgttactattgcttcatttacctgggggncaatggaattaattcttgttaccaccacatcccccaccaaaacacn

SEQ ID NO: 612575 - DNA, 215 bp, Homo sapiens
aaaatttttttttttaagggcgggaggtttttacccggttggtttttaacccaccaaagaacttttccttgggcgccaagccaaagggccccggccccatgaaaggtccagacccccccggggtttaaccccgtttgccccggtttggttttttttttggggggtttgaaagggggaagggtttttggggttaataaaccgggttccctttttta

SEQ ID NO: 612576 - DNA, 899 bp, Homo sapiens
agatgcgctactgcactccagcctgggcgatagagtgagactctgtctcaaaaaaaaatagactaatacaatataacacgcaaaaaaaggtaataattatacctcttgggagcatgaggggcactagggcgatgtagtcctatgacattgatttggatggtgtccgaagttgaggttgacgtgtgttgtcttgacaaccctgagaaggagcgagagcgtgaaagttgaagctgatgttactagtggtagattggttcatacgatgcacggaggggtcaatgtgtcaaagacatcggttatcaacggaatgagacatgtgcataaccttaagaaatggtgagaaattatttggtcgtccttaagtactgaataaaattagggaggataaagttatgctaggaatagcggtgaagtggggcctacctgaataattttggggcgattatgaacaacacaccagaagctgcataattaatgaaaatgggtaaattggacttcgaattagagcatttctatattggaaggatgttatagaatggggcataaagcgggatgtgaaaggggcttcccctatgactggggttcataaagggcctcgggacacacttgtgatactctatagggggatgtctctttatagacctattgaatggccccttcatcaattagagacaaaaaaaaccagaaaagaaggtgaaaaccgtttgggcaacggatggagcaaagaaactgtgggaaatagctggtggcccttggatcggggttaatgtggacagtgggtccaccccacttgtgagaaagtttggtccggtgggttcctccagtcaacggggacattgtgaatttaacctctcccgatctgggatttaccccatgggagtggccgttcacttaatcga

SEQ ID NO: 612577 - DNA, 116 bp, Homo sapiens
  misc_feature (96)..(96): n is a, c, g, or t
aatcagctcgtaccttttatcaacagatcgtgtatgacggtatcattccataaatatggggaatactttcctggcacaggagacttgagggatatnggtgctggaaaaggcaaata

SEQ ID NO: 612578 - DNA, 219 bp, Homo sapiens
  misc_feature (172)..(172): n is a, c, g, or t
ggggggccccccccctttggggggcccccccctttgtgggggtttttttttttccccccccccccccccttgttgcccaaggggggtttttttttttggggccccttaaggggggccggttttttaagggggttttttttttaaaacccgtttgccccccggtttttaaaanggggggtttggaaaaaggccattttcccatttttccttttttcccca

SEQ ID NO: 612579 - DNA, 352 bp, Homo sapiens
  misc_feature (248)..(248): n is a, c, g, or t
gtggcgaggtgaggccagctggaaagagaggctgtccatgttgacggcagtgcaccttatttccgctgtggtagatgatgctcgacgaggtatattgaccaccgcgctcattgtctgatctatacttgctgacactctgcatgccacagctggagtaagcgctgcgcaatacaaacttgtcacccctgtcctctgcctcacagctggggtcccatgaaggtcaggcccgtgatggatgcacttcaaantgcgcaacaagctctttcttttagataccagggttcttggcgttgtccggacactttgtctggatcaaggacacgagcagctccgggctacaagtgtgaccacg

SEQ ID NO: 612580 - DNA, 353 bp, Homo sapiens
gaagattgttgagccatatttcgagtatcgccgcgatatcgaatcgcgatgagcataccctctctagaggagctgtgactccctcaagtgcagtgacctgcagaacttaacccagagtctgggtctccgggccaacctgagggcaaccaagttgtgtaaaagccttgaaaggctacattaaacatgaggcaagggaaatgagaatcaggatgaaaggcaaacttctggattctcttgtgatgagactcggatacagatcagcaaccacgaagaagctgagagacaggcacttggccatgtgaccccaaggagaaggtgcaagactgtgcgcgtggaccctgactcacagtctg

SEQ ID NO: 612581 - DNA, 381 bp, Homo sapiens
atcagtcccattccctgccttcccgcttagaggtggccacaatctttaattttgtgtgtatcatttttatggtttttgtgtttagtgccttcacatttattattattattttttggtgctttggctggcttatgtttttttggcccttgtgatccgggcctgtttcccgagctcaatatggtccaaaaggaggttccctctgtgactttttggatgtaaacccttggctttggtatagaataaccccttgaaatttttgctgtgcgagggtggtagaaatttccttttttgggtatattcttatatatattatgtacatccctgtctgaaattttagttattttttgtttttaataaagactaacccaaacttaatgatta

SEQ ID NO: 612582 - DNA, 149 bp, Homo sapiens
gtggtggccccagtggcggtagcggctagtggtgccacatggtactctttcagctacacattccatggagaccctcatgccatgtaatgcatgagattcttacggtaggcagaaatcccatttgacacctatttatagggcagacggaa

SEQ ID NO: 612583 - DNA, 131 bp, Homo sapiens
taaaagttgcgtttaagttgtattaaaaatagatatataaggaaaaattctttccacttgatgttttgtttagaccagaaagtgttgttgtgtttctgttagctcagattcccagaacagacttttttagg

SEQ ID NO: 612584 - DNA, 1951 bp, Homo sapiens
  misc_feature (1204)..(1204): n is a, c, g, or t
  misc_feature (1244)..(1244): n is a, c, g, or t
gcgcgttaggtcgcagtaatgcgttcatggtcgccatccgcgtggtcttagcgcggatgctctgatgctgaacgcgtaaccgcgttgtgtatacaaggcacttgacagagatgtgcaccgtcgaccatacctggtgatcgccgcgggcactatatggacgctttcggcagaccagagatgccagcgggcaagctacgtcggcgacgagactgcgcttgatgtcggtacagcctaaaacggccgtgcgttcagtcagggatgcgtaacgaaagacttgcgtgccaacagacgcaagtctcggatcaggcgcccagcgcactagcggtgtcagatcacaatcaggcaccgcccattcccagggcaaatgtatcaggtgacttgagtagagatgtgtgtgcaattaatcaaagaggatgacacctgctttaacatacgccgttctgaggttcccacttggaatcagatatctcgctctgagatttgagctctgcccacgagatccagcgggaacggagcccatacgcttccacaattcgaactagccaattatatcggtgactctggcgattctccgacactaggaggctcgagttcccgagatccgattgttaagggcgccacgaactttgccaactactatagggaacatgtattgcgcacaccgagctacctcttaatagccgcgcaagttaaattctgggtggcgcgcgctccctggcgccgggccacatcccacccaaaaggtgagccatgcccagggggaccatgtccctacccgcaggggggcaattcgttacttaggtgccttgggcgtttagcaagcggagaagaccaaaggagagcgataagaggtccggagacaattaggagcgatcgattaggagcgctgacagtaccccatttgcctttcacacgttagaacccccgaatgtcctttgtctcactttaacgctaaccacaggtgggttgggaggaacgtaactacaatgggccagggttcgttcccctttaccttgggtgattgaaccgttcgtgctttttatcaccttcaatcgggacataacaccggggcaacggggctttagagcccccttggtctgtttaaacctaagggacaccacggagcaacatagagcgcacttagaacattaaagtagttaggccccccacgaaagacctattgagttaacagcagacagcacancggctttaggtacgctgttggcagaaaaaccgcaaaacgncggaggcgggcgttcaacacgcatcataggagcggagaagaacaccatttcgagaaaccatttggtgatctcctttggagaatagatgctccacaaaaagcggccacactagtgtattacccacccaaacgtttatcacagagtagagtatcgcgcgaatatgcgacacttacacaacacagagcatattatgcataccccttgcaatatctaccattgggactaccactcaccatattgagtcacattgggagaatgctagaaacccggtggcatatccagtggccaggacagtcgtgataacagtagaacaggagcattgcaacacttctatccactagtacctgtgaccatagccaacttatataacatataattgtaacgccccacccccaccacccagcagtagcaaagcgtcagacatcaaccagctgtggcagccccaccagtaccgacgcgggaatctacggcgccccaccgacatggcaggcccaacagcctaccacacacgagaaagtcgagcgcgcccaccacaatagaccacccaacaacccacgcagcggacaagcacaccaccgaacggctatacatcacgcgccaacagcacactcatcagcgagcccgtcacaccaaaaacacaagggtcgcccccaagcgccaccacgacaccagcaacagccgccgagtcggcacccaacgcacgatga

SEQ ID NO: 612585 - DNA, 1157 bp, Homo sapiens
cgcagccggagcaggagcgccgagacgcgcctccggaactgtagagtaacaatcacaaccccacattccgggcgagctgtgagcactgagcgggaatgggatgcgaccctgtggccgaggccgcctgcgtcgagacgccctgacagccaaccgtgagcgccgaccagccgcggctggaccagggctgccggtcaggcctgggaggcgagacgggagcctgcgtgcgtgcactccgtctccatctgcttctcagtgcagtcctggaacgcatgtggccgcggccggctccctccggggtgcaaacaccaagtcgccgccagacagaacggccgacgcttgcggaacgggacgacaggtccatttctcgggcctgtccaccccccttcacaccgagttctatccggcgagaacagcagtcaggcattcagcccacgactcgggaccccaggtggcacccggaggatgggcagcttggacaccccatacttgggacccatcaggcccccacgggagaggcacccagatccgcgcgccaagacagggacggacaagcacaccgataaaagagtgggggttcaccaccagagggcagaataaagcgacttgagataaccaaggcgccaactgagaacacgagccccctttccccactcggccaccctagggcccaacccttccccaaggtgcgacacatgcgagcgggcccacatgcagggccacaccaggagcggaggcacaccccaaccaggggacacccacgtctgggcaccccgttcgccacagttccgagtccccgtcggacgactataccctcggcccgcgaaagctcttgggcgggccaaccacagtagcacgcgaacgggccgcccctctagaggcatgcgcccagtccggaggacacacccgaacaccccaggacactgccacggacaggtagactcggcagaagagagaccggagcaggaaccacgatcagccctacccacgagcgagcgacgacgcacccccacgccaccagagggccactcgagcggccggacaggacgccccacggcgagaccatgacgcccgtgcggcccaagaagcactccagaacacagcccgcacagcggaccgcacacacaaggcgacaacaacagcgagcaacactagtggct

SEQ ID NO: 612586 - DNA, 108 bp, Homo sapiens
gacacgtccttgggatggggctttcattggataattcaccgaaggcacccctgaatggagtgggccctcagtaaatacctggaggaattttacctggccagttaggtt

SEQ ID NO: 612587 - DNA, 344 bp, Homo sapiens
  misc_feature (19)..(19): n is a, c, g, or t
atctctactaaaaatacanaattagccgggcgtggtggcacatgcttgtaatcccagctactagggaggctgaggcaggagaattgcttgaacctgggaggcagaggttgcagtgagccgagattgcaccattgcactccagcctgagcaacaagagtgaaactccatctcaaaaaaaatattttaaaaaaaacccacaaaacaaaaaaaatgctacaggtcagggctgggcgtggtggctcacacctgtaatcccagcactttgggaggccaaggcgggcggatcacctgaagtcaggagtttgagaccagcctggccaaaatggtgaaacactgtctctatt

SEQ ID NO: 612588 - DNA, 102 bp, Homo sapiens
cccctctatctgaatcagactctcctatctgaatccagatcctcctatctgaatgctgaccgccatgatgacaaaaagtgagacggatatacagataggagg

SEQ ID NO: 612589 - DNA, 1087 bp, Homo sapiens
ttgataccctgagtgctagcctacacgtatgtatctagagtagcttatagcccctgtgaaggagggggcatgttattattattactgtcgtgtgagttatggtagctagccgtactagagataggcgtgatcctagtagtaacagatgctactacatattacacagcttcctctctactggttcctccccgtcagcacccactacgatgcatgatgatttctatacttattatgtgagtagtgcgttcgtggtacgtaatgtagacaatagaatagtacatataagtcctggatgctatggtgattctttaatttatacttgtatgtgttataggcgtcgagttatgagtcacggccagcgatgcgcttgagaggtgtagtcttatgtggatagctcaagttaatgtagttggagtcatcgattatttgtatgtgtatatactctgcctttcatgatttcaggccctggtctacgctactatataccatgttatatcattacctgtgtgtgactatatgtgtcactctggcccacacgccgtgctatccgttcttagttctagctttacactcttccttttctaatatattacacgtaaacttattttgtaagatagtcgcttctattcaactatatctttatatatatatattaaattaacgctcgtcgatctgtcttataattaagtaataaatagtataattgagatcattaccataatattattaattttcttcagtattacggacatttgctacatgctagtcacatgtgagcataataaagcagagatagaaggagtagcagggaatttagtagtctatgtactcaacgtttgcgtatactccacctgggctcgtaccgtcgatgcgtcatctcgttctctattagttctctttctttctgtgttcctttgtgtagagatatattagaagacaagtactatcgatagttagatcgtttataattgatagcaacttagacttcttcacctcttttacattatctcattagctgtatgtactctcactttttccagctgacagctgtagtttgcgatcagccctccgttcactgttctccctt

SEQ ID NO: 612590 - DNA, 330 bp, Homo sapiens
gtatacataaattagccttattagaagctgtgttcaggttgaatatctctaatctgaaattagaaatgctccagaatctgaaactttttcttttctttctttcttttttatttaattaaagttctagggtgcatgtgcacaatgtgccggtttgttacatcagtatacatgtgccatgtgggttggctgcacccattaactcgtcatttacattaggtatttctcctaaggctatccctcccccagacccctaccccatgacaggccctggtgtctgatgtacaccgccctgtgtacaagtgtactcattgtacaattccgtactcccaa

SEQ ID NO: 612591 - DNA, 674 bp, Homo sapiens
  misc_feature (627)..(627): n is a, c, g, or t
tctttcctctaccttttaacctaggccaagaggccaaaccattattttcatcctaacatattacacccccttcacaccttttcccacatcatttatttcactcttttatcacctttaaacacctctttaccccaaattaaatttaccactaactcactcttcaacttatccaacattttttaccggggtaaccccccactactcactacccaaaaaaatcaccccaatccctttttcccccatttaaacctatttacatctttcataaacaccgcatttcattaatcccttcataaaaactaatatctgttaccttcatctatcaattccccactttccccaaatttcctatatccctcactaatcacaaatttaccatatcatcccaaatgcatactcccccattactccattccctcatacaccacccatcttacttattatgccttttttccaatattccccttctcctctaaccttaaaacaagccagcttaaccacacaactttcctaaatccaaccttcaaccccccccatacttataaacccccctcttactcctatctttttaattaataaaacaacccttatccattattttggtaattaaacctaaacaaaacctcnaacaacttattattttaaaccctcctcttaaaactttactctttcac

SEQ ID NO: 612592 - DNA, 277 bp, Homo sapiens
acagactccacgatattacaagggttctctgtcctaccatgaagttcacccgcaagggctactggcaggtccaactggaccagagtggaggtggccagcgcgactgacccgtgtgcaagagagggctgtgagcgccatatgtggacacagagcactacccatcatggatgcgcccggatggatgaggtgcgcgagcttgcagaacggccatacggggccgtgaccgctagattcaggcgcagagtacatagatccccttgtgatgaaggtgtccaca

SEQ ID NO: 612593 - DNA, 1019 bp, Homo sapiens
  misc_feature (27)..(27): n is a, c, g, or t
  misc_feature (61)..(61): n is a, c, g, or t
  misc_feature (63)..(63): n is a, c, g, or t
  misc_feature (81)..(81): n is a, c, g, or t
  misc_feature (190)..(190): n is a, c, g, or t
  misc_feature (202)..(202): n is a, c, g, or t
  misc_feature (205)..(205): n is a, c, g, or t
  misc_feature (228)..(228): n is a, c, g, or t
  misc_feature (238)..(238): n is a, c, g, or t
  misc_feature (241)..(241): n is a, c, g, or t
  misc_feature (252)..(252): n is a, c, g, or t
  misc_feature (280)..(281): n is a, c, g, or t
  misc_feature (283)..(284): n is a, c, g, or t
  misc_feature (286)..(286): n is a, c, g, or t
  misc_feature (295)..(295): n is a, c, g, or t
  misc_feature (298)..(298): n is a, c, g, or t
  misc_feature (305)..(305): n is a, c, g, or t
  misc_feature (307)..(307): n is a, c, g, or t
  misc_feature (310)..(310): n is a, c, g, or t
  misc_feature (342)..(342): n is a, c, g, or t
  misc_feature (357)..(357): n is a, c, g, or t
  misc_feature (370)..(370): n is a, c, g, or t
  misc_feature (400)..(400): n is a, c, g, or t
  misc_feature (405)..(405): n is a, c, g, or t
  misc_feature (426)..(426): n is a, c, g, or t
  misc_feature (436)..(436): n is a, c, g, or t
  misc_feature (439)..(439): n is a, c, g, or t
  misc_feature (475)..(475): n is a, c, g, or t
  misc_feature (499)..(499): n is a, c, g, or t
  misc_feature (512)..(512): n is a, c, g, or t
  misc_feature (514)..(514): n is a, c, g, or t
  misc_feature (519)..(519): n is a, c, g, or t
  misc_feature (523)..(523): n is a, c, g, or t
  misc_feature (525)..(525): n is a, c, g, or t
  misc_feature (529)..(529): n is a, c, g, or t
  misc_feature (535)..(535): n is a, c, g, or t
  misc_feature (538)..(538): n is a, c, g, or t
  misc_feature (556)..(556): n is a, c, g, or t
  misc_feature (565)..(565): n is a, c, g, or t
  misc_feature (567)..(567): n is a, c, g, or t
  misc_feature (575)..(575): n is a, c, g, or t
  misc_feature (607)..(607): n is a, c, g, or t
  misc_feature (633)..(633): n is a, c, g, or t
  misc_feature (652)..(652): n is a, c, g, or t
  misc_feature (655)..(655): n is a, c, g, or t
  misc_feature (663)..(663): n is a, c, g, or t
  misc_feature (671)..(671): n is a, c, g, or t
  misc_feature (680)..(680): n is a, c, g, or t
  misc_feature (683)..(683): n is a, c, g, or t
  misc_feature (687)..(687): n is a, c, g, or t
  misc_feature (692)..(692): n is a, c, g, or t
  misc_feature (719)..(719): n is a, c, g, or t
  misc_feature (743)..(743): n is a, c, g, or t
  misc_feature (746)..(746): n is a, c, g, or t
  misc_feature (769)..(769): n is a, c, g, or t
  misc_feature (780)..(780): n is a, c, g, or t
  misc_feature (831)..(831): n is a, c, g, or t
  misc_feature (880)..(880): n is a, c, g, or t
  misc_feature (894)..(894): n is a, c, g, or t
  misc_feature (937)..(937): n is a, c, g, or t
  misc_feature (981)..(981): n is a, c, g, or t
cgctcgcagctcgcaggcgccgcgtancgtcgccaccgccgccagcccgtgcgccctcggngntacccgccgcgctcccanccccgccgccggccaggggcgcgctcggccgccccggaaagtgtcccgctgcggctccgcggcgatggccaccaaaaacgaaaaaaaggcttgccgggcggcgtacaanctggtgcgcganganggctcggccgtcatctgggtganttttaaatanaanggctccaccancgtccccggcgagcagggagcggagtannannanttcatccancantgcacanangangtccggttgtttgccttcgtgcgcttcaccancggggatgccatgancaaaaagtccaantttgccctcatcacgtggatcggtgagaangtcancgggctgcagcgcgccaaaancgggacgganaanaacctggtgaaggaggtcgtacagaatttcgctaangagtttgtgatcagtgatcggaangagctggaggaananttcancaanancganctgaanaangcggggggagccaattangacgcccananggagtaancccagcccccgccacaccaccccttgccaaantcatctgcctgctccccgggggagangaccgccggcctcagctantancccaccancccaccanggagaaaanaanccangagangcagcgcccgccaccctgtgtccacancccccaccttcccgcttcccttanaancctgccgcgtcctatctcatgangctcatggaanctctttctttgatcttctttttcttttctccccctcttttttgttctaaanaaaagtcattttgatgcaaggtcctgcctgccatcagatccgaggtgcntctgcagtgacccntttcctggcatttctcttcacgcgacgaggtctgcctagtganattgcatgactcacgttgctttcagagccgggctatattgcatntagttttctgggcctgcttctgtgtacactgaggggag

SEQ ID NO: 612594 - DNA, 1101 bp, Homo sapiens
  misc_feature (394)..(394): n is a, c, g, or t
  misc_feature (717)..(717): n is a, c, g, or t
tcgacctccccaccccatccaacatctccgcatgatgaaacttcggctcactccttggcgctcagcactgatcctccgaagatcaacgcaactaggactattacctagccgagtgcgacgtacatcgaccaagacgcctctaaccgcacttttcatctaatcgcccacgatcactcggagacgtaaatcatggtctgtactcactccgtctaccttcagcgccaattggagcctctaatattcttgtatgctggcgctcgtatcgctacgaacaatcgggacgagagcctatagttacggtatcagtttctgctactgcagaaaagcgctgaaacatccgggcattgatcctgcctgcttagcgaactagtaggcaagcagtcctgtcataggncgtatggtccgtcccatgcaggccagatatatcattctgacggggccacaggtaattacaaactgtactatccgcccatcccagtacattgggcacgagaccgtaggttcaatgaatctgaggaggcgtactcagtagacagtcccaccctcgacacgattctttacctttcacttcatcttgcccttcattattgcagccctagcaacagtccaactccgtattcttgcacgaaacgggatcaaacaagcccctaggaatcacctcccattccgataaaatcaccttccagccttactacacaatcaaagaacgccctcggnttacttctcttccttctctccttaatgacatttacactattctcacagaactcctaggggacccagacaattataccctaacaagcccttttaaaacgcttccaaattaaggcccgaatgagtattcctaattggctaaacaaggtccgatccggcctagaaaacgggaaggggggccgtggcgccatataaataacatcgcaattccttaggagaagatccccccgtcctctattttcacaccaagggatatttttttggcgaagaaacacctttttggatctaccgaggaacccactttactgaacggggcaggacagcgctcacactagcgaaggagcagcattttacaagcaacgtatattccttcaaaaggaggcaggg

SEQ ID NO: 612595 - DNA, 980 bp, Homo sapiens
agcggagcgtccagagaacgccagccgttcacgtcgttacggtcctccttgcgctgactcaccgtcctcgccgccgaaccatggaagcccccaagagctatgtggtcaagctctgaggtacgctggtcccggaacgagagcatgcctgcagcatcgaggttgttgattcgtaggattactaaacatggaaatcattaggacctaccagagaggcagtatgacagtaaggtagtgcatctcgaaagtgagtcacagcgtcaatcagagtaatcgcgcaggattagttaaacatgtacagagtaaattctgggtgctgggaagttagctgatcgctgtccctagacaactgagtcatcggatgagtttcttcttgcaaagggaaggtgggctgacggacatgtctcagatgcatgatcctcgcttcaatgctcatgggcttgaagacgccgagaacggtgtgccggagctattgctcgaggtcgcacaggtagccttgtgtcatgctcatatgggctcgacattaacggaagccaaagaagtaagcggactatggcttattcgtttcgcccttaacacctagagtgacgtaatgcagattattgtcatgatcccatagttaccctgagagaacttcgaacacagatgtactcactaacgatggatactctaatgggccgactccagtgaagagcgtgtagcgatgggtgctagggagtgttaggactgtgtactaacccctgatggtgctcagggcgaagactagggacatgggttagtcgcacgtggtcacttcggagacggatacctgtgtccatctcacaggtgggagaggtggtcccaagtgtgggatagatggcttaattggcgggtggctgcagcaacgaaagggtagttctcttcctggggatgcgacgttggttgacatagggcctgggattggcatgctggaccgttaggaccgcacccaacagatgggccta

SEQ ID NO: 612596 - DNA, 195 bp, Homo sapiens
gagccgtacaagcgcgtagcagctctcccgggggcgcagcaatggcgcggccttttgcgccgtcgtctgtaacctttctgtcacattacctgattagtatgaagcccaactccgagcgccagggaaattctaggtgaatcttgaccgcggcgcgataactaaaaaggtaaccacgctatgaccaagcaactggag

SEQ ID NO: 612597 - DNA, 124 bp, Homo sapiens
ttgaggatcctcacgcgcgaacgtcaaaccattgtcgccgatcttcacgtgtcacacgccgaaccacccaaactgcatacgccgagcaaccacactgagcatcgcggtgtcgccgatcttcacg

SEQ ID NO: 612598 - DNA, 516 bp, Homo sapiens
  misc_feature (416)..(416): n is a, c, g, or t
gcaacggcaacttccaccccaagcagtgtcacccagctctggatgggcagcgtggcaagtgctggtgtgtggaccggaaaagggggtgaagctccgtctcaaaaaaaaaaaaaaaaaaaaatttacccggggcattgggtggggggccccttgttaattcccagcttatttggggagggggggcctttagaagaattcattggaaaccggggaagggcggaaggttgtgccggtgaagcccgaagaatcggcgcccatgggcaccccagcccggggccaaccggtgaagaactccgctctcaaaataaaaaaaaaaaaaaaaaaaaaaaaaaaaaacaggtgttgggcgcgcgccaccgggcgccctgaagaaagagcttttcttagaaaccaacgcggggaggcggcggcggggngcccccgatgaggtaaggaaaaacaggggcacaaagagagggctcctagaggaaaaaccgggcgcaaaaaaaagggggggggatttccaacaaaataaac

SEQ ID NO: 612599 - DNA, 610 bp, Homo sapiens
  misc_feature (247)..(247): n is a, c, g, or t
atgaattaactgatcagccctatatgaaacataagtggtgttataacttatcagccgaatatggcccataaactagttctcgatacctgctctgtagcacgagacgcttctacaactcccgggttctaactaacactacgagtatgctacgcctgtccactagggaatccagcagatgtctgcctgcacaatgggcataacgtgtctatcacttctgggcaagccagcacagtgcgaaagagtccancttagcgcaatacgttaactcacacgctgaaatctcagagtctcgcataatgggtcgagatgtggcccaacaacttcctttctccaacgacttcatagtgtcttactctccaccccaacaaggcccctctaaacaaacacttaaggccctgcgcgagccagcaccttcccccacgaaggagcaaaatgtatccccgaatgcacttcttctctatacacatttctcggggccccaacgacaggcccttaaacacgctctcaccgacgcgtcacaccacgcgcttctactcacactacacacccttaggattcctacaagagcattcaccgcccttcaacagctggcactccccataatgccacg

SEQ ID NO: 612600 - DNA, 107 bp, Homo sapiens
tgttgtcgtctttatccaatgcctactttttcacacttctagataagcctctacctgcacgacaacatataatgacccaccaatcacatgcctatcatatagtaaaa

SEQ ID NO: 612601 - DNA, 372 bp, Homo sapiens
aacccctgttgctttcctaaaccccaactgtttcccgggggtggttagaaaaaattttgttttgatgtttaaattggccggtttagatgcccggtttagttttttgaagatgaagttccccccttttgtttccacccgccccacccgggtttgtccctttccccgcctaaagtttagtgagatgttatatgtaagatctgatttgctggttttcccctggagggttttaaatgggaaagttccccccttttgtttaatggttttttccccccccgccaataatttggggcgcccgaattttgttttttgttcccccctttgtacccaaccccctgaaaatttgttttttaaattttgtcctttttgggggta

SEQ ID NO: 612602 - DNA, 324 bp, Homo sapiens
aaaatggggcaggggccttatgtttttataatttcccaacaatgggccgccatatttttgcctcaaggtaaaggttttaacagatgaaaaaggacttccccattcccccgggctattcctaacctataatgcccaaatgttttgggcaatgtgtagggtggggggataaaaacaaatattcttgaaatagacataccctcaaagacctcattcccaagtaactgatgtattggcatttcattcatatttttgatgtgtgagggatatgggactaattaccttttccttgatgtttgcccaatttgaataaaggccttgggtcga

SEQ ID NO: 612603 - DNA, 719 bp, Homo sapiens
tgggaactttttggtaaagatgggagtttaactatgctggctcaggcgggtctggaactccggagctcaagtaatctggccggcctgggtctcccaaagtgcggggactacgggtgtgagccactggcacctggcctggtgcaagtctttaagtggcatatgtgtatgtaatcctttggtgtattgggccaggagtgaaagtccggggtcataggatatgcttatgtagaattttagatattggccaaacagtatcccttcttgggggttctacaaattacatgccccaaagagtgttggagagtctcatttggtcccatatcttggccaatacttagtatggtcactattattaactttagccgtcggggggattggtagtagtatctctgggtttaaatcggcgtttcacttattactaaaggaggtggactactccctggtgggtcactaggaacccttgtgtgaacgtgctttatccacttgtctgtgccccaattttatctttttccctaatatgaggagttcctatatattgtggtttgaccccttctgtgggtcctgcggtgtggcaaatttttcccccttactctggctttgcctttaagacttctaaggggcaggacgggttcatgctgtaccccctgtggtgcgggcgggggttgtgcgcccagggtctcgccggcgggggtaggaccttcctgtgatccgacaagaaa

SEQ ID NO: 612604 - DNA, 617 bp, Homo sapiens
  misc_feature (21)..(21): n is a, c, g, or t
  misc_feature (307)..(307): n is a, c, g, or t
  misc_feature (596)..(596): n is a, c, g, or t
attttttggaagaatcaaccnaccaagtggcacaaattcataagggaacgaccaattatggatatttcaaacttttttaacaaatcaaaaactgaaaaattaagttaatactttgtagcgtcgccttttgttgcgattacagctgtaagtcgcttggggaatgtctctatcagttttgcacatcgagagactgacatttttcccattcctccttgcaaaacagctcgagctcagtgaggttggatggagagcatttgtgaacagcagttttcagttctttccacagattctcgattggattcaggtntggactttgacttggccattctaacacctggatatgtttatttttgaaacattccattgtagattttgctttatgttttggatcattgtcttgttggaagacaaatctctgtcccagtctcaggtcttttgcagactccatcaggttttcttccagaaaggtcctgtatttggctccatccatcttcctatcaattttaaccatcttccctgtccctgctgaggaaaagcaggcacaaaccatgatgcttccaccaccatgtttgacagtggggatggtgtgttcagtngacgcggccgcgaatttagta

SEQ ID NO: 612605 - DNA, 208 bp, Homo sapiens
tccctttaatcgagctcgttacctgcactggagatcgctctgaactgtagatcgctcatactacagtcgtcccgacagctccagcctgctagactcatgtagattggctggcgggagcgggaagtgattcagagcgcccccatgagcagttctgctcttcgcactgcagtacgcagccgcggaacaccggctcacggtcgccctggga

SEQ ID NO: 612606 - DNA, 373 bp, Homo sapiens
ccccgtactagtcccgacaggagttttctcgcgtgactactatcgctgtcatgtaatggtcgtgactaggcgaaagaccgtggggcccggccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgtcgggctagtcgggggggtaccgagctcg

SEQ ID NO: 612607 - DNA, 110 bp, Homo sapiens
gtaccaaagtgggatttgagcagatatgacagtccttagtgagcacctgctgtgtactagatgtctagctaaccttgaaccctactaataccttgggctgcgtaaaagtg

SEQ ID NO: 612608 - DNA, 636 bp, Homo sapiens
  misc_feature (492)..(492): n is a, c, g, or t
  misc_feature (494)..(494): n is a, c, g, or t
tgggagactagtgttctcccgtaaattcaggcctgactgttgatctggtggccagggtcaagagtcaggacacatttgtaggggcttacacgagggttcagtagagttcacctggatgtatgagactgttagtttcagttaagcaggtctccctgaaggaaaactgtgtgaaggtgttaaggaaggagataatggacgaaaactggcagcagtatttgtatatcccgtgtcagggttgttttgtggatattaggtcaatcttaacctttaggcaggggtggccactcgtactaggctgttggcttggtggttctttactctaccatctaggtaggctgctggcttgtgtttgtgtgcaagagctgggtttcacccgaaaaattttcctactgtacaagagggtcactacctcctactagtgttatgctctggtttggtcctcccaccacaaacgtgggatccgtgcacgttaacgattactaggacataggnanccctttggggtaagggcttatataggtgttgttgattctggtactgtgggttgggatgttggttgggctgtgttttatgggggggattgagagtttctatctatggggttgtactgtgcggcgtgggctgtcgactgtaggg

SEQ ID NO: 612609 - DNA, 171 bp, Homo sapiens
gacagttagcagagatgatggattgaacgtcccttacagacacctgcttcttcagttctctttcccgtaacatcccttccttggcaccgaaacacaaacctgaattgggtcctgtggggcaacagggcaccccagcaggacaagcagatcgagccaacgcctccaccctct

SEQ ID NO: 612610 - DNA, 710 bp, Homo sapiens
atcagcattttggatgtaaaaaaaagaggttttgtcagacgaatttgttatgaactcaatctttaacccacgttgcttactttgcttttcgaaaatacccatctctgttagtttcccccccattttgtcattttctatatccagtttccaaatttttacttgactatcagtaccagttgtgatcagtaaatcatccttcactgcaaggccccaacactctccagtatgcgcaatatgcgtctctatacattgatgtgtttttaggtcccatagcttgatcattccatctttggaggtgctgatcagccaatcttctccttgacaccaaaagccagtaatggaatccttgtgtgatctaagtttataaagaccaacttctccaacaagatcccatacaatgatattggagtccttggaaccagaaattaatcttgtgccagtcccatcaaattgtaataatgttatagctgctttgtgaccgttaaaattcaaaagcacagtcttagacatcaaatcccaaactttaatgacaccatctgcgtaaccgacagctaataaatccgtatctttatgagcctccaaatatgtacactcggctggcttggcgcctctagcatcagatgcgcctggaggtaagccatcggataatttactgaccaaatccccggtcttaatatcccatatattaacgtcctcgagggggggcccgg

SEQ ID NO: 612611 - DNA, 620 bp, Homo sapiens
cgctctagaggtcctccaactagtcaagaataattagacttataaaagcactggtctgataagattctattggctttctttattcatagagaccacaacagatcggcagatcccggtttctccaactggagcctctggttaattttccataaaatcaggtcttattctatatatttgggatggagtctggtccaccaggctggagttcaggggcacaatccatggttcactggaggcttgattctcccggactcaggtgatcatcccacctacagactctagattagcggggaacaaaggggcacgccaccacgctggctgatttctatgcactgtttgtagagatgaggtttccaccatgttgttccaaacttcctgggctcaagccatctgctcaactcggtctcccaaagtgctgggaccacaggctccaggcaaccaacaccaggccttcagcctaataatttccacttctgagagttaattccaaaaataatccaggggatgtgacagaagatttagactgccagaaatttcagcatctaactttctcatttacgtcatgcaaaaatactgggttccagacccagaattatatcattataataggctcaaacaca

SEQ ID NO: 612612 - DNA, 251 bp, Homo sapiens
aggatccttatgttagccttaacctaaaggcgacgagagacagaaggcttgcttgtcggcctgtctgaagtgacggtgcagccagggtgttcccgtgccagaaaacccgatagcattgtgctggacgtcgactaaccagtcttgggaccccgatgcagagtgctggaaaaagccccgatatcttggcgcaagttcaagggtgaagcggatgttggaagttaggttgaactttggaaaaagcaaggtcttgc

SEQ ID NO: 612613 - DNA, 868 bp, Homo sapiens
gtgaggctgtgagtaggtggcattcacttaactggcccagccctctctgcttcgtgattttattctcattgaacttataaccacaagccaccacccattgacatcctctctggattcccaacggcagcataccctccaaaactccgcagcaagagcaaactcagcagtcttcaacacactggactcaccactaagggcatgtctcacttccttcacttctccctctctgctctcttacaacaacgcaactcgcgactgtactgcttccaacagggctccctcacttctgctctccctcctctctatgacaccctcttctccctctctctgctcccctctgctacctctacacacgctgcgcctctctctacacacgcgcgcgtcctacacacaccacgcacctctctctgcgcccacacacacccactactcctgcacgcaactgctacgcacctctacgcccctggctgcacacgcacacacactctcaccctggccctaacccacgccacctccaaccccctgcactctacacccctggcctacacaagcacaaccgcctcttacctctctctacctacaccacccctctgcacccgcacacctagcacacgcgcaccatttacgccttgggcacctctacctctgcctgctgcctgcccacctctggcttactctctctcctatccctccttccttacctcctctcctccctccctctctgacccttctctcaccactccttcctccccacgctctccacgcccccgccacgcacctccacccactgcacccaacccagcctctcctccacaccttcctccacactctgcctcccccccctctccctcaccctggccccctgccc

SEQ ID NO: 612614 - DNA, 1750 bp, Homo sapiens
tcgcggccctgggagctggaggaaccgcgactcagcaggcatgactggagagggaagtcccaactggtgctagaactggtgctgcagtggcagaagacggctcacaagtgaggtctggaacgaacaacagggcaagacatccatcactttgctccaaagctgtgcaacgtcaatatccatgaggcgagcacatctatgactacacccgtgcagtcagctgaagccacgctacagcaaggcagaacatcgtgagcagtgcacgcgtgacaaatgacacagcggccttcaagacactcgagatcatggccatatggcccgtggagtcaagtgcaagaaacaatcatcctaacccatgatgcagggaaaccctccatctgtcacaaagcccttgctggctccctgtacacgagctggcaatctcaccatgggcaccgcggagagcccgcttggcccacccaacggtggagttatcccatggcgttgaccatgcaacgccctatcccactgggaaccccaatgtacacgatacgaaagcgctgatcgaagacccataacccgaagtcgccacaatcaaacgaggaaccattggaagggcgcggttgcgcaagacaccacatcgaaaggaaaaccccaacagcagccgaaggaaaatcccggaggcgaggccaaaacagccgtgacaccaacagccacaaaacgagggcaacggaccaagggacaccccgataatgcaagatacgccaccgaacaaacgcgagaacccccaataaacacaggaaaaacaccgacttgggaaaggaaccccagcgacagcgaaaacgccaaaagcaccgacgcagagcaaaccgcaaaaaccgcacgcaataggcgcacactagggcacaggggcccacacgcagccagccgttgggcacgcaaccgccggttcccgccgaaaaatatccacgaaaagacggcaaaaaggtgtgacagacacaggtggggaccgcacgtgagccatattccgaagccggtatccagaattaccaaggagcagcatagaaccccacagcgggaaattggggaagatatacgcccccagatgagatctaccgagtacccggaaagccattgggagacacccaacggacccaaacagcacgagaaaaataggatttggcgggaaacaataaggaccaccacccgggtagctcacgcagaccacagcgattaccacaaaaaaacacggagaccaaatggacaatagaggaaaaaacgagatgacgcaaaaccagaaaaaaatccaagacgaagagaaagcaaatgacgcaaagaaagggagcagaaaacacaaaagaagacacaatagacaagaatacggagacaaaaatgaaagcggaaagcacaccaacgagaagaaaaaacccaccaaagaccaacaaagagaagaaagaatacaggacaaccaacagaccaaccacccacgcaaaccacaaagacgacaccaacacatgcaccccacaaaaagaacaaagaaacaacgagaggcaaaagccaaacccgataaaagacaccgatgaaaccagaagcagatagagtaataaaacaagaggaacaccaccaaaaggtcaggagaatagtaccagcgctaaagagacttaggcacgctaatacaaagataaaactcagaatcaaagacaatcagaggaaagagcaccccacacccagaaagtgacaagttagagcaaagaaaaaacgcaataagacgaac

SEQ ID NO: 612615 - DNA, 196 bp, Homo sapiens
cctggctggcttaaaggggcttggtcaagggcctggcattaacctgccccccccgggaacttaaactaaggtcccaacccaccccaaaaaccttttgccccaaaaaattgggtcaatcagggcttggccaagggtccctcccattttggatggtttaatcctgttttttttaaaaaataaaatattttttaatcca

SEQ ID NO: 612616 - DNA, 143 bp, Homo sapiens
ccgttttgagtcagacacacgctatgaaaaatgctcttgccctgacaagaagaataagctggataatctatggagtcatagatttcattttaacaagacagagctgaggtctcaaaaaaagctaattaacttaacattcagac

SEQ ID NO: 612617 - DNA, 298 bp, Homo sapiens
cagatgccaggcaaaagtcatttcactagggctattctgcgttccacagggactcttcttgctaagcacaattataaagaaaatgacatcaccactctgaatcacaggctgaaagaaaattgggttttggttgattctccacaagaaacacagttatagtgatagctagaatatctgtgcctttggggtttgcttatcacacagctgatattggtacatatgccaaaggaacgcacaatcacatatgctaccagaggtgagtggatagctaggtaatcaagctttaatataagacttt

SEQ ID NO: 612618 - DNA, 851 bp, Homo sapiens
agcggggtggtccgagccaggctcctagggcagagggcaaacgggccctccagtgagggagccgggagattacgcatgctccagtgtaggtccacgtttaggttgggaggatctaccatgaagaaggtctaggaagaaaaggtcatgatggccagacgccaccgagactccacctcccagcatgctagctccaattccatgctctagcagtctagtcctgaatccacacacactagcagcctagccctgaatccacacacgacaggattccagccttgaaaccagctcccggcagccagcattccaagcccattccagtcacccgagaatccgccgctcctcttgctgccttttatcgtccagatgctaagcgtgaaggcagcccctcaatccaggaaagcatggtcctctgagtcgcgccggcccgcattccttgctctctgttggccagcttgcccctgcaggtcctccgctttgctaggcgtcgtcttggggctatgccatatgccgcatcttcgatgtccttctgcctcgggactggcagatggcgccagggagaggcactccccaatctgctcaccttctacagaaaatcttcaagaaaaacctccagtcatcgtaacgcgtgtctccaagccctcggaactgtggctgtggctctgggggctctaggaggctgctactacatcactgaatccgttgtgaacaagcccctagtgccccacagtctggcagagctccaccagccccaggagttgataggtgatggcgctgggagaacgatgttcagaatatctcaaagacaaggtccagaagtttgatgtcttccctgtccagagagtgaaaaacca

SEQ ID NO: 612619 - DNA, 1887 bp, Homo sapiens
  misc_feature (252)..(252): n is a, c, g, or t
  misc_feature (1073)..(1073): n is a, c, g, or t
acctatctgcctagtttgtcaatcgcgtgtgttgcgtgcccgctgtgggtgtgtgtcttgcggggagtgctttcctccggcgagtgtgggggtgtatgtgctgtccggctgctcgctctctttgtgcttgtctcttacattggttttgttgtgtggttgttagtctctgcctccctcgtgtcttcgcttctgtggtgttctctctctgtggtttatcccgtccgggggggggggccgccttgctttgtttgnccatgatgatgtccctactgtctttcctgctgttatttatgttggtggtgctgttgtctctgctcgctgtgtgctcgcttgttatagtcgcgctgatcaatcgtggttgtggtgtgtgggttttgttcacgcgtccgttgtggtgtccggtccggttgtcgtctcctttgtgtgttgccggcctgtgccttcgtgtcgtagcttattgtgttggaatcgtggtgcctgctttgttttttcttttgtttctcctgcctgttttctctttgctcttcgtgtctgttgttgtgtccctccgcggtgtgttttgctcccccacctactattggtgtatgttggttgtggtctgcggcctcggagtgatgtggtgtgtgtatagacgctacgttcgggtacgggtggtgtgatgttgtctttctcactgtggtaggctccaccacaggggggggctccctccgccccctgaatgaccaatgcccatgctgctgcagctgcccttcttgggtggttctccccgcgactgatgttatggtggggtgctcctcctctgtgttgcgtggtaatttgtctcgcggctggcgggttggatggtaaggctgtgccgccgctgatggtggtgtggtaagatgttgatgcgcccgcgtgttccaccggtgatattagtttggttttggtttgtgtggttgttggtgctgggcgcgcccacgctgggtgatgatgattggtgttggtgatgttgttggagatgcgccccgcgttgttgtttgagggccgcctacccagctttgtctgctacgagttctccttattggtcgcctccntcttattgtctccctctctctcgccacaactttgtattaggagactgagtgtgggcaaccttttttgtggtgccgcaccacacgccactaacaaccaacaaggcggacaatatgtcaaataacgacacgctcggcgtgatgatattttttgcccctcgttatgaggaataaattgtttcccacaactcgtgtcgcgcttgttgtacacacgacaactgtcccccgtgatgttgttatatcttctccgcgacttctcacagagagagtattgtcgcacaatgcgaacccctgggaaagcgtcgcaaccgcacatataggtgtttatacatatagagaagacacacaccccgtggtaaacgcgccaaaattatagatttctatagacccactgtgtcttttattgtacacacgtgttgtcacagtgtggggtcttctgtggtttgtgtacacacagtctcctatccaagacctctccagagagattaccttcggaggagtcttctccctggtctcacccagtttctcgcacaggcacatctttccggcgtccaaccatgattgttttagtgagcccaccaggcttcccaccggacattcacagtgccatatattggcgtccaacatttcctgccactgatactgcgttgcatacccgcccaactaataatttccacatttacacatacccaaccatgccctttggctttgaaccccccgcctgatgactggcctatttgtaggaaagtaggtttgtactcatttctgtatagtctccctctattgatgagggtcttaaacaaaaataaaagataaa

SEQ ID NO: 612620 - DNA, 187 bp, Homo sapiens
ccaaaagcctctgatttttaatttccataaaatgttagaagtatatatatacatatatatatttccttaaatttttgagtctttgatatgtctaaaaaaccattccctttgccctgaagcctgggtgggacacctgaagaaaactgtgtttcatttaaagatgttaattaaatggttggaacttgga

SEQ ID NO: 612621 - DNA, 138 bp, Homo sapiens
gtggctaaagtgaaaatcgtagcctgtgatggtaaccatactgactccaatactacagaatgcatagacaacatctgacttatatacacccatctctgtacaacataagcttaagaagcagaacctcagcaagcagca

SEQ ID NO: 612622 - DNA, 726 bp, Homo sapiens
ggaatggaatggaatggaatcgaatggaaaggaaagtaatggaacccaccagagtagaatggaatggaatggaatggaatggaatggaatagagtggaagggaatggaatcgaatggaaaggaatgtaatggaacccaccagagtagaatggaatgtaatggaatggaatagaatggaattgaatcaactcgagcgcaattgaacgaaatggaatggaatggaatggaatggaaaggtatagaatggaattgaatcaacccgaatggaatggaatggaatggaatggaatggaatggaatggaatggaatagaatggaattgaatgaacacgagcggaatggaatggaatgtattagaatggaatggaatcaagccgagtggaatggaatggaatgtcctggaatggaatggaatggaatggaatggaatggaatggaatggaatggagtgtaatagaatggaatggacaactgctcgatttggaatggaatggcaatggagtagaatggaatggaatcaaacagagtggaatggaatggaatggaatggaatggaatggaatggaatggaatagaatggaattgcataaaccaaggggaatggcatgtaatggaatggtatggaaaggaaaggactgtaattgaatagaacggatggactcagacgaatggaactggatgaatgtatgtaatgtatgacatggactagaatgcattaattcaatc

SEQ ID NO: 612623 - DNA, 457 bp, Homo sapiens
ggctgcccatcaacagtggactggataaagaaaatgtggtacatataaatcatggagtattaggcagccataaaaagaacaaaatcatgtcctttgcagccagccacatggatgcagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctcaataaaaaaaaaa

SEQ ID NO: 612624 - DNA, 132 bp, Homo sapiens
tgtaaccatctaatgtatggatacgcactaaaacatactgtaaacgatgagttatactctataacaaatgcatcactgattttcaggcaatcatgggtttaataataattagtttaagactattaatcacat

SEQ ID NO: 612625 - DNA, 566 bp, Homo sapiens
gttcctatgtctatctatatcacagtggttttcaactgagcaaaatttcgcctcctcagggacaactggtatatctatctatctatctatctgtctgtcatttcctcatttatgaagattggggtaataacaatgcctgcctcaaaaattgacaaatgagatctcattaaactaaagagcttctgcacagcaaaagtaactatcatcagagcaaacaggtaacctacagaatgggagaaaatttttgcaatctattcatctgacaaaggtctaatgtccagaatctacaaggaacttaaataaattctcctgcctcagcctccctggtagctgtgactacaggcagccaccaccacgcctggctgatttttgtatctttagtagaggcagggtttcaccatgttggccaggctggtctcgaactcctgaccacaaatgatccacccatctcggcctcccaaagtgctgggattacaggcatgagtcactgcgcccggcgactgtctcattctgtcttgcccgctgacatgtaagacatgcctttcctcctccttcaccttctgccg

SEQ ID NO: 612626 - DNA, 215 bp, Homo sapiens
tgcttctaaaaagagatttcattttaaatttgtcaagggaagtcatttatctccacacaaacgcacaccgcaaatatatatatatatttttatttcctcattctttgttgacaggggaattgtaactagaaatcaaataatcgggatgcgcaataaccctatagtagtcgagttcaacaaactgattaacaaaatcactgacatttagcattaag

SEQ ID NO: 612627 - DNA, 169 bp, Homo sapiens
aggtgttatctagcctttctattagctcttagtaatgattacacatgcaagcatcccgttccagtgagttcaccctctaaatcaccatgatcagaagggagaagcattaagcacgcagcaacgcagttcaaaacgcttagcctagccacacccccacgggaaacagcag

SEQ ID NO: 612628 - DNA, 499 bp, Homo sapiens
ataagcatcataatgaaaaaaaaaaacctcaggggtacgagtcacggacattgaacatgtgttactatctgtgtatctgcccttctgcttgggatactaggaataaagaaagtgatcagttgtctactgttgaaagcactctgccgtggagcacacggtatccgatgtacggaaagaggctagtttcatcatcacagatcacgtccattgaccacccggcccgggtcttgaaagaaaagcatgcccaagacaagactacctctgcgcaacatagattcgaaacatcggggcgtgccctagttaccacatcccgaacggccacgacaagacccgtactcgcacgtgcgcgaggcgacataatcccccgaccatagcaaataatgcgaaggctggccccgcgccctaaccctacgacgggaaagcgagtaaatatacgcttgaaacgagtcaccgccgcctaaggacaaggtttcgcatccatgataaacgaccccgccag

SEQ ID NO: 612629 - DNA, 133 bp, Homo sapiens
  misc_feature (3)..(3): n is a, c, g, or t
  misc_feature (63)..(63): n is a, c, g, or t
gcncgtaccagtcatgttttatttggaggttaattcttattaggatatgaaaggaatcagctncgattgagattgtgttcctctcggaggggctcgggccaaggtcgtggggtgggggggtgcagagtgtgtc

SEQ ID NO: 612630 - DNA, 1815 bp, Homo sapiens
  misc_feature (231)..(231): n is a, c, g, or t
  misc_feature (509)..(509): n is a, c, g, or t
  misc_feature (792)..(792): n is a, c, g, or t
  misc_feature (794)..(794): n is a, c, g, or t
  misc_feature (1064)..(1064): n is a, c, g, or t
  misc_feature (1815)..(1815): n is a, c, g, or t
ttttaaaaccctcatcaatagagggagacttacagaaaatagtcaaaccacttttacaaaaggccagtatcaggcgggggtcttcaaagccaaagtgatgttgggatgtgttaaagtgtgaaactatttagtgtgtggggggatgtgaacgcacgatatagtgtgagggaaagttgtgacgccaaataatgtgacggtgaagctccggggaacgcctgtggtggctctacnaaacaaatgtgtgtgacgccgataaagtgccgttcggaaagagtggtgtgaagagcggaagaactctcgaagagttcactctctgtgagaggctctgtgtgtgtagagagagcgtgctacacactatagagagcgcccgagttataaaagtgtgtgataagtggagccgagtgtgctgtgtgagaattttatgtgtggtttctggcggtgtgtgtttctccttactcatagacaacatcagtgggtgagagccctcgaggggtgagagtgtgcaatanctctcgcgtgagaggtgcgcgagagggataacatcagcggagagtgggtgtgtatagagagagagtagtgggagaacaccctcccaatagagaggggaaatctacagcgggcgggcgggtgaaagttgacccgtgtgtgtgggcgggtggccccccagagatgtaccctcctctctctataaaagtggtgcggaggggagacactaaggcgagggcaccatacgatgaccgtgggacaaggctgtgggtctaccacaacgaggggtgctctccaaaacaaaananaacatcttcgctgtgtgcgagaagagcagacaacaacaaaaccactcttctgcgctggcaagggcactcacacaatcaaacaaataaggagaaaaattatacatccgccgcgggaataattctcagcaaagaagggggcgccattatctggttgtggcgcacccgaaggagcgtgtgcggtcgtcgacctgtgttggtgtatgtggggccccccactgcgtggggcacaacgtatggtgtatggaacttataacccccacccaggagtgngtttatccaacacatcttccggcgacggccccaaaaccaccaaattggggggggcacacattacgtgggggaccacaagagggggcgtgtgttaggagataatcaacacaaagaggccccataaacataattgaaaggagaaaggcgcatcatagtggggacacgcgtgtggccacacgtcgtgcaacaaacacttaccacagatggttgggcacatagaagaccacagggacgactgattcacataatcagcgcgagggaggagcagtaagaacaaatgagggggcccccccgggagatatacagggggcgaccccacacgagggactgaggaggggtacaacacccactaccagtgtgtcaaggagcgacagtgtatgtcgccctcccaccgtgggtcggccccacaacaaaggtggcgcgcgctcgcccacctaggtgggtggtacaggcattgaagcagaacaagcagagggcccagagaacacacagaacactacaagcaagagcctactcaacgaggggagagcccaccacgttggtcagccatcgcagcgggggggattaacacccccgtggtgaatcatacccggcggggcttaacaaagagagggcgcgaaacccacgcgaagcgcttgcaacaaacaggtgcgtagccgcacacacatgagggaaagaagcgaccattatgagtgctcgagcaactagagagcacaaatgcacgcacagacaaaagagatgcgtgacgcan

SEQ ID NO: 612631 - DNA, 395 bp, Homo sapiens
tggcccggctctctacctcaggcgctagaaaaaacggggggcacagaagcggacagatgagctggtgagtgagtggtttacccagcctggagcggcgaggagaatgacaatcattccagactcaaacttaatgcgcaagttggccgccatcacctagcaccttatttagccactctgcagctggatagcagcctatggataccacttaaataccagaccccaccagcagcagcacaggggacaagctacgccaggggaagggtggggcccttagctccaaatgggatcagcagctcccccagggggcagggcatttaatcccacctcgaatagtagttctacaaatccggcagcaagtagtcctggatcgggttcctcggtgccaccggtctcag

SEQ ID NO: 612632 - DNA, 211 bp, Homo sapiens
  misc_feature (134)..(134): n is a, c, g, or t
  misc_feature (174)..(174): n is a, c, g, or t
tgtctctgtctctgcatgcgcaccacacccagctaattatgatatagagcaggttctccatgttggtcaggctggtctcgaactcctgacctcagttgatccacccacctctggctccaagatgtgctgtgatnacaggcgtgagccacctcgcccggcaatggactaccagtntaatagggaaatctacaaatagatcacatgtgatagg

SEQ ID NO: 612633 - DNA, 189 bp, Homo sapiens
taatatgtacttataaacacagaggctagacagtcatggtctaagtccatatacatgtgacacatactgagtattgctcccttccaagccatttttaagttacttaaatctgttttcaagagtttggatgttaaggaaaacgagacaaatctgttagccagctcttggctctcctgtgttcctctagct

SEQ ID NO: 612634 - DNA, 269 bp, Homo sapiens
gcgctgtctcacagaaaaaacatataaaatctagttaatggaagagctgtcgttgtatctggcaaatacagtgatgctgcctgtcaggaagccgggtgcttgtcctctgtatagacttacagcagtaagcaggtcaggtacacgcagtctcaagtgccctcctagaaaggagctcatagtcttccaggatggctgggaaacaatttcaggactgtatgtgaaatttagtcccatgtccccaatatctcccatatcctgtagcctaccct

SEQ ID NO: 612635 - DNA, 174 bp, Homo sapiens
tcttaacgtgctgtcatagtatcagtcctcacgtcaatgtctcctgttcatcaatggcttcctcaacagctgtctttgcgtgaaaactcgttctctcaggggacgtccagaatcgcattatctgacacacagcatttcatggtcagaacctcggacagcctggatgtgttcgat

SEQ ID NO: 612636 - DNA, 880 bp, Homo sapiens
ggctcttcttcctgccaacttgtgaagagggtttcttatcttcgccttcaccttctggcatgattgtgggctctccttgaggcctccccagtccatgtcgcaactgtgtaggtcaactaaacctcatgttcctcttcgagaattgcccagatcattgagcaggacttcttctgtagcgggttgtgaaaactggacataactaccagttagtatacgatctcagcatcgtggatagaagtgtagttacacaccctaatttttcatcgtgcatagtatctcccaggcggagtgcttctgcaatctactcagctagtgtattcttcggtctactgtgccacgatccggctgcctgtgctctgtctactctctcaacaggccgtactggtgccactctgaacagatgaaggtccaagatacgctatgtgtgggccacggagacactccggagctggggcactccacttgggccccgtggatagaggtcaccccgaagacaccgcggtcctatggaagggaaagggccactgacgccgccacgcgtacgtggagcttcaccgggggcgccttccgcggacagtactcacggaacggaacccttgagatcctcttgggaaacacaaaaacaagtgagcgtacacaataccgccaccttaggctttacctctcctacctttcaaacagacggtcttacgcaggcagcagcatctgacgggccaccactcggagccatgtcgcggggtacgaggtagcactgggtgtggccccggtggacatcgacaggtcccgccacacggaccgtgatgcatttccacacgccgcaaggggcctgtgcacagcagaccaagcgggaaggaacgtctagcggcccatgtggaaaagc

SEQ ID NO: 612637 - DNA, 1712 bp, Homo sapiens
  misc_feature (1258)..(1258): n is a, c, g, or t
agctggcctccttgtctaccccacgcgcggttctcaacgggtttgtgttgctccgtcccacctgtagtggaacggtcctcacactctgcgggggtcctcctttgtagatcaactaaccggcggggaagcagagtagtcgctgtggcaccaactattgtggacacctcctgtttcttctgcagacactgtggtgcacacccccaaacacgtgcgggccccacgctctttgtgagtacgcggcgtgcaccacaattgaaggtaggagatatggtttcaccctctcctccccctcttccttcagctgatagggtgtgcatcgatctcctgtggctcgagatttttttcctgggcgccgattttctccacagggcggggcccccttgttgctgccgctcttactaatactccctctgatgttcctcctgtggcgaattctactcgggcaattttttggtggtgttgtggtcacacactcttctctcgcccccccccggggagtggtttcgccctccacaggggggtgatatattggggggatacaccctgatgcggtgtcctctcctccctcctccacttgtgcggatatccaacagtgtcaacagacgtccgtgggggggggtccattttgtgtctcgggggccccacacatatagagcgggggtccaccccaccgggggggccccgcccgttgtgtcctccgtccgtgtgggatagcgccccccccttgggatactggatacctcgtcttcttatacacccctctctctccgatgtggtctaccccccctcttccgcattggttctcacgcgggggagaccccactggggttttcttttccccccccacggcagagatataatattgggtctttgtgtgaagagggagagggaatcgcccccgcgggggcccaaacaaattgggcccccccccgcgggagagccccccacacccggcgggaacgagcacgctctctattgggccccccatgagtcgaaactctcgagaggggagactcttcacccacagcgcgctctctcgcgcgtgagaccacccccccacatcacatccggagccggagtactttctcacgcggtttctctcgcgtgagagtcgcgccccctctgccctctgcgcggagaacgccccagcgtggtgttcgcacacacccacactcactctcgctgatatctctcgcgggagaacactctctcggggtgagcacacacacggggtgctactcacacgcgttccccgcgnggagcactctctcccgcccctcataagaatgtgggccggggcctataccctctgtgagagagagagggtctctgtgtgagagagagaagaaaaggggggtctctgagagagagagagagaggagaggagagagccctctcacacacacagagagagagagaggagaggagaagagagcgcgcatcaactgaacccccggcccacgcgcgcgcgcccccccgctgatctccgcgaggagccgcagacttcgccacgggcgttcccgaggaggcgccacgggctctccaagaaagaaacttgggcccctcgagagttcgggagaaagtttatagttcgttctgagttctgaacgtcttttctaacgtagccttttgtatttttttttttaatttgaagggaccctgatgaagccctgccatacccctcccgagtttaataaaacgtataatcacca

SEQ ID NO: 612638 - DNA, 198 bp, Homo sapiens
  misc_feature (184)..(184): n is a, c, g, or t
tcaaagaaccactccccgttgaacaccaaatacccttgtatttggcccatattagctccctgtaccccattgtctgctccagccactcctgctattcctggaccacagcaggcaacatcactgagtatcagtgtcaccaggtacattaccaacgatgacggccatcactttttagctgattacncgtttaattctgtg

SEQ ID NO: 612639 - DNA, 237 bp, Homo sapiens
  misc_feature (40)..(40): n is a, c, g, or t
  misc_feature (57)..(57): n is a, c, g, or t
  misc_feature (95)..(95): n is a, c, g, or t
  misc_feature (107)..(107): n is a, c, g, or t
  misc_feature (205)..(205): n is a, c, g, or t
  misc_feature (210)..(210): n is a, c, g, or t
  misc_feature (233)..(233): n is a, c, g, or t
gggggcggttagggcgatgaagtggggaggaatggggtgntttttgtatgttcaaangggtcctttatttttacgttgaaagatatggggagtangtgtgattgagngtggagtagattaggcgtaggtagaagtagaggttaaggagggtgatggtggctatgatggtggggatgatgagtgctattgttttttgtgaattctntcgantatatggtcccatttgggcaaanaagc

SEQ ID NO: 612640 - DNA, 138 bp, Homo sapiens
ctaaccatgggctatatgatggcaaaaagcactggagatcatcctgaccaccccattgtggagacgctgaggaagaaggctgaggccgacaagactgataaggcagttaaggacctggtggtgctgctgtttgaaacc

SEQ ID NO: 612641 - DNA, 157 bp, Homo sapiens
ctgtggttcttgtgctgggggtgtctggctgggggatggggcagatagagccagctgtgagcagagtctcttcagcatctgctcaggggccagcatataggtgacggctttggggaggatggcacttccctgcccaccagcacaaccagcacaagaa

SEQ ID NO: 612642 - DNA, 538 bp, Homo sapiens
  misc_feature (22)..(22): n is a, c, g, or t
  misc_feature (82)..(82): n is a, c, g, or t
  misc_feature (145)..(145): n is a, c, g, or t
  misc_feature (149)..(149): n is a, c, g, or t
  misc_feature (174)..(175): n is a, c, g, or t
  misc_feature (199)..(199): n is a, c, g, or t
  misc_feature (244)..(244): n is a, c, g, or t
  misc_feature (269)..(269): n is a, c, g, or t
  misc_feature (292)..(292): n is a, c, g, or t
  misc_feature (298)..(298): n is a, c, g, or t
  misc_feature (320)..(320): n is a, c, g, or t
  misc_feature (326)..(326): n is a, c, g, or t
  misc_feature (330)..(330): n is a, c, g, or t
  misc_feature (334)..(336): n is a, c, g, or t
  misc_feature (363)..(363): n is a, c, g, or t
  misc_feature (398)..(398): n is a, c, g, or t
  misc_feature (400)..(402): n is a, c, g, or t
  misc_feature (439)..(439): n is a, c, g, or t
  misc_feature (444)..(444): n is a, c, g, or t
  misc_feature (470)..(470): n is a, c, g, or t
  misc_feature (521)..(521): n is a, c, g, or t
tttctgttgaaccctgacagtnaccatgatggcagctcagttttagttactgacaaattatactaacttctctcgctcaatnttccccgtccccccttccccctccctgagttttgcctttccggtgttccccctttggtttggntttnttttgcccttttttgcttttccccnntggtagttgccccggttgcctgcngtgtgggggcccttttttgcctttgttttcctgcctgtgtttttngtcctttttttgggtccctttcccnttgcccctcttttgctgggtgcncgtttngcgtttttctggggggggggtncgtgtncggntttnnngttcctttcctccttgctcttcctctnggccttgccctcctttccctgctcctctctttttngnnngcggttttctctctcccgctcctcttccgtggctggnttttngggccttttccccctccgcccccgcngcgctctgtgggttctgcttcttctttgctatttgataatgctacctttgnggatttctacataatat

SEQ ID NO: 612643 - DNA, 82 bp, Homo sapiens
ccccgggcttttttttgggggccccccccccccccattttttccccggttttttggcccccccctaagggtttttgggggga

SEQ ID NO: 612644 - DNA, 274 bp, Homo sapiens
cagcttgtgggagccgcatatcacccaacgccagtggagaaagcctgggcccttgcaaacgattccaactcatcagccgatgaagttctcatgggcagactggtcctggactgacaacgccccgtggtgaggagaaatgggggccttgatgctcacctggtcaggccaaggtcaagctatactgtcaggacatggcaggctggtggacacaggaagcctacccaacacgctggtatttggccaacactgaggatgtggttcatgggggagcagt

SEQ ID NO: 612645 - DNA, 216 bp, Homo sapiens
gtaccaggctcgtagtttgtcgcctctacctataaatcttcccactattttgctacataaacgggtgtgctctatcttagctgcttcttagcgttgctcgtcttggtttcgggggtcttagctttggctctccttgcaaagttctttctagttaacttcacttatgcagaacgtataggggttagtccttgctatattatgcttggttatgatttt

SEQ ID NO: 612646 - DNA, 444 bp, Homo sapiens
acttcttctccccagcccacatcatgaggttactagaggtcattcctagccgatactcttcccccactaccatcgccacagtcatgagcttatccaaaaggattggaaagattggagtcgttgttggtaactgctatggatttgttgggaatcgaatgttggctccctattacaaccagggctatttcttgatagaggaaggtagtaagccagaggatgtagatggggtcttagaagagtttggttttagaatgggacccttcaggtgtctgacctcgcagggctagatgtgggttggaaagttcgcaaagggcaaggcttactggaccgtccttacctccaggaacccccacccgaaagaggggcaataccaggtactccccaattgctgatatgctctgtgaagctgggcgatttggtcagaagacaggtaagggctggtat

SEQ ID NO: 612647 - DNA, 577 bp, Homo sapiens
gaggaaaacagtgcaggtaggagaaaagaggggcctgggaagggaagaaaacagcagggaagaggagggctgaagacagagcaggaggaaggctgagtggctttagctctttggcctaacccagaccagtcagagttcactctgggcacctcccagtggcagccacttgatttgcaggcaaagagcttggagaccggctctgcaaattcagccttatccatgtccacatgggtatggccccggaaagcactcaacaaatatgcactaaatggatgacttcaggcagtgatccagattattcagagcagaaagctgcttgggctctgattacagaaaagtactccccgctcatccggatgcagggataccttccaagaccccccgtggaggcctgaaactgtggattgtaccgaactgtagaaatacagtactgttttttttttcctatacatacatacctatgataaagctaggcacagtaagagattaacagtaattactaatgataaacagaacgattgccacaatatactgctgtaataaagttagtgtgtgtgatctctctttcacaataaaa

SEQ ID NO: 612648 - DNA, 119 bp, Homo sapiens
ggtctgtaggcgcacaccatggatcgatcttcctcatcatctatcgcctttgttagccaggcgtcgctggggacacggtacaagtgggacttaatatcttcggggtgggggtgataata

SEQ ID NO: 612649 - DNA, 112 bp, Homo sapiens
ttctggattcacgtcgtaacttaaagggaaactgttacaatgtccggagcccttgatgtcctgcaagtgaaggaggaggatgaccttaagttccttctgcaaggaacccacg

SEQ ID NO: 612650 - DNA, 520 bp, Homo sapiens
taaatcgcgagcggcgccctcaacattttaaaaaaaaaaaaaaaaaaaaaaaaaaaaaaaaaaaaaaaaaaaaaaaaaaaaaggggggggcgtttaaaattttccccgggggggcccattttcggtcccccttttttttgaaaagggggcccctaagggggggtttttaaaacgggaggggaggggcggttttaaaaaacgtggtggagtgggggaagaagactggtgtaggcacgtgggacttctttgtgggggaagagggaaccctattacttggggggggggggaaacattatggtggggaaaaactattacattacagagagagaaatttataagagcctctagaggggaaataatattaatattattaagcgggtatattagtggggttaacaacaaacggcggaaataattccgggcgggcagtagaagaatattgtggcgatacgaggaaagattattgaatatattggaaacatttttttattcccgggggagttgtgttgtataaatcagg

SEQ ID NO: 612651 - DNA, 584 bp, Homo sapiens
  misc_feature (226)..(226): n is a, c, g, or t
gatcacgtgcattgtgccagtgggcagtgtattgatggtgcctccgatgcatggagatgcaaactggcaggacaaatcagatgagaagaactgggaagtgctcttggttaattgatacaggtccggtgtggccatggtccgggccttggaaagccccagaagtgtgatcctaatgtggattgcagtgacaagtcagatgaactggattgttatccgactgaagaancagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggaccccccctatgaccgagcccatgttacaggagcatcatcaagtagttcttcaagccacaatggcacgtggatcgggtaacgag

SEQ ID NO: 612652 - DNA, 330 bp, Homo sapiens
ggtcgacaaaaatcatatcatcatttcagttgagttgtaaaaagtgatgttgatggccaggtgcagtggctcatgcctgtaaccccagcactttgggaggccgaggctggcggatcacaaggtcaagagattgagatcatcctggccaacatggtgaaacctcgtctgtactaaaaatacagaaggctgggcatggtggcgcgtacctgcattcccagctactcgggaggctgagacaggagaatcacttgaacccgggaggcagaggttgcagtgagctgagattgcgccaccgcactccagcctggtgacagagcgagactccatctc

SEQ ID NO: 612653 - DNA, 400 bp, Homo sapiens
caggcaggcttctgggccctgcagctatggctcttcattccttttacatgttcttcgagaatcagctgcaccctggatgcttctgacagctcagaggacatcagcatgaggacaagcacagggcttgatggctcggagggaaatggagttggaagatttggacttaatgtgcacacattttagaaatatcttaacaaattttattttgctgatatctttcttttttgtgtgtgccaaagtgatggccagtacaaatccatgtctaattaagtccagaagagctccttcaataagcgtaagatgaaagttatgagtgataagaaagcgtcatgtcagtttaattggcagcattttctctttcttagtggttcataaaataaggcagtgctttgctatcaaa

SEQ ID NO: 612654 - DNA, 458 bp, Homo sapiens
cgtactacatcgtgttgtcatccatgacgagtattcattcttggctatgaatttttgtggttcgtggctgataaagcctgatcgcacattcttagcagtaattagtggaatccctgagctggttttggtaggcgtcctgccgcggtaatcaataaagcgagcaagatttccaagtcgggaatatgcccagccggaactaattttaagatactggtctttttgtggaacttcggtttgcgccttggtacgtaaaccttcctcaaccatcaatcgtaattgttctgcagtaatgctttttagcaactcaccggctggttcatcattcggatcttgcggtaccaactttccacgcacagctagctccagaatcagctcacggagcttttttattccgtctggcgcgcctgagagcagtggcagattctcggtcaacagcacggtcatgcctggcgctccag

SEQ ID NO: 612655 - DNA, 179 bp, Homo sapiens
cctgttgaagtcagtagcatcatgcaccgcactctagcctgggcaacagatcagacccatctcaaaaaaaaaaaaaattatatgggagtcaagggaagacccaatatacccaagacaatcctaagcaaaaagaacaaagctgggagggcatcatggctacctggacttcaaacctatac

SEQ ID NO: 612656 - DNA, 309 bp, Homo sapiens
  misc_feature (12)..(12): n is a, c, g, or t
  misc_feature (43)..(43): n is a, c, g, or t
  misc_feature (110)..(110): n is a, c, g, or t
  misc_feature (262)..(262): n is a, c, g, or t
  misc_feature (281)..(281): n is a, c, g, or t
  misc_feature (284)..(284): n is a, c, g, or t
  misc_feature (291)..(291): n is a, c, g, or t
  misc_feature (299)..(299): n is a, c, g, or t
atcaggccgggnagttttgtttgttgtgattggctgctatctncccagtgccctaaaattgccctggcatacagtaggcatttaataatcccttgaatcagtgaaaaccnagatggtggcttggcatttcccacataggcaatgagcccaggtggaaatcatccaggatataagtagatcttgaagtgataaggaagggtcatcataatccatgtggggcccattttgccctttcttgtttcttttctctaggctcagcaanagcctcacctaggactccntgnatcttgnagcccatntccacatgtt

SEQ ID NO: 612657 - DNA, 232 bp, Homo sapiens
gctctccgcggtgaacgcgccaccctgagctgtgagtcgactgtttgcctgtgccgaaggccgggccgtgaacattgcagggctgcctcagacctgcgtccacgtttggaaacgggagcttcgcgatttgtgtttacatcatcgactatgccagggagtctcagataagcctgttttattttcgcagtgaaaagccttaccgataactgactttatgcttgccctgggaccg

SEQ ID NO: 612658 - DNA, 822 bp, Homo sapiens
aactcggccgttgtcaccatgccggtcgtccggaagatttgccgtcgccgccggtggctgactcggagtcagaggaagatgagcgaggactcataggaggttcgattagaactggaagagagcagagaggtacagaacttgaggaagaggccctaacggggtgagtgctgtggccttgctggtgggagagaaggtacgagaggagaccactctagtggatgatcccgtttctagatgaagacaggtggtatggtggatatgaagaaatgaaggaagaggggcaacgattcagatcagtcgatggtacggaggaactgcacctggaggacatctgtttcctgcagtaagaccataccgtaaagggatcgacggatcgccgactttgatgtaaagtagattcgagactgatgctcatagaagaggaccgggatcgtggaagcatggatggagcagtagagagttaatgcgcagacgaatgcagaaggagctgtctgttatgaaacttcgcagagacatcatgcgcgatacctcagcacaagaagaccgcaaggagatgctttccaaacagatgctgactggcatgcctgaggtggaccctgggccatcgaatgctataacctagacgatcatatcatttccacggacggaatgccaaggaccagtcctgctggccagaagcagagcagagcagagaacgacagacaggcgaggacctccgttcgatggctagcaaacatggctgtgaatcatgtggccgcaccaacgactgtcattcatggaggacgctacaaagcgcccattgcgggaagcaggcaagaacag

SEQ ID NO: 612659 - DNA, 1557 bp, Homo sapiens
atccagtggagtcaagggcatggtggcgagaccagactagtgcgatgtgtgggctgtgtggcggagtgaatgacgctctcatggagggatggatggttgcatgtgcatgggtgtgatggatgctgcatgctggtgctgtgtgagccgaggaggcacttggcgctccgagatgcaccgtgggcacaagtgcgtggcctacgctgagagctgtgtcagaacgggcacgcccggagtgactctgagttgcctcatacatgactggtacggggcgcttgggatgatctgagtgcacagtgtcctccaagctagaggagttgggatcggttgccacagcaaatgtttgcgcgaagggcccaaagaacctgcccagggtgtccagaggtgcgaccgtttgaccatacggccaggtgaccagttgaccatttggtccctgaggttgcttgagcatgtgcggactggggaccactgaggtgaagcgccgccggtcaccggggccactttcccgtggaagacagcgcctataagggcagtggggtggtgcggccttttgagtgtgcagaagatggacaaggcagaggggctacgttggtgtcacatattaactctatcacttccccagcggagaacgctacaggggcaacctaccgatagtgggggccttggccacatccgtggggagcatcccccagggaaaagccttagaagaatacactttgtacccacggcagaaggtggcgtgtgcaataacccgcgaggacaatcaaaagccgcgtgggggccccctttttggaaacacttcccgggggaccacccaaaagaaagcgcccattgactaagccgttggggggcaccaaatgtggaacatctaaattggccgtgggacacctttgtttacccaaaagcccaaacttggcacacacttaaccccgtttgaagccttccgagtcgaaacctccgggggactttctctctgacaaagtgtgtcttgacaacggccgtcacgaatggggaaaaacaccgatagtaattccttatcagttacaggggcccccaaaatgtttctcacgaatgagctcaccccaattccgggacacccaggccgagggcgtaccgcgagtggtgtagagccccacaaacgcccgtggcacaccggggagtgaaactttcccaaattcattatacaaaatgggggccataaacccccccttagtgatgaggaggtagcaacaggtggttttgtagaccccaacagcgagggacagacaagagaaagtttcaatcacccccagaaagagcgaggaggaatacgatacccacgagcggggcgacaaaacaagagacgcggaccaccagacaggaaaactcagcactgacatcaacacaatgaggcacagacagacgacgagggaggcaccagatggagaccacgacgacagcaaccggcggtggcgaatgccgacaaacaacgacggccagagagacaacaagcacctccagcaacacaatatattgcccgcgaccccaaccatgagaaaaaaataaggacagcaagacgag

SEQ ID NO: 612660 - DNA, 95 bp, Homo sapiens
gagaatagggaagcgggtgaaggcccttttggaggagttccctgacaaaggcttcttctttgcctttggagctggtcatttcatgggcaacaaca

SEQ ID NO: 612661 - DNA, 122 bp, Homo sapiens
ctacccaacaaatggatatcaaatattgcaacaactccaaagtattgagcaaagtgcatttctacagtattcagtgttgctattcagttttctaacttaaaacagcctattagaactggctt

SEQ ID NO: 612662 - DNA, 870 bp, Homo sapiens
cgctaggtcgaggctgggtgttaatcggccgagggtagggctgggtgcttggacaggcctccaggtaataaataacaggtactagcaacagcagggccagatggggagttggggacaaatgaccctggtctcaggctttgggagctcttggggtatggttaggggttcaggggacagacgttagccaagacagaggaagcagcagcaggtacgggattcccctgtcttggggtatggttaggggttcagggggacagacgttagccaagacagaggaagcagcagcaggtacgggattcccccttcccccgtggctcagtcttgccccaaagccaggccccaccaggccaggaagggggacaggtggcaacgtagcttctccggggccaggcaggttaggacacggcctctcagagcctgggcctgggccccagcagggctggtcctggagaacaggtgagctggctccacagagctcagcagccacacggctgaggggccacggcctgggcactccgaggctgccgaagctggcggagggacgcatccccgtactgaatgccagagcccatcctctccgggtctagctcgcctgagtcaatcttgttgaggatagtgcgggcacacttgaggaacgcctcctccacgttctcgccagtgagagcgctggtctccaggaacatcagctcatttctcctgggcaaagcgggaggcctccaggaaagtgacctcccgctcagggtcccaggtccttcttgttgccacagaggatgaccacgatgttggggctggccagggtgcgggcattcgtcgcaggcgccgttgagttgtttgtcttccggtggtgatgtcgtaccaggggtccgcgcc

SEQ ID NO: 612663 - DNA, 194 bp, Homo sapiens
agccggccgtgtgtcagtagactagaaatatcattgaacatataatggttatttcttttcttggattccagaaaagcctcttacttttatgctttctcatcgaagtaatgtaccctttttttctcgaaactgaattaaaatactcattttatctcttgaaaaaaacacacaacaaaaacaacaaaaaaaaacac

SEQ ID NO: 612664 - DNA, 2108 bp, Homo sapiens
  misc_feature (937)..(938): n is a, c, g, or t
  misc_feature (955)..(955): n is a, c, g, or t
  misc_feature (1131)..(1132): n is a, c, g, or t
  misc_feature (1951)..(1951): n is a, c, g, or t
  misc_feature (1974)..(1974): n is a, c, g, or t
  misc_feature (2015)..(2015): n is a, c, g, or t
actcctgacctgaagtgatccacccgcctcgacctcccaaagtgctgggatgacaggcatgagcaccgcacccggccaacacagatgtttattgatcgtggaggataaattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggcagaaaagaaggtcatggcccctggctggcccccgccctgcagggacacagaagccacaccatttgcaccatccacgccttgctccagaaggcctggccgccttctccctgggggtgattcaaggatttggtctcggaccagaccccctccacagctgcccggccccagacccatctcttggattgagggtgtgtgggctggaacagtgggtcactgtggcagcttcatctgagccgaagtgtgggatcctctggtggctgtcgattgacctcgatgggaaggagcgttcnncccattttccttgtttncagtgctgcggtatcagtcagtgatctgaggaaatcctgtaggggaaggcaggctgcagtgaaaacaggagctggtgaaacgagccctctgcatctgcgaatgtgccctaggtgctgctgctggggacatggatgccgagcggaggcctgcgtggcctcctgagcagcagctgacnncccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaacaaacaaaaaataaaaaantcagggggccccgtacccaatcncctatatgagcgaatacattcactgccgtctttacaacgcntactggaaaccttgcgtacccactgatcgcttgatacaatccctttccacgtgcgtatacgtatttgtaaattcctaatttgtaaacactact

SEQ ID NO: 612665 - DNA, 205 bp, Homo sapiens
agaggcatgaaggtttagtgcaaagggagcacaaaagttgaagatgaggcgctgctatcaatgctgggacttcaggccaagggcatggcaactggtaggaagccacaatgggaggacattttctcgcagttcgctgaaccagtaaacaactagcgtcctgatgaaagccctcgtctcgtgcgaagagataacacgccagagcggg

SEQ ID NO: 612666 - DNA, 951 bp, Homo sapiens
gggagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatgatttcatttaaataaaaacctgtagtctgggcaacatcgggagaccccaactctacaaaaaatacaaaaattagctgggcgtggtggtgcgtgcctgtggtcccaactacctgggaggcggaggcgggaggatggcttgagcctggaagtccgaggcttcagtgagctgagatcgcgccactgcactccagcctgggcgagagagcaagaccctgtctcaaataaataaataaaaagataaaaacctga

SEQ ID NO: 612667 - DNA, 241 bp, Homo sapiens
  misc_feature (209)..(209): n is a, c, g, or t
tgcctagaggacccacgtaatatgtaacaaggtctaaataaggaatagtgatctggaaagacatgagcggcatgattgaagcaatattcatattgtgaatactgagaatgaaggccgtgaggtacagtgttagcaattacaagttaaagaatttggattttatcctgcttaagtaggattttatttatgggaggttcatgaacggtgtngacaaacgatagtgaggttacatattacgggt

SEQ ID NO: 612668 - DNA, 114 bp, Homo sapiens
tgagctcggtacccccatgcactttgtcacagctatatgtgactgagaagaatgccccctcctcccaacatgaccaccaacgagaggagagtcatcgtccccgcagaccccaca

SEQ ID NO: 612669 - DNA, 1130 bp, Homo sapiens
gggagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgctaccctcgcgtagcatttcctgtggttttccaggactccgct

SEQ ID NO: 612670 - DNA, 204 bp, Homo sapiens
ccctgaaaaagcggcaaaagacagaacgacagcagaaagaaacgaaaaagaaagacacaagtacagaaagaaaaaaagaaacgaaacaaaaaacagaggaccaaaaacgtagaaagaaaacaaaacaaacaacagaagacaaaaaaaaaacacatagacaacacaaagaaaacacaaacaaaaacaaaacaacaacacaaataa

SEQ ID NO: 612671 - DNA, 516 bp, Homo sapiens
  misc_feature (10)..(10): n is a, c, g, or t
  misc_feature (49)..(49): n is a, c, g, or t
  misc_feature (320)..(320): n is a, c, g, or t
tttttttttntttccagggggagggaggaaagaaaggagggggtccaanctgtccccaaaaaggaaaacggttaggttttaggaggggcacaaacaaggccggccaaagttgtcctctcataaggtggtatgggggggtggggtcaggcccttaacattgtccttctttagaatttgtccggggaaaaaatccaggggagccggaggaaaaacccggagggccccaggcaaaaaaaaaatggagttttttgggcccgggtgaaccaagggtccaaggcccataggtgttttcttgggggggggggaaaaagccagggggncccctccccttttcccccccaggtccagccctggttttgtttttttatccctttttcccccgacaaaaaaagttgtggccccggcccagttattgtgtttctgtgttccctgcatggaccccccccccccccccttccttttgggggggccccctttccataaatttttaataaaatcccgtttttgggtttggga

SEQ ID NO: 612672 - DNA, 911 bp, Homo sapiens
gcgtgtggtcctcaaatatgcgcgccagtgtgtctggggtgcgcggctttcacacttgcccaccggggttttccgcccccccgtttgctccgtaccgcgcagttcccactccgtgtggggccccccacctttgggggtccctttcgccacaacacccggtgccctggtcgccgtaatcccccctgcggggggccgcgcctcccccccgcggccaagtgtcccggagtgctcttaaccacctccctcggcctttatactgccccaattctgccgcttcttgggcggcatcctctctttggccatctctgctcttcattgcctcctgggggttctacgcccctttctcgtcagtctggcccatcccgatgtccggccccggtttttctttccgccacgctgatcccccctcttcaagtgagacgggggttaacccccccgcgctcctcggtgggcccctcgcccctgggagtgcatctcggccccccggcccccttcggtcagtcctccggctccgcgtgttgtttgcccccgacgagacgcccaccctttttgggtaggccctccttggggccccccccctccctatgacttgggggggacagcctagcctttctccctcgatagggggggtccccccggctcctggtgccctccagtcggtgggtccccgaggaagggtggctgttgccacgaatatctgcttctagacgaggttccctatccagccacgcgcagattgaaagccggcttctctggcccccggagatttgctagcggccgcccctctccagtatgttcggtgctgtgtaggctcggaacgtcgtcgcccccccgctcctcatagcgccggcctttctctgtttgaacgcaagagcccgggggccccaagcgaaaaaaacttttctcatcat

SEQ ID NO: 612673 - DNA, 681 bp, Homo sapiens
gggagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaaca

SEQ ID NO: 612674 - DNA, 912 bp, Homo sapiens
tcagacgccttttgctggcgttgtcagacttgctcagattccccagggacactttgaccggccagctcccaggcccagtgcagggttccctgcttgggttttcctggcctgaggggctgccatgctctcatacgcgtgctttggtacctgcagcccccccagactgcagcctggagggcaccagcgaccctgccatcggccggggaagaaggacccaccctgttaaggatggacgcctgggtgtcaaatcggttttgctcattgatgtgtatctgtccacttcagaaccggcgtcctgcatagagccgcacggtgcatcggcgcattttccctgcgggaggccgcggccccactgcgtgtgcctctcctggtgccctcctgccggcgtccagcagccctgggagacatggggaggcgggccctgggcaccctgcgcgctggcggaaatggcgcccagggcctcactgcgcctttcttgtcacaggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgctaccctcgcgtagcatttcctgtggttttccaggactccgct

SEQ ID NO: 612675 - DNA, 421 bp, Homo sapiens
  misc_feature (74)..(74): n is a, c, g, or t
  misc_feature (102)..(102): n is a, c, g, or t
caggataacaacgaacaaaaagccaaacaacttcccggcagccagtatagtgtggcagtgctgagaccaaggancttaagtatcggacaaatgcagtttganaccagaatcttccacttacaggcagttattaaagttctctaaatttccatttcttcactaagttgttgccaggattaaagaaaataatgcatctaccaagattagcataatgttttacgcacagaaatgtttccaatgaaggaaagaaagatgacatacaaaaaaaaaaagaaagaaagatgacatgcacagagcagtgaatgagtaatgtttaactttaaacatctaatgatatctggttaattttagcaaacacaaagatttttggcagatggctttagtctgaagctcgcagcataacacctggtagggacgattt

SEQ ID NO: 612676 - DNA, 751 bp, Homo sapiens
ccagtctgctgccactgggctgtatgtaaggcggttcttctgtccaccccaccgctactggactctcttccctgtagacagggtctcacgctagttgcccaggttcggagtacagtggcacaatcagggcctacactgacaagcctatgactttaccaggttcaaacaataccacctgcctcagcctcacaagtagctgggactacaggcatgtgcaaccacacccgtgctaattatatattgaattcctagtggagacaaggtctcattatgttgcccaggctggtcttgaactccttagcttaagcaatcctcctgcctcagcaatcccaaagtgctgggattatgggcgtgagccaacatgcctggcaatatctaccctatctcgaaggctgaaataacattccatgatggtcctagaacaataggagatacatacgcacacaaagaacctcaacccttacctcacaccagaccaccaaacagctaccttccactaaatcataggcctaacttgaaccacctaaaaccatgccactccagaaagtcccgccacgacagaaaaaaccggagcacaatctacgggaccttggagtaggccaccgcatcccctaaaagaccacaacaacgcccgcaagctcatacacggggcccacaactcacacacaactggcactcccacccacagaaacaacacacccaacacacaacgcaagcgcacaccataacgcaaactgcaaccagcacagcc

SEQ ID NO: 612677 - DNA, 1229 bp, Homo sapiens
gggagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaagcaagtctgttaattttttttctttattttcattactgttaactatggagttctcgcaagagtttgtcacggtcaatcattaccagtatgatcactaggaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgctaccctcgcgtagcatttcctgtggttttccaggactccgct

SEQ ID NO: 612678 - DNA, 309 bp, Homo sapiens
gaacaaatatctcgcgtgacgaccctggacatcgtcagagccaatcacctctgttgcagagcttaagggtttggatccagctcgagtcaacatccctgtcataggtggtcacgctgtgaaaaccatcatccccctgatctctcagtgcacccccaaggtggactttccccaggactagctgacagcactcactgggcggatccaggaggccggcacggaggtggtcaaggctaaagccggagcaggctctgccaccctctccatggcgtatgccggcgcccgctttgtcttctccccggtacatgcaag

SEQ ID NO: 612679 - DNA, 1129 bp, Homo sapiens
cacagcgtgagttcatgtcagcctacatctttgccacaacttggcgttggctgactttagttgttgccagtctggtgagcacatcatggtgtcttgtgcagggctagcttttcccccatttctccatcagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgctaccctcgcgtagcatttcctgtggttttccaggactccgct

SEQ ID NO: 612680 - DNA, 1934 bp, Homo sapiens
  misc_feature (937)..(938): n is a, c, g, or t
  misc_feature (955)..(955): n is a, c, g, or t
  misc_feature (1131)..(1132): n is a, c, g, or t
actcctgacctgaagtgatccacccgcctcgacctcccaaagtgctgggatgacaggcatgagcaccgcacccggccaacacagatgtttattgatcgtggaggataaattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggcagaaaagaaggtcatggcccctggctggcccccgccctgcagggacacagaagccacaccatttgcaccatccacgccttgctccagaaggcctggccgccttctccctgggggtgattcaaggatttggtctcggaccagaccccctccacagctgcccggccccagacccatctcttggattgagggtgtgtgggctggaacagtgggtcactgtggcagcttcatctgagccgaagtgtgggatcctctggtggctgtcgattgacctcgatgggaaggagcgttcnncccattttccttgtttncagtgctgcggtatcagtcagtgatctgaggaaatcctgtaggggaaggcaggctgcagtgaaaacaggagctggtgaaacgagccctctgcatctgcgaatgtgccctaggtgctgctgctggggacatggatgccgagcggaggcctgcgtggcctcctgagcagcagctgacnncccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaaca

SEQ ID NO: 612681 - DNA, 1068 bp, Homo sapiens
gggagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagacgttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgctaccctcgcgtagcatttcctgtggttttccaggactccgct

SEQ ID NO: 612682 - DNA, 855 bp, Homo sapiens
  misc_feature (698)..(698): n is a, c, g, or t
  misc_feature (721)..(721): n is a, c, g, or t
  misc_feature (762)..(762): n is a, c, g, or t
gggagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagagccgagggtctgccctgtcctaggttaggtcttcatggtttagagtaaaaccgtgagggatgttaattatgggcattgaagacttaaggttttcctaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaacaaacaaaaaataaaaaantcagggggccccgtacccaatcncctatatgagcgaatacattcactgccgtctttacaacgcntactggaaaccttgcgtacccactgatcgcttgatacaatccctttccacgtgcgtatacgtatttgtaaattcctaatttgtaaacactact

SEQ ID NO: 612683 - DNA, 491 bp, Homo sapiens
gaggtaccccctgcagcagacaacagcataaatgggacatcgttgcagaatgtaaacagtcctcaaagaaaaaatgactatcaagacatagcaggcaagtgcagtggctcatgcctgtaatcctagcattttgagaggactagacgggtgcatcacttaaggccaggagtttgagaccatcctgggaaacatggtgaaaccctgcctctacaaaaaatacaaaattagctgggcgtggtggcatgcacctgtagtcccagctactcgggaggctgaggcaggagaatcgcttgaaccagggaggtggaggttgcagtgggctgagattgcgccactgcactccagcctgggtgacagagactctgtctcagaaaaaaaaaaaaaaggagaaggaaaatttagatgggtgtggtggcatgtgcctgtaatcccagatatgggggagcctgaggcaggagaatcgtttgaacctgggaggcagaggttgcagt

SEQ ID NO: 612684 - DNA, 659 bp, Homo sapiens
gaccagaggatctcgctgccatttccaagcatgcaactaggaaaacattctttatgctcacagattgtatataacctcaaaaaccaagtatacacatttaaaaagtcatattcaggttgggcatggaggctcatccttgtaatcccagcacttagggaggctgaggcaggaggatcacttgaggccagtagttagagactagcctgggcaacatagcacgtcccatctgtttaaaaattgaaaaaataaaaaatcagcaagacatggtggtgcatccctgtggtcccagctactggggaggctgaggcaggattggtcgagcccaggaattcaaggctgcagtgagccatgatcgcaccattgcattccagcctgggtgacagagtgagagcctgtgtctaaaagaaaaaaaagaacaaaaaagtcatatccacaaagcatctaatttcaggttatagataatactgtcaatgaaagtacctttcctggttgcagtgcgaatgtagtctgggctgcttccacgcatgctcttatgactttcacgcctgacttaacggtctgaggtatgagggtcccacttacacaccactttcttctcccagagaccgcaggcaaatgtcggtgtggcatgatgctgtgacttatttggccctagatgg

SEQ ID NO: 612685 - DNA, 641 bp, Homo sapiens
  misc_feature (18)..(18): n is a, c, g, or t
agcggctgagcattcatnggtcatggggatatggggtcatcgggacatggtgtttctggtagaaatttggtccttgcaggtatcaataagctgctttccttaaccataaacatcttatgacggtgactcgtgcatgagctgtaaggaatatgtctggctagtttaattggactttgaacttggtcacccatagctctcctaggtttccggctttaacagttttatccatttcagtgcaacattagtcctaagcacaatttatggagacaccagttctctcgttaagtgtatctgacagaacgtgagcttcggccccaagaaacatagtattagcaatactaagtgaaatatcaggaagttcaatgtatgtatataatggatcatttagtatggctcagcgctagcgctgagcattctgtgttacactagagtccacagggcatttggagtgtagacgtgagtgcttaaacatattggggttcctctctcaggtttaaaaatgtttcaaatgtaatggtggctcatcagtgcagttatcaatgcaattttatatcccttgaggggagaaagaggggtctcatggtacatgtccaaggggggtgataagagtatcatctgttcacttaattggaacaaccatg

SEQ ID NO: 612686 - DNA, 874 bp, Homo sapiens
  misc_feature (151)..(151): n is a, c, g, or t
  misc_feature (176)..(176): n is a, c, g, or t
  misc_feature (212)..(212): n is a, c, g, or t
  misc_feature (214)..(214): n is a, c, g, or t
  misc_feature (220)..(220): n is a, c, g, or t
  misc_feature (226)..(226): n is a, c, g, or t
  misc_feature (228)..(228): n is a, c, g, or t
  misc_feature (234)..(235): n is a, c, g, or t
  misc_feature (239)..(239): n is a, c, g, or t
  misc_feature (270)..(270): n is a, c, g, or t
  misc_feature (313)..(313): n is a, c, g, or t
  misc_feature (335)..(335): n is a, c, g, or t
  misc_feature (341)..(341): n is a, c, g, or t
  misc_feature (383)..(383): n is a, c, g, or t
  misc_feature (392)..(392): n is a, c, g, or t
  misc_feature (432)..(432): n is a, c, g, or t
  misc_feature (436)..(437): n is a, c, g, or t
  misc_feature (451)..(451): n is a, c, g, or t
  misc_feature (453)..(453): n is a, c, g, or t
  misc_feature (476)..(476): n is a, c, g, or t
  misc_feature (499)..(500): n is a, c, g, or t
  misc_feature (527)..(527): n is a, c, g, or t
  misc_feature (541)..(541): n is a, c, g, or t
  misc_feature (550)..(550): n is a, c, g, or t
gcacgcctcaggcaactggttgtgaccgaggaagatggcggtgcctgacccgaggcgctagggaagatcgcaccgcggacgcccgctgagcttggcgcacgggccgaccaggagctggtgactgccctcatgtgtgatttgcggcggccancggcaggtgggatgatggacttggnctacgtctgtgagtgggagaaatggtccaagagcancncagtgnccatcngntgcccnntggnctgcgcctggtcctgccgaaatctcatcgcncttcaccatggacctgcgcagcgatgaccaggacctgacccgnatgatccacatcctggacacgngagcanccctgggacctgcactcgatcccctcagagcagcacgaggcnatcacctgnctggagtgggaccagtcaggctcccggctcctgtcagcanatgnncgacgggcagatcnangtgctggagcatggcggacaccntgggtaatagctgggagagctcnngtgggcagcctagtggagggggacccnattgtggccctgtnctggctgcncaatggtgtgaaactggtcctgcgacgtggagaagtcgggcgcctccagcttcggggagaagttctcccgatgtcaagttctcaccgtcgctcacgctgttcggcgggaagcccatggagggctggatcgcggtgacggtcagcggctggtcaccgtgttccccggcttgaaatcgcaatgggtcaaggttgatgaccgtcgaccggagagcctgtgccggctgctcggacgcgtggacctggacgacatggcttcaacgtcggggaaacatcgtggtaggccaggaggaggaagcacgcgtcgccgtgcgtatcaaagtgtgc

SEQ ID NO: 612687 - DNA, 150 bp, Homo sapiens
tcgaagatggcggtggtcagatggccggtggctacttggtgtctgtaccacaatccccaagaccttctcacccaggactgggctggaattctgtccggaacagggctggctgctgaagtccaccaggaggagtctcttctcagcctcccc

SEQ ID NO: 612688 - DNA, 627 bp, Homo sapiens
agcggatggtccccattgcctgctgcgcacccgggacgtgcggctcccctccggactcctcgccatggacgcggacgactcccgggcccccaagggtctccttgcggaagttcctggagcacctctccggggccggaaggccatcggagtgctgaccagcggcggcggatgctcaaggtatgaacgctgccgtcctgtgccgtggtgcgcatgggtatctacgtgggggccaacggttgtacttcatctacgagggctagcaggacatggtggacggaggctcaaaccatcgctagaggccgacatgcgagagtgtctccgagcgatcctgcaagtgggcgggacgatcattgccagtagcggcggtgccaagcgccttcccagcacggctggggaaggagcgcgcctgaaaggctggctatcgcaaccctagctagcaagcagcttgattacaccaaccttgtgttgttgatcgtgcgggggaacggggatcctcacccgagggcgcaaaccttctttgccagtgagggaggagtagaagttgggccttgcttggcaggaggcatgcccaggaaacagtcagattcggatgatcgatggccgccggcaagaagtaggcctaccctc

SEQ ID NO: 612689 - DNA, 340 bp, Homo sapiens
agtgatgtatttcattagcagcatacagaggcaggaaggactgaagagagtttggagaagaaataaagaagcaaggatgagtagcatattcaagatctcagaagatacattcattaagcataaatgctaggttatttttgtaacagtagaacccttttcatcaaaataagagatagatgaaaatggctgaaatcattctaagatactgcatgaaaattgagggagtttttgaacgagtatgtggtacttgtatcctgatggttaaaacagatgaaaagctaaaaagtccttcatgggaaaaatcattaaagtatcctcttggttaaaaacagatgaaaag

SEQ ID NO: 612690 - DNA, 357 bp, Homo sapiens
  misc_feature (13)..(13): n is a, c, g, or t
  misc_feature (98)..(98): n is a, c, g, or t
  misc_feature (167)..(167): n is a, c, g, or t
  misc_feature (301)..(301): n is a, c, g, or t
  misc_feature (322)..(322): n is a, c, g, or t
ttcaaatgtattntttgttagaatttaccctagattcttatttaatgtctgcagtagactgaatgtttgtgtgcccccagaattctaatgttgaaatntcatttccaatgtgatggtatttggaggtggggcttttggtaagtgataggtcaggagagtaacagcgntcatgaatgggattagtgcccttatataaagagacccagagagctccatcaccccttctgccatgtgaaagggagaagacaaacatccacgaaccaggaagtggtcctcaccagaaaacaaatctgtaagcacnttgatcttggacttcccagcntccagaattgtgagaaataaatttctgttgttgat

SEQ ID NO: 612691 - DNA, 221 bp, Homo sapiens
aaagggttttttttcctttgggggggccccccccaggaaccaaaaagctttggaaaaatgggggttccctaaaaacccccgggggactggggagggggttttttgccaaaccattttccccccaaaaggcaggtagggggggggggaaaatttttttttcccccccgggaaaacccaattgggaggggcctagggcaaaaaaaaaaatttttgccccggga

SEQ ID NO: 612692 - DNA, 320 bp, Homo sapiens
  misc_feature (171)..(171): n is a, c, g, or t
  misc_feature (309)..(309): n is a, c, g, or t
tttttttaaagagacagggtctcattctgttgcccaggctgcagcgtagtgatacagtcatagctcattgcagcctcaaactcctgggctcaagttatcttcttgcctcagcttccagagtagctgggactacaggcgtgcaccatcacgcctggcttgtctgtgtatttnctttactaaggtgtctgctcaggtcttttgcccagtgggtttctttgtttgtttttgttttgagagacagagagcctcactctgttgcccaggctggagtgcagtggtgcgatcttggctcactgtagcctccgcctnctggggttcaa

SEQ ID NO: 612693 - DNA, 134 bp, Homo sapiens
  misc_feature (52)..(52): n is a, c, g, or t
  misc_feature (96)..(96): n is a, c, g, or t
aaggccctgcagaccacctatggcaccaacgccccccgcatgacctcggccngccctgcgctggatgtaccaccactcgcagctccagggcacccngaggggacgcagtaatcgttgggcaatgtccaagtttc

SEQ ID NO: 612694 - DNA, 1057 bp, Homo sapiens
gtgttctttgagaacaccattgtgtcctgcattgcccgcatctgcaaggtgcgatgacggtgtggagagctggtgtgctacatgcagcgctggacctccttcctcaaggcccagctgctgtgctcactgtgccctgacgatggcttccccttcaactgtgctgcagtgatgtcgttcacgctgagccccatgccccatgtgactggctgttgacaccccttttctattgtgtgtgtcttcacatatcccatgtggcacatgggtgaactacatgaagtgctctgccggtctgtgtcttcacaattgaacgtgatgtgcagacgatgtcttcagtcgtgcctctacaattgagtgttgaacctgtgatgaacacagcacgttggtacacctgtgacccacacctggttgaccacacccctgggccttggagcgttgcatcagccaagcagatgccctgggaacaggacacgatcaactcatccctggatggtcccagaacctgctgttgctgaagctttctcaatggaccacttccttgaatggactgggcatggtccgacagacctgacattgcattggcttggcttgcatgaccccaagtgactcaggcttacccacggcgggctgttggcattgtaacagccctgactagtatccattggacccttggcagacgagaagccgtagcgaattgtaccgtacgttgccttgggagcacacttggcgttggcactagtggcctgtagcgtacagcacaacaagtggccacaagtgagaagccaggtaggagtgcccccacgcgtggtgattagcgaaccaagtcacattttcgaaggtgagatgactttggcgaagagattccgttaccgtcccagttacgtctgtgaccatagcgcccggctggcaacggaaaaatgtcttgcttcacctttggagaagaaccgaccaccaggtggggcgcacattggagtggtacatagccgagcgcctgtcaggaccgtacgtgtgtggtcggttagggtccccaaggggttggcgcacagttgtcgggcagaca

SEQ ID NO: 612695 - DNA, 156 bp, Homo sapiens
cccacctgcttattccacttgcctctgtacaggtcactgtgacgctgggtcccagctggctcagaccactttttggctccgggcgtatttttctcaaccaatggttgccgcagctgtcattgtccacctggtgacggatgggacatattatgggga

SEQ ID NO: 612696 - DNA, 1071 bp, Homo sapiens
cggacgcgtgggttagcgcagattggacagtggactcatccatgctatggatacaagtcccgcccactccaaagtccacggcatccaaggggatgcatccatgggtagaggaaggaatcctcggccctctggctggaagctgcatacctgaacgtcgacgtccgcaggcctcatccgtgggaagctcttcctcaggccatgcgtgtcaccttgccctacccaggtgtaagcctcctcgatacagctgtgtggagcttggacaccctatcatagaatatcgatggaggtctccatgcactagacgctcattgccccaagaatgcccaagggttgcgatgcacatactctgggataaccgagttcagtcatcacactattatctaggtagtcctgtacgccgcatacgtacaggttcttcagtgtgtgacatgactctccaggcacagctctgcgtgacagccctctggctgaaacgcatgctgcaccaggagcacgaagggggcagagaaaaggagcacatgcaggtggtgggagctacatctttctaggccctcgctgtgggtggatgtttcgtgcggcaacaagggaatcgacatcatcgtgggactgggaagaggggcatacaggacggcgcctcgtcaaattataggtcaagctagcataacatgtaaggacgtggttcacctgcattctacttggaggctcacgatttaacactattctttccccttggatggggccaatttacagaccatcgatctccccttgtgccctcctcaacttacacaaagaccacctggatatccgccatcaaccttgcgcgtgaagggtacacgcgctgggcgcatgcaaacccggacgaaacgggatgggcaacgccgcagctcacaggaggtgtggaacagcgatacaatacagattcaactaactcagggaataaaccagcacacaacatagaaccttgacacaaatcaaaaaacacagcaccagcagacacacaacagaccacaaaacaaaagaccacaacaaaaaccaaaaaaacgcagagcccgcagacacacaaatagcgcc

SEQ ID NO: 612697 - DNA, 314 bp, Homo sapiens
tggaagtgtgtggtgtatgcatgagacatataacggctaagtaaacttatggccaatggttggcttacagcgagtttagctactctaggatcacatccagaccgcggctggtatgtgaactctagaggtgttatatatctgtatagatataaattaataattgcttaaaaatgtcatatatgccatatcatatcttcattattcatacatacctgtgccatgatatacctgatagcatctgcattgtttagtatactatgcatgctatatctgtttatttatttgcatgtgcatacatatttgccataacacca

SEQ ID NO: 612698 - DNA, 150 bp, Homo sapiens
ctcgtaagctgcacattgatgattaaaagcaatacgctgtctgggggaattcggacaatttatcttccatatgctctttaagtaaaagtttcaaagacagttttaaagggagccatgctcttaaaggcagttgattaaagaacctgttac

SEQ ID NO: 612699 - DNA, 255 bp, Homo sapiens
taagtgacgatctcgggctgctttggtactaggtttcttaccttctttatttaagggctttcttacaacatactggcggacatcatcttctttagagagattgaaaaagctagcagaatccgcaaacttttcaatctctctaaagaagatgatgtccggggtaccggagcctccggaaaatttcggtaaattcattgggtccattaggccttggtttttcccccttggttgttggaaaaattggttatccgctag

SEQ ID NO: 612700 - DNA, 743 bp, Homo sapiens
  misc_feature (1)..(1): n is a, c, g, or t
  misc_feature (8)..(8): n is a, c, g, or t
  misc_feature (96)..(96): n is a, c, g, or t
  misc_feature (102)..(102): n is a, c, g, or t
  misc_feature (109)..(109): n is a, c, g, or t
  misc_feature (128)..(128): n is a, c, g, or t
  misc_feature (132)..(133): n is a, c, g, or t
  misc_feature (138)..(138): n is a, c, g, or t
  misc_feature (154)..(154): n is a, c, g, or t
  misc_feature (160)..(160): n is a, c, g, or t
  misc_feature (171)..(171): n is a, c, g, or t
  misc_feature (175)..(176): n is a, c, g, or t
  misc_feature (183)..(183): n is a, c, g, or t
  misc_feature (202)..(202): n is a, c, g, or t
  misc_feature (208)..(208): n is a, c, g, or t
  misc_feature (230)..(231): n is a, c, g, or t
  misc_feature (261)..(262): n is a, c, g, or t
  misc_feature (265)..(266): n is a, c, g, or t
  misc_feature (277)..(277): n is a, c, g, or t
  misc_feature (288)..(289): n is a, c, g, or t
  misc_feature (299)..(299): n is a, c, g, or t
  misc_feature (304)..(305): n is a, c, g, or t
  misc_feature (314)..(314): n is a, c, g, or t
  misc_feature (324)..(324): n is a, c, g, or t
  misc_feature (326)..(326): n is a, c, g, or t
  misc_feature (344)..(344): n is a, c, g, or t
  misc_feature (346)..(347): n is a, c, g, or t
  misc_feature (349)..(349): n is a, c, g, or t
  misc_feature (351)..(351): n is a, c, g, or t
  misc_feature (354)..(354): n is a, c, g, or t
  misc_feature (381)..(382): n is a, c, g, or t
  misc_feature (387)..(387): n is a, c, g, or t
  misc_feature (391)..(392): n is a, c, g, or t
  misc_feature (396)..(396): n is a, c, g, or t
  misc_feature (399)..(399): n is a, c, g, or t
  misc_feature (401)..(401): n is a, c, g, or t
  misc_feature (430)..(432): n is a, c, g, or t
  misc_feature (435)..(435): n is a, c, g, or t
  misc_feature (634)..(634): n is a, c, g, or t
  misc_feature (640)..(640): n is a, c, g, or t
  misc_feature (643)..(644): n is a, c, g, or t
  misc_feature (647)..(647): n is a, c, g, or t
  misc_feature (650)..(650): n is a, c, g, or t
  misc_feature (663)..(663): n is a, c, g, or t
  misc_feature (683)..(683): n is a, c, g, or t
  misc_feature (731)..(731): n is a, c, g, or t
ntacagcngtgctcaggaagtttctggatcataggctcagctccacagaggagaacacgcaggcgcagagaccatggggcccctataagcacctanatgcanaaagaanataaactggaagggggtantgcnnaaagnatcaattttaaacttntggaanatgcatataantgcnnaagtaangattgaagcactgcaaccnaaagtntccgaggggaaggatgtacttnnacttgtacaaaatttgcataaaaatattgnnggnnaaatctggaanaaaggaaaacnnaaggacctanacaannaaattaaanaaaatgtagnanaaggtaaaataaatatananngnantgnataaactggacgagaaaaagtatatannaatgnatcnntgcngancnagaatgataacacagggaagacgcaggannntanaccttaaacataataaagcgaggtgataggactagaggagtaactggatatttcaccttcaacttatacctgaagctgcccaagccctacatcaccatcaacaactcaaaacccagggagaataaggatgtattagccttcacctgtgaacctaagagtgagaactacacctacatttggtggctaaatggtcagagcntcccgnttnnttnttntggaaagcgaccnattgaaaaaaggatcctcantccacccagtgtcacgagaaaagaaacaggaccctatgaatgtgaaanacgggaccgaga

SEQ ID NO: 612701 - DNA, 80 bp, Homo sapiens
gggacggtgcccaagccagaggctgggttcatttgtgtaacgacaataaacggtacttgtcatttcgggcaaaaaaaaaa

SEQ ID NO: 612702 - DNA, 960 bp, Homo sapiens
ggctttcctggggaggcgacgccgggtgcaagtgcaggagtgggcgaggaggaggaggaagaggaggtgatggcgacgcgaccaggggcgggggagatgctccgcctagctcagacgccacgcaggttgccgtgacccttccgggtgacatacccggccttggggcgccaatgatttgatgcccggagcgcagttaagctcaaggcatcaatggcatgggacttaggacaacaaggacagccaacacgaactcaccggaacactaacagcgccaggcaaacccagcacaaaaatagctcctgaaaggcaatttgcattgcgcgcaacacataccaacagtgggatctccagtggtcaaccagatgccacggacccattcatactgcctatcaatgggtgccattccaaaaagcaaagagaagtgtcaagcaaaaattcacggtcagtgaggcgagggttggtggtacttgggaatgaatctcaagagcaagtggtaacaaagtaacgtcagatttaacatattgtgtgctggagtattgtgaattagaccataataaatgggaatcacaggagagttaatatttcaggtggagggttaaaaagtcctgtgggtggtagctaccttagggcagtgtgcttatatccatatggggctagtagaaatcaaggttatcagggccacaagtgggctgagtaatcccaggaaagagcttacattgtaatagtttcgaaactgtgggactattggggtataaaaactcgttgggacatagatacctacaaatagttaagtgtagagttgtactggatcgaggagggaaataaggaaaggtaaatgtgaataggtgttgcatgtaggctggcagttgtccagtgaaattggcataaacgggggggatcgagaagagaggagatagacaaaaacgacaaagaaatggaaaggacaggcaaggagagacc

SEQ ID NO: 612703 - DNA, 187 bp, Homo sapiens
ccgtggtttatgaaccttggaataatgagaagataggagcataacttcgataacctctgcctttcttctgaaatgagtgctgtttaaagtatttcttaatttacaaaaattgatacatcttcaagatgttggggagatggaactctgtactcacattagccagaataccagatagttgtagattgcg

SEQ ID NO: 612704 - DNA, 103 bp, Homo sapiens
aagtgattcaaggactccaggaccccttttaaaagcctttctaagaacatgataggcttacttttgctccataataaagtgggagaaaaaagcccgaatttta

SEQ ID NO: 612705 - DNA, 149 bp, Homo sapiens
gggcggcctctggcaagggtctcatctctctctctctgggtctctgtctcctctgtctctgggtctctgttctccctctgtctctgggtctccatctctctctctctgggtctctgtttccctctctctgggtttctgtctccctctgt

SEQ ID NO: 612706 - DNA, 592 bp, Homo sapiens
aggtttggtccaaaaacgggggtgggccggggtccggatttccgggattttcgcgccccccctgtccccgaacggtgggtccgccgcgtggggtcccgcacgcgtgggcggaacgcggggcccgtgtttttttgggccccaaaaaaccccctccctgtggtttgttccccccttccaggggggtcggtgggggacatgtattttttccctttctcccagaacccggggctggttctgggccttgtttgggggggacggggccgatttccctgttttcctcccccccgccccggggttttttgggttttcctccggggcccgcccccacgggggtgtttcttggggccagttccgggggggtgccccgcccgtccgggtttttttttaccccccccgggttttcccccgggttgggggtggaccctttgccccgggggtgggtgccttcttgccttgggagaaccgggggttggcggggttcggtccccggggggttttccccccttttttttttttttttttgccggccccccccccccccccctttttgggcgggtcggttttttggttttggggggtttttgggtccctc

SEQ ID NO: 612707 - DNA, 236 bp, Homo sapiens
gtgtaacactgcactgcattcttgctagtgactgatacatggcctcgcagccgactgacacttgacaagtctggtattgaccttgaggttcccatatttatactgagtgttgaaggctgtgactgttacttgccaagttgaaagctctctaattcttagacggatagaccttactgtatacgctggatgactgtcattccctactcaccgttgctagatcattagcacagagtctt

SEQ ID NO: 612708 - DNA, 113 bp, Homo sapiens
gatgggagtatcactgactgtgttttaatgtatctgatgtgtagatagttggatatattatagtaccgatgatcttagtgcgaagtagtgatcactgtattgctgtgatgtgt

SEQ ID NO: 612709 - DNA, 1313 bp, Homo sapiens
  misc_feature (355)..(355): n is a, c, g, or t
  misc_feature (370)..(370): n is a, c, g, or t
  misc_feature (376)..(376): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (910)..(910): n is a, c, g, or t
gttttgggccgcgtgcccaaggacgcccctttcgccccaacggtctcttggacaaagccgcgagcaacgtgatcgcctccctcacctgcgggcgccgcttcgagtacgacgaccctcgcttcctcaggctgctggacctagctcaagagggactgaaggaggagtcgggctttctgcgcgaggtgctgaatgctgtccccgtgctcctgcatatcccaacgctggctggcaaggtcctacgcttccgggacccagaccagaccccccgagacctgactgaggccttcctggcagagatggagaaggccaaggggaaccctgagagcagcttcaatgatgagaacctgcgcatagnggtggctgacctgtnctctgncggnatngngaccacctcgaccacgctggcctggggcctcctgctcatgatcctacatccggatgtgcagcgtgagcccatctgggcagtgcaggggccgagggaggaagggtacaggcgggggcccatgaactttgctgggacacccggggctccaagcacaggcttgaccaggatcctgtaagcctgacctcctccaacataggaggcaagaaggagtgtcagggccggaccccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgttncaccccgaacacttcctggatgcccagggccactttgtgaagccggaggccttcctgcctttctcagcaggccgcgtgcatgcctcggggagcccctggcccgcatggagctcttacttttcttcacctccctgctgcagcacttcagcttctcggtgcccactggagcagccccggacagccatctgccacccatgggtgatctttgcctttccctatgggtagaggcccattccccccttattaaggcctttaggtagctatagccccggttaaaaatgggggtaaccataatcccgcaaggcttggctcacctagccacaaaggcctcaaatagtaccacaatcaaagcacatgtggataagttcccacaaaagcaataccaacaaacaacagaaacaaa

SEQ ID NO: 612710 - DNA, 514 bp, Homo sapiens
  misc_feature (60)..(60): n is a, c, g, or t
cgtgggggactagttccaggacgccgctgataccaaaatccacaggtgctcaagtcccgnacatgaagtggtgtcgagtctgcacagaagctatgcacgctgccccccaacgcgctctacgccatccccagattacttacgacacttaacacgctgtgcacgccaccccccaccactttacgccatccccagattacttacgacacttaacacgctgtgcacgccaccccccaccactctacgccatccccagattacttacgacacttaacatgctgtaaacactatgtcaatggttgttctactgtatttttaagatgtgcattattgttattgttgtactgttatttgttattgttttggttcccaaacattttcaatctgtgttgactggacccatggattcgggggagctggccgtgcactattaaaccgggtgcacctaaagcaggtgacgtccgagcacggacaagatatgatgaacttgaccctaataaaatggaaagtttacgtg

SEQ ID NO: 612711 - DNA, 278 bp, Homo sapiens
gaaaccttagatgttttctgaaagacggaaggcagaaaggtcttttttcttggttttcctatatttagaccattttatctcaaacttgagtagtaaatagagtattttgaaaggaatacaattctcacagatccccagagttgatttaaattattttattataatacaatttgcacattgtaaacagtatacattccctacttacagatcttatacaactgtcaagtcaaaacaaatttagaaattaaatcgaaataaaaccacaaataaaaagtcca

SEQ ID NO: 612712 - DNA, 373 bp, Homo sapiens
gtcgctgttccgcgccagtgcaagcgcagcagatggtgaaaacagagctaaggaaggagctggggaaggaggacaatgggcgcgggcgggtcgtgagcttgggagtgggtcaggacacgtgatagtatgctatcagcttgcccgtgcttcggttaggcacacaccctctggctagcttgagaggaaggacgatggtcaaggtacatgtctcttctcctctgactctgggaatgagatattactactcccacaggcttgaactctccttataggagtgtctccacatgccaaaatcagaggaagtcagaataaaacctcccaacgctgaaaactagagctggcacgtagtacatggtcagtaaatgtttttagg

SEQ ID NO: 612713 - DNA, 1408 bp, Homo sapiens
  misc_feature (355)..(355): n is a, c, g, or t
  misc_feature (370)..(370): n is a, c, g, or t
  misc_feature (376)..(376): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (910)..(910): n is a, c, g, or t
  misc_feature (1023)..(1023): n is a, c, g, or t
  misc_feature (1026)..(1026): n is a, c, g, or t
  misc_feature (1030)..(1030): n is a, c, g, or t
  misc_feature (1032)..(1033): n is a, c, g, or t
  misc_feature (1066)..(1066): n is a, c, g, or t
  misc_feature (1076)..(1076): n is a, c, g, or t
  misc_feature (1094)..(1094): n is a, c, g, or t
  misc_feature (1097)..(1098): n is a, c, g, or t
  misc_feature (1109)..(1109): n is a, c, g, or t
  misc_feature (1204)..(1204): n is a, c, g, or t
  misc_feature (1207)..(1207): n is a, c, g, or t
  misc_feature (1227)..(1227): n is a, c, g, or t
  misc_feature (1236)..(1237): n is a, c, g, or t
  misc_feature (1260)..(1261): n is a, c, g, or t
  misc_feature (1392)..(1392): n is a, c, g, or t
  misc_feature (1403)..(1403): n is a, c, g, or t
gttttgggccgcgtgcccaaggacgcccctttcgccccaacggtctcttggacaaagccgcgagcaacgtgatcgcctccctcacctgcgggcgccgcttcgagtacgacgaccctcgcttcctcaggctgctggacctagctcaagagggactgaaggaggagtcgggctttctgcgcgaggtgctgaatgctgtccccgtgctcctgcatatcccaacgctggctggcaaggtcctacgcttccgggacccagaccagaccccccgagacctgactgaggccttcctggcagagatggagaaggccaaggggaaccctgagagcagcttcaatgatgagaacctgcgcatagnggtggctgacctgtnctctgncggnatngngaccacctcgaccacgctggcctggggcctcctgctcatgatcctacatccggatgtgcagcgtgagcccatctgggcagtgcaggggccgagggaggaagggtacaggcgggggcccatgaactttgctgggacacccggggctccaagcacaggcttgaccaggatcctgtaagcctgacctcctccaacataggaggcaagaaggagtgtcagggccggaccccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgttncaccccgaacacttcctggatgcccagggccactttgtgaagccggaggccttcctgcctttctcagcaggccgcgtgcatgcctcggggagcccctggcccgcatggagctnctntctnanncctgtgagactcagtctcgtgcactgcagccgncagcacatgngcttgttctgtaccatcnctnnactggctggcntagatggactagtcagctgtctagcgagctatgcatagatggagtcaaaaaaaaaaaaaaaactagggccgccatgctgagcgtcatatgcggtnagngtgaactgtcatatctgcanctgcatgannagcactctcatgacagagatggnntgacgatgaacttcagcagactataaacaaggtgtgaagctgcccaggacttggcccaccattgggatacagatggcgggggagggtgccccccggggggcttttctttttgctcttttccgtttttccgntgttctctctnccttc

SEQ ID NO: 612714 - DNA, 1384 bp, Homo sapiens
  misc_feature (355)..(355): n is a, c, g, or t
  misc_feature (370)..(370): n is a, c, g, or t
  misc_feature (376)..(376): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (910)..(910): n is a, c, g, or t
  misc_feature (1023)..(1023): n is a, c, g, or t
  misc_feature (1026)..(1026): n is a, c, g, or t
  misc_feature (1030)..(1030): n is a, c, g, or t
  misc_feature (1032)..(1033): n is a, c, g, or t
  misc_feature (1066)..(1066): n is a, c, g, or t
  misc_feature (1076)..(1076): n is a, c, g, or t
  misc_feature (1094)..(1094): n is a, c, g, or t
  misc_feature (1097)..(1098): n is a, c, g, or t
  misc_feature (1109)..(1109): n is a, c, g, or t
  misc_feature (1204)..(1204): n is a, c, g, or t
  misc_feature (1207)..(1207): n is a, c, g, or t
  misc_feature (1227)..(1227): n is a, c, g, or t
  misc_feature (1236)..(1237): n is a, c, g, or t
  misc_feature (1260)..(1261): n is a, c, g, or t
gttttgggccgcgtgcccaaggacgcccctttcgccccaacggtctcttggacaaagccgcgagcaacgtgatcgcctccctcacctgcgggcgccgcttcgagtacgacgaccctcgcttcctcaggctgctggacctagctcaagagggactgaaggaggagtcgggctttctgcgcgaggtgctgaatgctgtccccgtgctcctgcatatcccaacgctggctggcaaggtcctacgcttccgggacccagaccagaccccccgagacctgactgaggccttcctggcagagatggagaaggccaaggggaaccctgagagcagcttcaatgatgagaacctgcgcatagnggtggctgacctgtnctctgncggnatngngaccacctcgaccacgctggcctggggcctcctgctcatgatcctacatccggatgtgcagcgtgagcccatctgggcagtgcaggggccgagggaggaagggtacaggcgggggcccatgaactttgctgggacacccggggctccaagcacaggcttgaccaggatcctgtaagcctgacctcctccaacataggaggcaagaaggagtgtcagggccggaccccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgttncaccccgaacacttcctggatgcccagggccactttgtgaagccggaggccttcctgcctttctcagcaggccgcgtgcatgcctcggggagcccctggcccgcatggagctnctntctnanncctgtgagactcagtctcgtgcactgcagccgncagcacatgngcttgttctgtaccatcnctnnactggctggcntagatggactagtcagctgtctagcgagctatgcatagatggagtcaaaaaaaaaaaaaaaactagggccgccatgctgagcgtcatatgcggtnagngtgaactgtcatatctgcanctgcatgannagcactctcatgacagagatggnntgacgatgacttacagtgactaccagtgtgctctaggtccggactgggctaccatgggatacagcttgcagggtgggccccccgggggttatgatattgttattatatattatttgttttccg

SEQ ID NO: 612715 - DNA, 1092 bp, Homo sapiens
  misc_feature (355)..(355): n is a, c, g, or t
  misc_feature (370)..(370): n is a, c, g, or t
  misc_feature (376)..(376): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (910)..(910): n is a, c, g, or t
gttttgggccgcgtgcccaaggacgcccctttcgccccaacggtctcttggacaaagccgcgagcaacgtgatcgcctccctcacctgcgggcgccgcttcgagtacgacgaccctcgcttcctcaggctgctggacctagctcaagagggactgaaggaggagtcgggctttctgcgcgaggtgctgaatgctgtccccgtgctcctgcatatcccaacgctggctggcaaggtcctacgcttccgggacccagaccagaccccccgagacctgactgaggccttcctggcagagatggagaaggccaaggggaaccctgagagcagcttcaatgatgagaacctgcgcatagnggtggctgacctgtnctctgncggnatngngaccacctcgaccacgctggcctggggcctcctgctcatgatcctacatccggatgtgcagcgtgagcccatctgggcagtgcaggggccgagggaggaagggtacaggcgggggcccatgaactttgctgggacacccggggctccaagcacaggcttgaccaggatcctgtaagcctgacctcctccaacataggaggcaagaaggagtgtcagggccggaccccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgttncaccccgaacacttcctggatgcccagggccactttgtgaagccggaggccttcctgcctttctcagcaggccgcgtgcatgcctcggggagcccctggcccgcatggagtttcctatgatcacctcctgctgcacactttactactcgggccactgacagaccgggccaccccatgggttg

SEQ ID NO: 612716 - DNA, 366 bp, Homo sapiens
actagcccggttactggcccgcagggccgctacgcgaaggtgacgcctccactgataagtggcaagagctcaccccagttccacaacccgacttgcgcaaactatacccaccatcgatccgaacatcgatgcgcaggatggcggctacgcctgggcactctggcgcccttattcgtgttgccagcgtcgtgaacagaccttcctcggcagtacggacttccaatgaaacagcgatcggagcacagcatgaaactcacttaccttggcgatagggctacgcctgaagcctcagcagtgcaatagcgctctctgctgatccaatcaaggtctcctcctccggaaagcgtcaattgggggccgcgcagg

SEQ ID NO: 612717 - DNA, 1109 bp, Homo sapiens
  misc_feature (355)..(355): n is a, c, g, or t
  misc_feature (370)..(370): n is a, c, g, or t
  misc_feature (376)..(376): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (706)..(706): n is a, c, g, or t
gttttgggccgcgtgcccaaggacgcccctttcgccccaacggtctcttggacaaagccgcgagcaacgtgatcgcctccctcacctgcgggcgccgcttcgagtacgacgaccctcgcttcctcaggctgctggacctagctcaagagggactgaaggaggagtcgggctttctgcgcgaggtgctgaatgctgtccccgtgctcctgcatatcccaacgctggctggcaaggtcctacgcttccgggacccagaccagaccccccgagacctgactgaggccttcctggcagagatggagaaggccaaggggaaccctgagagcagcttcaatgatgagaacctgcgcatagnggtggctgacctgtnctctgncggnatngngaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgttncaccccgaacacttcctggatgcccagggccactttgtgaagccggaggccttcctgcctttctcagcaggccgcgtgcatgcctcggggagcccctggcccgcatggagctcttacttttcttcacctccctgctgcagcacttcagcttctcggtgcccactggagcagccccggacagccatctgccacccatgggtgatctttgcctttccctatgggtagaggcccattccccccttattaaggcctttaggtagctatagccccggttaaaaatgggggtaaccataatcccgcaaggcttggctcacctagccacaaaggcctcaaatagtaccacaatcaaagcacatgtggataagttcccacaaaagcaataccaacaaacaacagaaacaaa

SEQ ID NO: 612718 - DNA, 182 bp, Homo sapiens
ggagtacagtggtgcaatctcgactcactgcagtcctccacctcctgggtttccagctcttctcctgcctcatcctcctgggtagcgtggattactgttgtgcgccaccatgcctagctaatttgtgtatttttgcttaaagatggcgtgtttatcaccactgttggactcgcggctgtgct

SEQ ID NO: 612719 - DNA, 247 bp, Homo sapiens
ttctctgcgagaaagcacaattatatgcaatcctaggcagctccctcagctgggtttaagtttcctatgacgactgtattgcccttattgtataggtcttcaacaatccagggtgttaatgtgtgttcctgggatcctttagcttaactccttactgttgggataagtcgctctgtcgcccaggctggagtgcagtggcacaatctcactctgttacccaggctggagtgtggtggcgcaatcttgg

SEQ ID NO: 612720 - DNA, 876 bp, Homo sapiens
  misc_feature (85)..(85): n is a, c, g, or t
  misc_feature (355)..(356): n is a, c, g, or t
  misc_feature (479)..(479): n is a, c, g, or t
  misc_feature (512)..(512): n is a, c, g, or t
  misc_feature (524)..(524): n is a, c, g, or t
  misc_feature (526)..(526): n is a, c, g, or t
gctgcgcaggagccgcagggccgtaggcagccatggcgcccagccggaatggcatggtcttgaagccccacttccacaatggacntggcatgctggctgctgtggccactgtggttcaaccatgcctggccctgtaatgatcctgcagactgtaatgtgccctggcaatgccaatggctgcgcctgcatcgcccctgcgccccgctgtcgtggtcccatcctggcccatctgtgctgctgccccactggttctgtgtaccacactgaatggtgcgcgcctggccgcggcttcagccttggaggagctcagggtggcctggcattcacaatgaactggtgtgcccggaccatcggnnatttctgtggatccgaggaggcggaacaagtccacggagtccctgcaggccaacgtgcagcggctgaaggagtaccgatccaaactcatcctcttccccaggaagccctcggaccccaagaangggagacagttctgctgaagaactgaaactggncacccagctgancnggaccggtcatgcccgtccggaacgtctatacagaacggagcaagctcgagttaatctacttgacggcatcgcagcacgcacttctccacagccttcgctaaggtctccgacatggcccggtgacaacgaccgggtcttcgggcatacgggggcacacacgtacaccaatggaacagccgcagcaaacaccgattgttcgacccccgcaccaacgatacagcgcccttcccgcgggaccctggcatgtccaccacaacatcacaaaacaacgtcgagaagctacaatatcgggagagcggcacaaagcgcgtatatcgcctgtgcactcgccgcataagcgtgccctgac

SEQ ID NO: 612721 - DNA, 100 bp, Homo sapiens
gccagcaccaaccagacatctatgtacctctgtgccagcagaaaccttcaggggcttaatgaaaaactgttttttggcagtggaacccagctctctgtct

SEQ ID NO: 612722 - DNA, 396 bp, Homo sapiens
  misc_feature (1)..(1): n is a, c, g, or t
ncagcgtgtatgatcccccacagatgatcaggcacagccctgttagccattcggaaatctcgatggatgtgtcgcagtcagggataatgagacgaatatagtgcgattttccataaccatactgatgttccatcacaaagtacctggtgatagtcttttgtagacagtttgctgcatgtgtagatgtcactgctgtttgataggtattacattcacatatgatttcttcacatgtcctaagatttttacctcaaaaagatatcaatgatagactcatatgtagaatttactacactttctttactggatcgatttcagtttatattcaggtagtatgagtatctctctgaattacccatattctacttaggcctcaacctcgtgctgaattccggc

SEQ ID NO: 612723 - DNA, 626 bp, Homo sapiens
cggcgaccatttcaagacatagcttagagggtgcaagcccaagcttggcacgttccaagcggtgttgagcctgcaggtacacagaagtgaagaactgaggttgggaacctctgcctggattttagaggatgtatgaaaacgcctggatgtccaggcagaagtttgctgcaggggtggagcccttatggagaatctctgctagggcagtgcagaagggaaatgtggggttggagcccccacacagagtccccactggggcattgcctagtggagctgtgagaagagggccaccatcctccagaccccagaatgacagatctactgatggcttgcaccatgcacctggaaaagccacaaacacgcaacaccaacttgtgaaagcaatcagcagggaggctgcaccctgcaaagccacaggggcaaagctgcccaaggttgtggaaacccacctcttgcatcagcatgtcttggatatgagacatggagtcaaaggagatcatttcggaactctgaggtttaatgactgccctattggattttagacttgtatggggcctgcagtccctttgttttggcaattttcccattgaaatggggtattacccaatgctgtatcccattgatct

SEQ ID NO: 612724 - DNA, 140 bp, Homo sapiens
  misc_feature (38)..(38): n is a, c, g, or t
actctagaggatgctgacatgaccaagcatcatacttnctgctgatcgacgtgtatacacactgcggtgcatcctcctgtacagttcccgtcgacacgtgagcaccgtgctgacctccaaatattgttaagctggagcct

SEQ ID NO: 612725 - DNA, 102 bp, Homo sapiens
ctagtcccaagtactattgacccagcgattggggcttcgacattggctttatggagtcataagtggagtcctgtaaagaggtatcttcactattaatgcttt

SEQ ID NO: 612726 - DNA, 201 bp, Homo sapiens
  misc_feature (165)..(165): n is a, c, g, or t
tagcaataggctataacataagccgaggtataggctacactagctaggttcgtgtaagtacactctatattggcacaacataaaattaactagtgacgcatttctcagaatgcatccccatcgttaagtgacacagactgtccctcatatcaccggaggactggnccaggacctcctggcggcaccaaaatccacgagcgc

SEQ ID NO: 612727 - DNA, 136 bp, Homo sapiens
gccagcaggctgcccaggaagccacccgccgcatgcaactgatgcacgcgcagatcgtgaatcttgcgaacagcgccaccgacgccgtcagcagataggccactggcagcgccgcgcacagccaccaggcccagcc

SEQ ID NO: 612728 - DNA, 111 bp, Homo sapiens
aggcatggtctcagcggtgctgagtggtcgtaggtacatggatggagccaggtcgtgtcctgccagtgtactccaggcactcaaacctagctttactgaaccctgccctgt

SEQ ID NO: 612729 - DNA, 984 bp, Homo sapiens
  misc_feature (71)..(71): n is a, c, g, or t
  misc_feature (79)..(79): n is a, c, g, or t
cacgatacacacgaacacagaacagagcgcacgccaacacacatgaacacccccaccatcgagcaccaatnggaacggncagagacgaccaacgagaagaaaccccgcgaagacgcatgaaaacccgtggaagagaacgagggcgacgaaaatggaggcaggaaaggagacagcacgacggcgaacaggaccacgcgaaagacgtaactgaagagcgacagcacggcacgaagaaaaaggacaagaagcagagcagacgcagaaggaacgggaagaggcgacgcagacagacagacataaaaagaagcaaaacacgaaaaaaggaggagacacaggaagaagaaggcgagcaagaaagcaaaaaagaaggacaagaagaagaagacagagaggaaaccgcagagatgaggaagaagagcaccagggaaccaaacccaagacgagccaagaaagacaagtcgaagccacgaaagcggcagaagaccactcacagatgagacgaaaaacaagaaagcaaaggggaaaacaaggagaccaagcaatcagaaaggaaaaaccccgaaggaacagggagagacgaaacgagggcaaaaagacaaggggccacgcgagacgagaagaagaagcccaacaaaagcagaagtggaacccggaaaaaacaaagggagagaaaaaaattcaaaggaggaaaacgaaaaaaggggagagcaagaacaaagaaacaacaaagaagaagagggaagaacagaaaaaagacaaagcaaaacggggagaaaagaaaaaaagagcagaggaaagggaggacacaagccgaaaaaagagaccgggaggaaccaacaccgaaagaggaaagcaaaggcaagcacagaaagaataaagacggaccaaaaaaggaggcggaaagaaaaaaggaaagaggacgaaaaatgagacaaagaaggggaaagggagaaaacggcagggacaacggaacacgagacaggt

SEQ ID NO: 612730 - DNA, 427 bp, Homo sapiens
catcacagagcaaaggtgggagattccatctaagagccaagaattagtttagtatcttacctttcttttcttttcttttttcttacctttctttttgaatactcaacttgagtttcctcctggcccttaaatcatttgtggccaggcgcagtggctcacgcctgtaatcctagcacttcgggaggccgaagaggccggatcacgaggtcaggagatcgagaccatcctgacccaacatggtaaaacccgtctctactaaagatacaaaaattagctgggcgtcgtggcgcatgcctgtaatcccagctactcgagaggctgaggcaggagaatcacttgaacccgggagaaagagtttgcagtgagccaagatggcgccattgcactccagcctggcaacagagcaagcctctgtctcaaaaaaaaa

SEQ ID NO: 612731 - DNA, 183 bp, Homo sapiens
atcaggttcactggaatcaggctgtaacgtactcaagtcacaacgactgcagctgcaggaggtttgtcactaggacacagaagtctgattccaagcccactcttcaacagctgagatgtggtgtgcgtgtttgtatgtgtgtgtgtgtaaacgctgtcctgatgtcccgcatttacactttgg

SEQ ID NO: 612732 - DNA, 674 bp, Homo sapiens
ggcagacctaggaggtgcgacagagccgcggggcgatacggtactggggccaagagccgggagcgcgggcgctaatggcaccagagtccggccaggggtgccgagcagctacggccttgggggttctgcgggccttcggttgcgcgtcttcgcctctagccatggggtccgcagctgttggcagatcctggtgcctggctgctgtgcctcggtggtgctggggcgggtcgtgatcctgtggcgtgcgggcttgccgcatgtgtgcaggtgaccgccttccgtggaccactaacaatcgtgactggctgcagaccacctgggacaggggctgtgagatgtcgtgcgtggtgcaggagcaccggggcaccattgcgagttgcaaaagtgtacgaactcgcgtgctggcctctgagcaccgatggtggcaggctggctgcgtggtgctcacctgtgacgcgcccgtggctgcttggcgcgtccggttgcgcgcatcttctgtgaccctgggcgggccgcgcaggttgcaccaactggcgtggcccggggcccgggcaaggcgcgtgtgggccctcaagggacggggtgctctacctgttgtgcgggcttgctggcgctcgtggccactctgctggtacgccaccatggtcgcccggcgagtctcacgacccggctgc

SEQ ID NO: 612733 - DNA, 477 bp, Homo sapiens
gagagagagagagagagtatagagagagagagagagagagagagagagatagagagagagagagagagagagagagagagagagagagagatagagagaggagagacccagagagagccgatgcacatgcaccctacacctgatccgttcactctcttcgaacctatcccatcatcaaactcgtcacctcctatgccgcaaccacaactgcattcaccactcacaacttccgaaactaactcctacaacactatccaacgaaaacaaccgagccagatacccaacctgcaccccacattctaacagtgacaacatcacgttctcgccacgcgcttcagctgacccccttacgcccaacaccccctcatttgctcacaaccaaggctccaagtctcctcctcgcaatctcatgatcagctttccacgccactgaccatcctccaatcctgacagcactcctccacatccctcccgccc

SEQ ID NO: 612734 - DNA, 473 bp, Homo sapiens
ggggagccaaaagatagaaaaagaatagcaattctcaccccccacataattggaaaccacttttccttctgtctggcttcagaaacacaatgtcttgatttccgtgcgagagaggatgactgttctttaactggtttcacgtcggctttttcctctgatttgagaggtggagttaagtgtgaactgcttaagaatgcactgttttctatttaatttggctgcggaagatggaattcattgagctccgtctgttcaaatgaactttaagcaacagcaagcaaaccatttatacttctccctgcacatgcaatcgaaatgtgtctggtgaaagaatggatgaaaagcccaggattacctaaggagagccatggagatgtgataacaactccttatctctttgttggctcatctgaagtgttaaagtgttgttgggggaaagcgagcctcttttttactagggagtattgaaggcg

SEQ ID NO: 612735 - DNA, 344 bp, Homo sapiens
ggcaggagagcaggggccatgtctcagctcacggcaacctcggcctctcaggttcaagtgattcgtccgttctccagcctcccgagagcggggattacaggcatccaccaccacgtcgggctcatctctttggtatttttagtaaagacgatgtttcaccagtgtgggccaggcgggttctcaaatttccgtgaccttgagttgatcgtgcctgcctgcggcctcccaagagtacgtgggatcacagggcttgacgccaccagcgccgcggcctatctgggcgctacttttggagaataaaagtggataagtgtaagtatctgggtgagcagcgctctacgtgt

SEQ ID NO: 612736 - DNA, 104 bp, Homo sapiens
gctcctcagtagatgatggcgcaagaggtctgatggggagctgcggagtatcggcgggctctccatcaggactctttgctgcccacatccatcttgctgcggtg

SEQ ID NO: 612737 - DNA, 219 bp, Homo sapiens
ctttagactgttgatgctgaagatgatgcaagacatggaaataaactggaggcaaagatagataacttacaggaaacactgagcaaagagatacaagataaaaaacttaaacaagaagagatgtaaaatacaataactgaaatgaaagcaatgaaggcttttttgtaatttaacaagaataagacattgcttttgctctcaactagcttaaaggaaata

SEQ ID NO: 612738 - DNA, 160 bp, Homo sapiens
  misc_feature (56)..(56): n is a, c, g, or t
  misc_feature (85)..(85): n is a, c, g, or t
cagaggctagaagctgggagactgaaaaaatgcagaccgccggggcattattcatntctccagctctgatccgctgttgtaccangggtctaataagggctgtgtctgcctcctcttgaatagccagtgaattcatctaaacagcctcctacagacactt

SEQ ID NO: 612739 - DNA, 168 bp, Homo sapiens
agagacaacagccgtgttccacagtctgtcctcgagatgtcgctgagtccgcacacttgggctgcacccgccctgcagatgaccaagcgccggccgctcagcacacgtgcaggcggggttaaacgccaatacgcagttttcgttcttgttgttttaatctgaacgact

SEQ ID NO: 612740 - DNA, 204 bp, Homo sapiens
gcgcaatagatatagtaccgcaagcaaagatgaaaaattataaccaagcataatatagcaaggactaacccctataccttctgcataatgaattaactagaaatacttatccaggggaccaagctagccccgtaaccagacgggctacctagcacagctaatgggcacacccatctatggcaaagtgggagcttataggtaggg

SEQ ID NO: 612741 - DNA, 840 bp, Homo sapiens
tcaataaaggaaagctttaagaaaagggcacgtattcctggaataggtaagaaaagctccccatcggtcccctcccttttggagggagcagcccctaggggaactcgtttgggtaccccagaaacattcagcaaagcaaccattagcctcctggacccctctccccgtttccccagcagctaggatgaaggcaacatattcctcacaggtcattggatctggaggtccttcaggggtggactccaagctcttcacatcccagatatctcatgccgccatccatgccagtggtgcagaacggcgagcattgggcctggccgccgctgagcaccgagatcgggctgacgctgttctggggcagcgagtctaggcccgcgcccgacagccgggccaccctcggagctcgccttctggtccaggttcgggaagcgctcgcgggccgtcaagccacgcggcgagctcggctaggaacgtccagccgcccgcacgaagctcagcatccccgcgggggggtcataggtgaacagccaacggggaagcagtcggggcccgttgccaccaggcggtggtctgtgatgaaggtcagggccacgcaggggtaggttcacagaggccaggagtcgcagacggcaacttctggtgggcatcagccaggcaaacggtgctggcggggttaaaccaggccaaggggaactccgcggggtggagaaacaaacggcgggtccagccgaagatatgcgggttcgcgacctcagttccccaaggggtgtggagccccggggggggggggcgtctccccccctatggggtggaaacgcctgatgtaagaccgggcagacg

SEQ ID NO: 612742 - DNA, 1425 bp, Homo sapiens
ggaatcgctgtgggtgagaataagcggtgttcccccacacttgaagacactcgtggtgacaccgagagtgttgttacgccacgaccacaccacttggtgtgtgagtgctgttaaccactccttgatgtgaaattagcggccagctttgtggtgttttttggggggcggggcgtggtctttgtcttcacacaagaagactgatatggggttgagtatgtcttaagaagttttttgattggcgaagtctgacaagaagtcttcgttcaattcagcactaacgtgtaggtagtagtgtgccggagcccgattttcttgtgggccagcatctgtggtccgcctctgccgctaaaaagccccctagtaatgtccgccaaggagattttttgaggagggccgcccgctcgtttttgaaagggagcctgtgtgatatagtatatcctgcttctccccatcaaggggttgtagaagaaggagttggttgcctctcatttggggggggtctatgaatagagttgttattaaagcctccgcccttatcgcccccttggtatcactttgtatgatgtggtttgggggtgaaatttctgggggaaagtagggcgcctgttgttggcgcccgcgccgcccgcacgtgtgtcgcgcgcccccccccccccccctcttcccccctcttttggtagaccccctgtctcgtgccgccttcttgtgagagaggtagtgaggtacacagtgtgtgtgcaccccctgcccccacttgggctgtgggggccaccgctttgcgcaccggggggatattttctcggagtgcccccgtcgggggccaccgcccacgcgagagacgctcttctcgagaagcgcctcttttctcttgttgaggcccccctctttttgttgtgtgtgttgccactcccgctcgctgagttttttttttctaaatgggagactctttccacgcgagaattttttggtgagatttctccacatagacctcttcccacaaggctccaccacacctctttccctctaatttctctataagaaacttctagaatttgacacacgctttcacacattggaaaggtggcctcgtttgttaagagactctaaccacaccccacgctgaaaagccccgcgcctcactgaccaaatcccttgaaagttcttctcttaagagaaaatgaatgctggtcatcgccagcgttctagcatcttccctgttttttgaatgccttggcgctccctcttgctgagtctcacgtttcctggcttttcctccctcagccccttctcaccccctttgctgtcctgtgtagtgaatttggtgaggagaattcgttgctgcaccccttcccccacgcacccactttattgaggttctccagttttattattgccataaaagtgctttatgccggcttttttcca

SEQ ID NO: 612743 - DNA, 385 bp, Homo sapiens
tcagacaaagtttataatttcttctgataattcttcagagtatatcaatgttaacatttagatgtacactgtatactcagttgcaaccttatacacatatttgtactctagatagaaatgtatgtactattacccgtggggaccccactgtgcctgccctctctgggtgactaatggagtgcggatgggtcctgttcttttcccccttattctttaatcctgccctattccccttatactattcggcttctcattagaatctcaggattcaatctctgtgaggcatgagttttagatttatagaacagagtggggagactggtgcatctcctggattttggaggtcccaaggcacactgcattatttctccatgcctgatccctt

SEQ ID NO: 612744 - DNA, 879 bp, Homo sapiens
ggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccgtgttgtggcatgtatcagtactgcattcctttttatggctaaatgatgtttcattgtatgagtgtgtaccacattttatttatccattcagcaattaatggacaggaacaatggctttctaacgtattaaacttgtcaagttcaacattacatgtatccacagttattgataactatcaagattatacatggtgtgaccacgaatgctgtgtcgacaatgggtattgtaacactcactcctgtcaccattttcatgttacactgcattcactttcctaagggaccccttctaagcccctggttcaacgcacctactgtgcactgtccgcaatatatcattctaattcacagcttcacgtgcctctacgcctttagcccttccacactttcgcatccactcgcccactctccaaccaccattgcgccccacagttcgtccatcaacccacgttcggcacataattccactctaacaactccacacaggtccataccattac

SEQ ID NO: 612745 - DNA, 760 bp, Homo sapiens
cgctagtccagtgtgacaccctgcacctggaagctaggagggaagctcctcctgtggacactgggggcaacatggtgcagactgaagcagacagggatgcacgcacgtgacagcaaagctggggacagtaaagccgacccaccggtgctagcagctggcaccactgccaatgagattacactagaaccaatcaggccaagttagcaccaaatatgcccgtgggtacgcattgccacacgcgtcaaattgcatgcaggtaaaatggactgaaggaaaagattaagcggccgccctaaagaaaagctaaaagataaccctataactctaagaaggcatgaagacagctgccttaggaaaagctgagagatgagaagcccatttgcgaccagagcacacaaaagtatacacctaagagacctttctcattcatcgatataaaacagacagttgctgaccctgtcatcatagaatgggacaagacatgattgtgagcgtgtcaattaactaagtttagcaagcatgctaataaaagataaaggaatattattcataatgccagacgccccagtcttaatcagagaatggaagagccttattatagatgcttggctcaataggccatataaggcaatgagtgagagactggaccaagataacagtgcagctctaaccaaaacaggtaatggaatatggtttaatacaagtttggtttatttgatagctgcggaaatgtaagactgtacccttataatagggcttg

SEQ ID NO: 612746 - DNA, 232 bp, Homo sapiens
ggcgcggcggagcaccagcccgggggaaggagctgcccggctgctggggactgggacctggagcccttccctacgcacgtacgccctgcctcgagtagcctgatagcagcacgctaatggtatactttgatcggatagttctgtatcaagagatcgaggggtgaaaccactgtgaaagatagacgggatgtctagatagtaaagttgggtgacagtctgggaagcgtcagag

SEQ ID NO: 612747 - DNA, 287 bp, Homo sapiens
aggggccagaatttcctttttttttaaggggggaaaaaacttttttttagggaaaacccccattttgtttatccccttattcattgagggacccttagatggcttcccccttttgggtattgggaaaaaaggggggaaaaaaatggggaaaaaaaaactgtttatgggggggggggcagggggtcatgcctgtaatccccgcattttgaggggccaaggggggggggttggttgggctcaaaagttttaaccccgccggggccacaggggggaacccccttttccca

SEQ ID NO: 612748 - DNA, 280 bp, Homo sapiens
cattatgtcaggagatctgagcacatcctgggctaacatggtgaaaccccgtctctactgaaaatacaaaaaaattagctgggagtggtggtgggtgcctgtagtcccagctactcagtgaggctgaggcagtgagaatggcgtgaaccctgggaggcggagcttacagtgagccgagaccgtgccactgcactacagcctgcgcgacagagtaagactccgtctcgaaaaagaaaaaaaaaacaaccagcactgtattggcaaagggtagcactgcatc

SEQ ID NO: 612749 - DNA, 120 bp, Homo sapiens
  misc_feature (34)..(34): n is a, c, g, or t
  misc_feature (36)..(36): n is a, c, g, or t
  misc_feature (40)..(40): n is a, c, g, or t
  misc_feature (48)..(49): n is a, c, g, or t
  misc_feature (54)..(54): n is a, c, g, or t
tatttcatgacgggactgggctttacttgatttncntgcncgtgtgcnncggtncaacagccgtctgagggggtgggaggtggccgctgctccgaaatctccgctgagctcattcgctac

SEQ ID NO: 612750 - DNA, 338 bp, Homo sapiens
  misc_feature (5)..(5): n is a, c, g, or t
  misc_feature (180)..(180): n is a, c, g, or t
  misc_feature (293)..(293): n is a, c, g, or t
ggaanaagtttcagacatggagatgcatgaatgtatatacacaggagaggccaggcgtggtggttcacaacctgtaaccccagcactttggacaggttgtggagggcagatgacttgagcccaggagtttgagaccagactgggcaacatggcgaaacctcatctctacaaaaaaatatnaaaattggccaggtgttgtggcatgtgcctgtagtcccagctacccagtaggctgaggtgggaagatcacttgagcccaggaggtcaaggctgcagtgaactgtgatggcatnattgtactccagcctgggtgacagaggcaagtgaagaccctgctc

SEQ ID NO: 612751 - DNA, 139 bp, Homo sapiens
aaaaacagaaagagtcaactatcctagtccggcctgttaatcgtacgatgctgattgcttgaagttgtcaggagtggcaccgtctgagggggtgggaggtggccgctgctccgaaatctccgctgagctcattcgctac

SEQ ID NO: 612752 - DNA, 284 bp, Homo sapiens
gtaaaaacagggtttccctatgttgcgcaaaaaattttcgaactcctgcccccaagggatcccccccccttggccccccaaaagggtgggattacaggcatgaaccccagggccccccaaaataaacttttttttttttcgggtttaagcccccaaaaaaatttaccccaaaattttttgggaccccttatggggaaaacctttaaaaccgtttaaaaaacttttaggaaaactaaaaatttccaaagcctcctttaaaaaaaaaaaattccccttttttccca

SEQ ID NO: 612753 - DNA, 123 bp, Homo sapiens
tgccgtcacggtgagtgtcccccagctcccggtgcccggcgcggtgagtgtccccccagctcccggtgcccgtggtgagtgccccccagctcccggtgcccgtggtgagtgtccccccagctc

SEQ ID NO: 612754 - DNA, 192 bp, Homo sapiens
  misc_feature (10)..(10): n is a, c, g, or t
gcgaccctangatctttgagcatcacctggcatagttataatgccagaagtctagcggcgcaggtggcgctatccaatataggtgcatgagtaggtggcctagcagtaatagttagcggtataggcgtacggccagggctatatggttaaatagagtagagctgataggtaatcgataaataaactaagtaa

SEQ ID NO: 612755 - DNA, 716 bp, Homo sapiens
  misc_feature (12)..(13): n is a, c, g, or t
  misc_feature (238)..(238): n is a, c, g, or t
  misc_feature (290)..(290): n is a, c, g, or t
  misc_feature (297)..(298): n is a, c, g, or t
  misc_feature (307)..(307): n is a, c, g, or t
  misc_feature (339)..(339): n is a, c, g, or t
  misc_feature (350)..(350): n is a, c, g, or t
gggcctcggcgnntgaggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaaagaggcgcagcgcttccagtggtagcagcagtaccaggtctcggtccagctcgaacttccagctcagngctccagcaccagcactggctcaagcagtggctccagctcttcctcagcatnccagccnnctcaggaangctccagcacctcccgcagctccagctctagncagctcttctnggctctccaagtccttctcaggcgcagacacgacaacaggaggcgctcccgctccaaatccaaaccacctaaagagagatgacaaaaggagaggaaaaggcggagcccatctcctaagcccaccaaagtgcacatgggagactcacccggaatgtgacaaggatcacatcatggagatattttccaccctatggggaaaatttaaaattgattgacatggccgtggaaaggatgcatccccaatctgtcaaagagtatgggtacgtagagtttgaggatccagatgaaaggcgagaagggctgaagcacatggatggaggacaaattgattgggcaggagatcagtgcgacgcgtgtgggccctgg

SEQ ID NO: 612756 - DNA, 385 bp, Homo sapiens
gggataccaaatacatactgagatcacagtgcagtaaaaatagaagactaagaaaattgctgaaaatcatgcaattacatggaaatcaatcaacatgctcctgaatgactttttaataaataatgaaattaaggcagaaatcaagaagctctttgaaaataatgagaacaaagttacaacatactagagcctctggacacagctaagacaatgttaggagggaaatttatagcactaaatcccacatcaaaaagttaggaagaactcaaattaataacctaacatcacaactgaaagaactagagaagcaagacaaaaccccaaagctagaggaagacaagaaataactgaaaatctgagctgaactgaaagaaaccgagacatg

SEQ ID NO: 612757 - DNA, 157 bp, Homo sapiens
ttgcggtctcatatcctggacagaaacccatgcatgtcaatgctccaacttacaaataatggcatttatgatccagatacctgaatatgatgatcctgtgattctacattacaatgtacctgtgttgaagtgtggactggtggctcccagtgacctc

SEQ ID NO: 612758 - DNA, 446 bp, Homo sapiens
ccctttggaggcgtagaaggcggcccccctaactcggggtccaacttcagcttgccaacatggtaaaccccgtgtcaactagagacacacaaaataacccggctgcgcaggagggtgcctgaaaaccaaaacctcagccggctaaaccatgattattgttagaccctggcagtgcagttctccagtgagtggacatcgcgactgtgccctgtactcagggtgccaaaactgaacctctgcctccacaaaaaactttataccatggctgggcgcccgtggctcatagcctggaattccaacccctttggaggcttaagccgatagatccccttaagtccggagttttaaattaacctgacccaccccacaaaaccccgttttttctaaaaattcaaaaattagctgggtgtggtggcacacgcctgtaatcccagctactcgggagg

SEQ ID NO: 612759 - DNA, 261 bp, Homo sapiens
agacgtccattctgggcatttcgaaaatctctttcttttctcttacgcacttcattcagccacacatgaaatatgtccacttttcgcactacctatggctatggcctggctggctcaaataataaaggctagggctgtaattatatgagtagccactatgaactgaatatctactaggtaccgggcatatagcaccttaaaattaccggcgagtgggacactatcatccaggtttaatagatcaggcaagaagggaggtcg

SEQ ID NO: 612760 - DNA, 280 bp, Homo sapiens
taactacatttttgaatacacatccagtacttagaaaggtgatgtttcttccttaaaaaataggctatctctatatccccaaacttattacttaagatgccattattcaattcatatagaaaatgaatcacgtgaatagcaagtcggttgaagtgtgtgtggggggtggagggatgacaaacataacatacctaacacacagtctcaaaataaggtgggatatgtatgcataatagttagtagtggcttatatcccagagaactaggtaggataactcag

SEQ ID NO: 612761 - DNA, 262 bp, Homo sapiens
tatcagctccagattccacaaaccatacagtagagaatactggtcttcaaaaatttctttttggctgggcacagggctcacgcctgtaatcccagcactttgggaagacgaggcaggtggatcacggggtcaagagattgagaccatcctggccaacatggtgaaaccctatctttactgaaaataaaaaaaaattagccaggcatagtggtgggcacctgtaatcccagccactcaggaggctgaggcaggagaatcgcat

SEQ ID NO: 612762 - DNA, 626 bp, Homo sapiens
aaaactacggctaggtacgaggctgggtggtcgctgaggtagctacagagctcccaagaagacagaagtagtgatataccatggcatgtcagcatcgcagaacgaaatactacaaggccattttgatgaaagacctagatgcatttgaaaatgagacggcaagagaaagttacactacatgaacatttggtcccagcttcgaaagtgtgtcggatcacccatattcgtttgatggtgtgtgagccggagaccttgttgaacgttggtacgaccacgctgactgaggctagtgggaagcttcacctgctggataagctactagcattcctgtattctggggcgccactcggagttttactgtttctcccaaagtgacccagatgttggatattctccgagactatttggattacagaggctacagctatgagcgtgtggatggttctgtgagaggagcacagagagtagcacttggccagttaagaacctttggacagcagcccatatttcgttgtttctcctgagtactcgggccggtggagttggcattgatacttaacagcagcagatactgtgattttgttgacagtgactttaatcctcggaatgacttgctagcaggtgcc

SEQ ID NO: 612763 - DNA, 160 bp, Homo sapiens
cctacacatgttctgattggctagctggttgtgccttttttttttatgtgtgtgtgtgtgtgtgtgtgtgtgtgtgtgtgtcactctgtctcccaggctggagtgcagtggtgcgatctcggctcagtgcaacctccgcctcctgggttcacgcgatttt

SEQ ID NO: 612764 - DNA, 254 bp, Homo sapiens
atgtcttaccaaaacgttagcatttattggatcaccctggcctctgaacacgtggtgagttcaagggccactattcacaaagggtcaccttttcaccattttatttgtaccatgaaaataatggcttaaggccagaagggacttacaaggacatcattcttttgaagaaacccctaccccaacatacacacacacacacacacactggccctggaactttggaaaattttacttacattaacaatggattctct

SEQ ID NO: 612765 - DNA, 507 bp, Homo sapiens
gtaatggtggactcagattggaataggagatagttatatatgaaaaaatcgaaatttgggaagaaagtgagtggtattagtaaaaactggtgaataaatcaccagtgattaggtttcctcatgctggcatattattctgtcagatacaagcataaaggcaaataagccataaagacaaacaagatgacatattacgaatgtctaaaatcgcttcttccgaattatccggattctacgggcagagcgaagctttggcatcttctttctcttgttcaaagcttgtgcacatgcacgtttgcaatcctccctgctaacaaagttattgtcattccctccacagccagtataggtgaaagcatcacaggttctgtatcttggattaaaataatagcgagtcacattggcagagcacagtccctcatcttttggactgtagcagaatgatggaatcttgtttggtgcgcagaagcccatacaagtagcttcatcgggaaacctgttctcaat

SEQ ID NO: 612766 - DNA, 506 bp, Homo sapiens
  misc_feature (190)..(190): n is a, c, g, or t
ctgcactctatgggccccgacccgtggtcatcaccagctccgacctgccctccccgcagggcagcaacttccttattgtgttggggagtcaaaggaggaggaatccccctggctccgtggttatggaacgcatccggatggacatttgcaaaatggaccccgtctttgtgggccctggggacctgttttnttccatgctcctggggtggacacacaagcccccccataacctcaaggtggcctgttagaaaaccgtgttttccctgccccccgttttgcaaagggccatccagtgtgcaaaaaccccggccggggaaagagttaggcccagccccattcagctggaacttcggatggtgcaaagccaaaagggcatcgagggcccaaagattgttgttcaggccccggtgctgttagggcccccccccttgcccgttacacccagcgcgttggggtttccgtgtttgtccctgtgaaaacatgtaacgtttgccttaaaaccctta

SEQ ID NO: 612767 - DNA, 493 bp, Homo sapiens
  misc_feature (10)..(10): n is a, c, g, or t
  misc_feature (33)..(33): n is a, c, g, or t
  misc_feature (54)..(54): n is a, c, g, or t
  misc_feature (81)..(81): n is a, c, g, or t
  misc_feature (87)..(87): n is a, c, g, or t
  misc_feature (92)..(92): n is a, c, g, or t
  misc_feature (126)..(126): n is a, c, g, or t
  misc_feature (200)..(200): n is a, c, g, or t
  misc_feature (266)..(266): n is a, c, g, or t
  misc_feature (293)..(293): n is a, c, g, or t
  misc_feature (339)..(339): n is a, c, g, or t
  misc_feature (407)..(407): n is a, c, g, or t
  misc_feature (423)..(423): n is a, c, g, or t
  misc_feature (488)..(488): n is a, c, g, or t
ggcttatgcntccggggccccatcggtctggcnacccaagcttggggccttttnggacacctaccaagggaagttttgggnaaggcntcttngggggaaatggggtggcgcatcaagggggtgggnaagggaaagggggtgactttcccccgctgggaaataagaggaggagactaaggagctcagggtttttccgaagngaaaatgcaggagatgacacacctgagtgaggtccaggtacaatggagtggctcagcgagacttgnggcggctttctaggaagaagctattcnaaggacaagatcatctgagacccagactcttgttctagagctatcncacctcacagggaggaacacacagaatcaactagagtgtcgattcctgtgtatcagcgggtgagccgnagtctaagagtgcttngcaaagctgggacgggcttgcagaacgttatactctaaggactagaggaaggatcccttatggangttgg

SEQ ID NO: 612768 - DNA, 160 bp, Homo sapiens
ggaccttcgattggtgggcacttagtgagactcatctctgcaaaaatagccaggcaaggcgaggtaggagggtcacttaagcctgggaggcagaagttgcagtgagctcagatcaagtcactgcactccagcctagtgcaacaaagcaagaccctgtctc

SEQ ID NO: 612769 - DNA, 112 bp, Homo sapiens
aacatggggaaaactttcgtggttcctaccatacctaaaactttgatactaagaccagtatgcctacatccagtatttaaattacgtaaaatactacccaagtatacttttt

SEQ ID NO: 612770 - DNA, 531 bp, Homo sapiens
  misc_feature (10)..(10): n is a, c, g, or t
  misc_feature (30)..(30): n is a, c, g, or t
  misc_feature (32)..(32): n is a, c, g, or t
  misc_feature (51)..(51): n is a, c, g, or t
  misc_feature (57)..(57): n is a, c, g, or t
  misc_feature (59)..(59): n is a, c, g, or t
  misc_feature (61)..(62): n is a, c, g, or t
  misc_feature (64)..(64): n is a, c, g, or t
  misc_feature (69)..(69): n is a, c, g, or t
  misc_feature (71)..(75): n is a, c, g, or t
  misc_feature (77)..(78): n is a, c, g, or t
  misc_feature (82)..(82): n is a, c, g, or t
  misc_feature (85)..(91): n is a, c, g, or t
  misc_feature (93)..(95): n is a, c, g, or t
  misc_feature (101)..(103): n is a, c, g, or t
  misc_feature (105)..(110): n is a, c, g, or t
  misc_feature (116)..(116): n is a, c, g, or t
  misc_feature (119)..(120): n is a, c, g, or t
  misc_feature (125)..(127): n is a, c, g, or t
  misc_feature (132)..(133): n is a, c, g, or t
  misc_feature (136)..(136): n is a, c, g, or t
  misc_feature (139)..(142): n is a, c, g, or t
  misc_feature (144)..(144): n is a, c, g, or t
  misc_feature (146)..(147): n is a, c, g, or t
  misc_feature (152)..(152): n is a, c, g, or t
  misc_feature (154)..(154): n is a, c, g, or t
  misc_feature (157)..(157): n is a, c, g, or t
  misc_feature (170)..(170): n is a, c, g, or t
  misc_feature (181)..(183): n is a, c, g, or t
  misc_feature (185)..(186): n is a, c, g, or t
  misc_feature (189)..(190): n is a, c, g, or t
  misc_feature (195)..(195): n is a, c, g, or t
  misc_feature (201)..(203): n is a, c, g, or t
  misc_feature (209)..(211): n is a, c, g, or t
  misc_feature (221)..(221): n is a, c, g, or t
  misc_feature (224)..(225): n is a, c, g, or t
  misc_feature (230)..(230): n is a, c, g, or t
  misc_feature (247)..(247): n is a, c, g, or t
  misc_feature (249)..(249): n is a, c, g, or t
  misc_feature (280)..(280): n is a, c, g, or t
  misc_feature (283)..(283): n is a, c, g, or t
  misc_feature (285)..(286): n is a, c, g, or t
  misc_feature (291)..(291): n is a, c, g, or t
  misc_feature (295)..(295): n is a, c, g, or t
  misc_feature (303)..(303): n is a, c, g, or t
  misc_feature (305)..(307): n is a, c, g, or t
  misc_feature (367)..(367): n is a, c, g, or t
  misc_feature (369)..(369): n is a, c, g, or t
  misc_feature (371)..(371): n is a, c, g, or t
  misc_feature (385)..(385): n is a, c, g, or t
  misc_feature (388)..(388): n is a, c, g, or t
  misc_feature (391)..(391): n is a, c, g, or t
  misc_feature (406)..(406): n is a, c, g, or t
  misc_feature (421)..(421): n is a, c, g, or t
  misc_feature (424)..(424): n is a, c, g, or t
  misc_feature (428)..(428): n is a, c, g, or t
  misc_feature (441)..(441): n is a, c, g, or t
  misc_feature (454)..(454): n is a, c, g, or t
  misc_feature (468)..(468): n is a, c, g, or t
  misc_feature (522)..(522): n is a, c, g, or t
gaagacagcnccgcccgcgcaccgccagcnanccccgccgcagactcccancgccanangnntngggcnannnnnannagangannnnnnnannnaaacgnnncnnnnnnaaacanccnnaaaannntgcannaanggnnnngngnnatgantnagntggagcaaatganaaaggaggaannngnngtnnggaanaacatnnnggatgnnngaaaagaatntgnngaatnaaaaatgatgcaaatangnaaatgggatggaaaaagtggggagaataaanatnannaaaangagnaaaataantnnnaaaatggaaaaaatatatgcaatgcaatgggggaaagaataaaggctgctggtaagcgcntncnaggatgggaagctnatnatntgggaaagataaaanaaaaaaaaggtccangcnatcncgctgcgctcctnctgggtaataaantgtgcatacgcgcnctcagggaaatttgtggcctgtggggggttggacaacatatgctccatctaaancatcaaaaa

SEQ ID NO: 612771 - DNA, 345 bp, Homo sapiens
acgagcgcacagacacgctacactgtggaagggtgtagagacctctgtgccaaaaagagcacacttgcatgaaggtgagatcctatgagtctggttaccggttgagtgaagtgctctaagaattctctggctctcacttcctgtggcagagattgagtggctgtcaagcgtttgtggtcagaccggattcacagagagagtgtgagacaggctcctcttcttggagcacccactctttaactctatgacacggtttttggaactctgtgatgtggatctggagaagacaatgtgacagaacttccctcttaggctttatccccacattggtggacactttggggt

SEQ ID NO: 612772 - DNA, 309 bp, Homo sapiens
aagacaaggaggaggacagaagttccggagatctaagaatctaggacctcattcacgggatttatgaaagctgtttaatacaaaagatctccatgctgtgggacccctacacagttatatggcagtcacaaaattataaagagaataataacagggcagaaccgaagctcaacacaaaaccgtttaccacggccctgtctcaagattccatgttatatcacctcacatagcatatagctagtcaagccgctgcaggaagtagcctggccaacaacccagctgacggtgactccaggcagggagacggga

SEQ ID NO: 612773 - DNA, 156 bp, Homo sapiens
cactggcttttaagaccccaactatgtagattgtggctataaatactcagcagcattaaatgttggtataagacactgttgtgggcgtgagttgtgccacctcctaatatcctgttacttcaggatgtgactgtatttgaagacagtaatttaaaa

SEQ ID NO: 612774 - DNA, 237 bp, Homo sapiens
tgatatgctgtcatcatagtatttttacgtttccctcattcctaagtcacgtgcccaggattcctgttctagcaaagcggaacatatgaaaacgtgttctctcgaccacctcccctctcactgcaacctccgtgtcccagattcaagcggttctcctgcctcagcctcccaagtcaagtagctgggatatgtgccaccacacccagctcattattattattattattattattattt

SEQ ID NO: 612775 - DNA, 176 bp, Homo sapiens
ccccatgagtttattgcggcggatatcggttactgcggtggcactctgtctggccagccccttggcactcgcctcgaatttaggggcttcctcactcgtggctttccgaagctgctgggcaagcttgaactagcagaaattccagaaggctatggcccagaacacttgggaatatt

SEQ ID NO: 612776 - DNA, 375 bp, Homo sapiens
tggcaatcatgtcatcattccaacatgatttcagctttgccattcacatgtccgtgcattatcttggctttcccccaggcacatcattacccagttttcatcattcccaatcactcccctctttgccccatctttccatgcaatctgtcagctcacacacttcccttcatttttctcagcacccaagctgtgtgctcccagtatgttacctttcaacttggcacattccccttcccgaatgtctttctcaccctttccagtgccccagcacactctcatcaaatgcattatccctgacttgcccattccccaccacaccaaacgtcccgcatgccttgtcttgtctcactcttgggcccatcttgcattttccca

SEQ ID NO: 612777 - DNA, 158 bp, Homo sapiens
atttcaaataaatagaatcatacaatatgtgaccctttgtgtccggcttcttcacttagcattttttttaaggttcatccatgttccagcatgtatcagtactttctccctttaatggtggaatactttattgtatagataagcaacattttgtttat

SEQ ID NO: 612778 - DNA, 367 bp, Homo sapiens
tttactaaaaatacaaaaagattagccaggcatggtggcatacacctgtagtcccagctactcgggaggcttaggcacaaaaattgtttgaacccgggtggcaaaggtttcagtgaacttagatcatgccactgcgctcctagcctgggtgacagagcaagactccatttcaatttaaaacaaaaaaagaatgtgtttttaattttgttaatgtttgtttgttaaacatagccctgggaccgcaaacattttacttaaacttttaatagcatttttttcgccagatactttaatatttccccttacattaattctggattcacatttttttaattgaaataaatgttaatgacaaaagttgtttgga

SEQ ID NO: 612779 - DNA, 211 bp, Homo sapiens
cgatgtctcaggcaataactctgcctggctgggccgtttacgggagacggacgcgttgtccatggtggcaatcaacaagagaagcgcgtcgctgcggaagcaaacgaatttgggtccggcgttcaacacagctgccgagtcacgcttcttgatcccgaagacttccgagcgtccgtaaacgcccgaatggtcccgatcagggtaccgacct

SEQ ID NO: 612780 - DNA, 176 bp, Homo sapiens
atttaagatagtcagtagcacattagaatgtgcagatgcataagtgtagcagggaaggttatggttgcacatgctcagggtggcgcttccaattaggtgcatgagtaggtggcctgcagtaatgttagcggttaggcgtacggccagggctattggttgaaatggtcgccaatccg

SEQ ID NO: 612781 - DNA, 294 bp, Homo sapiens
gacggggattggtccaccgggtattaggcgccattacatgggagctagcaggctcctagactcagtcaaaagtgtgtggaaagcctggtttacggacaggtgtagtggctcactcctgtaatcccatcattgagttttaataatagcactttgggaggccgaggcaggcagattgcttgaggtcaggagtttatgaccagcctggccaagatggtgaaaccctgtctccattaaaaatacataaattagccaggtatggtgtcgtggtgtcgcacatctgtaatccccggtcga

SEQ ID NO: 612782 - DNA, 115 bp, Homo sapiens
cgaggcgttagtcaattttctaatattttggtaggaatctgtagtacaatataccttgcagctgttacatacacgaaactgaaagaatatttgactaaacacatactgctgttgc

SEQ ID NO: 612783 - DNA, 366 bp, Homo sapiens
gctacgacaaggaaacaaaaaggcaattaaatgagtcggactagaaaagactgatgggaggccggacacgatggctcacgcctgtaatcccagcactttgggaggccaaggcaggcagatcacctgaggccaggagctcgagaccagtctagccaacatggtgaaactccgtctctactaaaaatacaaaaattagccgggcgtggtggcgggtgcctgtaagcccagctacttgggaggctgaggcaggagaatcgcttgaacctggaaagcggaggtctcagtgagccgagatccatacaattctactccagcctggaccacagagtgagactccgtctggaaaaaataaaaggctggtcgacg

SEQ ID NO: 612784 - DNA, 743 bp, Homo sapiens
ttcaacagtgcttggacggaacccggcgctcgttcgccaccccggcggcgcccatagccaggcctccgtcacctcttcagcggaccctcggactgccccaaggcccccgtcccgccgatccagcgtcctggcagcaactgcgcgcgccagccgcgcgtctccttaattcgccgcgcagtgaccgacggcgtcacctcgcagggtgcgccagaagtaccaccaggactcagaggccgccatcaaccgccagatcaacctgagctctacgcctcctacgtttactgtccaatgtcttactacttggaccgcgatgatgtggctttgaagaacctttgccaaatactttcttcaccaatctcatgaggagagggaccatgctgagaaaactgatgacgctgcggaaccaacgaggtgcccgaaatcttccttcagggatatcaagaaaccagactgtgatgacgtggggagagcgggctgattgcaatggacgtgtgcattacattttggaacaacaatgtgaatcagtcactacgtggaactgcacaaacgtgccactgacaaaaatgaccccatgggtgtgacttcattgagacacataacctgaatgagcgggtgacagccatcaacgaatggggtgcccacgtgaccaattgcgcaagatgggagcgccgaatctggcttgggggaatatctcttgacgagcacaccctgggagaccagtgaaaatgaaagctagcgcgggc

SEQ ID NO: 612785 - DNA, 237 bp, Homo sapiens
cccggatagagcggctcctgctggggaatttggatgttggattaaatccagagtgtcagcctactgaaacaaactatcagagaaaaataaaacaaagactcttgtcaacttgaataaaacagatactttaagaaaagataaaggttgattgaggcaaaactcatgcatcataaagtttaagtatataattcaattactttttctaaatgtacagagctgtgagaccatcaccaattc

SEQ ID NO: 612786 - DNA, 203 bp, Homo sapiens
gagtgccccatacgaggacaccctgcgaccggggtccaggaagtgaacaagaccgaacccttcgtccggcttaaccccccgtgctagccccgagttcatgggtgagcaactaccccttccttaggatgatgtgcttgagaaacctccctccccctctttccccatgtgaggaatttgaagccacaatcgccttagggccatga

SEQ ID NO: 612787 - DNA, 873 bp, Homo sapiens
  misc_feature (873)..(873): n is a, c, g, or t
tgatacctttcaagatttgggatccctcggaggtgttaggaggtaacaactgaagatggagaaaggtgttaatgtgttccgaatgtccattgatggactggaaaataaccagtcctcttggtagcaaatatgtcttcaggttacattgttggaaaaactgggttgctctagaggattgtttagtaagccaatctagtgacagtgtggaaggtgatgggaggttttattgagaaagtcccagtttcgcagaaatgatcaggaacatggttcagttagttcagcagggtgttgaattggggtaagagaagaatcaggtttcgaaggcatccaattaggaccaccaaatatgttaggtccaattctcatagttgaaaatgactctgaaaaatgtaagaaacagcgatttgagtttcaatgcactcgctgtccagtgaaaggtcaatgagcgagattaccaagaggatctcattgtttggaaaagagatagagattattgaagatttcagagactgatgaggaacaaaggggtttgttctggcagattgagatgagaacaggatgaagatagggaggaatagaaaggttaatttgtggctttttagactgtccttgaatagagctggagtggtagtggaaagtaaattaagttataaaccttaataaaggatcgaaaggcaaagagtgcagtggaaagaaattgccattggtggcagggtatgccacggggtggtgacaggggggggactaggaaaaggacccaatgggtgtattataacgaggaggaaaaaagagagccactttgcgggacataattagggagggaacagaaaaggaacaagcgattaaacacgtgggttttgtatttatgtaagn

SEQ ID NO: 612788 - DNA, 907 bp, Homo sapiens
tatcgcgttatgtttggatgccataactcgtggattttttgaaattagtggcaatgtttttcctgtttattgaggtaggtgtagggcgttggttagggatgtccttgttaaatggggtctgaaagttgttgactttgttgtctaagtgggtttaatcgcccaaggtgtgcctacttagttcggtttgtaactgacccctactgtgcacgtgggactttggcttgggccccatgtgaaaaaacgccgtatcatcacctgtgccgctctgccggtcttcaaccttgttgtcgaatactcacagagccaacgaaacttggtttgccctgtctacttctacggacgcttgctgcggttggctaagctccccaggtactttcccgatggctatggatgtgagagcctcctcgtcctgcccgtcctggggctctcactaggcccctgtgcaagcgcctgatggcttcacggactgactggggctacagccacgcagtttgaacacatcactgctctcagagaactctgcactgaccgctagctgctgtctgctgcgtcactttatctctgtgtatggctttgagtacggcataccttggagaacatactcccaacattaggaacttgatttaagcctgagagtttgaagggctttaatcctttaaaacttggagaagctggctgggcgcggtggctcacgcctgtaatcccagcactttgagagaccgaggcgggcggatcacgaggtcaggagattcgagaccatcctggctaacacggtgaaaccccatctctactaaaaatacaaaaaattagctgggcgtggtggcaggcgcctgtggtcccagctactcgggaggctgaggcaggagaatacgtgtgaacccagatacggcacgtggctagtgagcca

SEQ ID NO: 612789 - DNA, 276 bp, Homo sapiens
acccctcgttgctgcttgtgctgctggtgctcctggtactcccgggcggtcaaggtattgctggcagcgtggtgtggtcggcctgcctggtcagagaggagagagaggcttccctaggtcttcctggcccctactggtgaaccttggcaaacaagggtccctcttgaggcgggtaggtggacacggttgtcccccctgggttcccattgggccccccccttggatttgggcttgggacccccccttggtggaattcttggacgttgagggggggct

SEQ ID NO: 612790 - DNA, 174 bp, Homo sapiens
acgagccgtactggacatgttcactcagaccgcctgagtgcgccatgactggcatgctcttcattttgggtaaatgtagacttccggacctgcagggtgcccccatgcctgaagagagctggggctgccaccctgtgcccgcacagcctggccttccccttcctcagccaggct

SEQ ID NO: 612791 - DNA, 344 bp, Homo sapiens
agaagcaacatcctaagaattaaaaaaaaaacttaaatattttagcttttggaagcaacattacaggcgaatttcaggtttagagcaactaattaattaattccattaacaccactactcaaaaacagtaggtttttctgtccaggctgtgtgcctcatgcctgttatcccaacactctgagaggcccaggcaggaggatcacctgaagccagccaggctttcaagaccagcctggacaacaaagcaagatcttgtctctacaaaaaaaagttttaaaattaaccaggcattgacggttgtcaccttttattcccagctacttgagaggctgaggttggaggac

SEQ ID NO: 612792 - DNA, 213 bp, Homo sapiens
  misc_feature (192)..(192): n is a, c, g, or t
cttagaggatcccggacgcaagacatggagaagctgtgttcttggacaggtggagccacgccacattgcggagatcatgaactcttcactagaccaatcgcagtggtacctgccgcaagtcctctgctggacccaagggcaaatcctgaaggatgaggattttctgcagaaagctgccggtggcaccaaggnccaacttgttcttcggtcgaa

SEQ ID NO: 612793 - DNA, 149 bp, Homo sapiens
  misc_feature (12)..(12): n is a, c, g, or t
gtgcagattagntgataatagaatagtttttaatgaaaaatgttaagggactcttacaaaagaatgcaggctaatcaataataaagaaaagaaatgggcaggcatagtggctcatgcctgtaatcccaacattgggaggccaaagcaaa

SEQ ID NO: 612794 - DNA, 1204 bp, Homo sapiens
  misc_feature (83)..(83): n is a, c, g, or t
  misc_feature (86)..(86): n is a, c, g, or t
cctcacagggctactcagcctcaggtagctggtgccagaataacacagactcagctgccagagcctgctcttaacacctgtgnttncttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatcaaaaa

SEQ ID NO: 612795 - DNA, 1505 bp, Homo sapiens
tacgggagtatgtggttttttcgttctgttgccgttggggttgtcccatcaactcgttttttctcttcgctgtggtggtggtggagacttcactgcgctccgttgatcatgtttgtttggtggtcttctctctccttcccctgtcacatcttgttggtgggtgatgctggtcgagcatcttcgttgaagggtcgcttgtttctcttgctactgcttggtgctgttattccatagggtgtttcgggtatatttttttgatctttgtcgcctgcggtagtagactcctgcattttcgtagctcctgcgggagtgctcctgctcataatttttttgggtgtgccctctcccgcgaggtcttgaatagggcgccctcccgctgcgtgctatagtgttggagggaagtttttggtgcgccagacacaacacggggagctttttcatataccacatgtgtggacaatacatggctcacacagtagagtgtttcttctcgttgtgaggaggccgtctgaataaaggggcgatacaataggagatttcggagttttccgcctccgccgcgttgtcttcttctcggggtgttactaaaaagtagccctttgggggagaaaaaaagattgggtgcccccccctcataagtattggcttttttcgaagaatgttttctccggtgttgaagattgctcttccgccacaccttttgtgtttttggaaatatttggggtgttctcacctcgggggccacatgagccgcccccaacataggtgggttttttttttaatacgagagtccatcttttgtccacacaggaaggccttaatagacccaaccccctcgtggttgggggattcacgccgtgtttttgctgtgttgtgtcctcttgtgaataatataggattgtacctacgttacacaccattgtttcccggtgtttgggggtgttctctactactcacataaagtcatctctgggtgacaccacaaagaaataggtttacttctgctcggggagaatcctcttggctccaacaggggtggtccacacccaacagtttttcgtctcccacgcaaagggctctcatcgagaagtgcgctataaatgtagaatatatgtgtattcccctcatagatatacctcggtctcacccccccaccttttctataatctcacgctgggtggggagaagaacccggtttttcacagaacctctgttcttgtttcacaattgtggcgcactttataagtttatagtatagtataaaagagtctgggggtataattgagtaaccacacttgcacttcggtataaaccctctccacagagaaggaaaaggagagaatatttttgtggagccacctcttggttttcttttttggcgtgtggcacgcttttaaggtaattagtttttataaaatcacggaactttttaaatgggaacccaacttggcccacaaaatttgttcccacgaattttgagaccccatttaaaaagtttaatgaga

SEQ ID NO: 612796 - DNA, 251 bp, Homo sapiens
agatatcttgatgagtctcaagctgccgcccgtttgggcgaaacgcttctgagccggaaatccactctccttgcttggatcggcgaacaggaaatgaccgttcgtaaggcagtggcctgagccctaccccgccgtttcggaggtatttcagcatgccctgggaggacacaaacttgattgttacagcatttatggcctgccgaagggcacggtgacacaatagtctattttgatatagaagcatatgacgg

SEQ ID NO: 612797 - DNA, 124 bp, Homo sapiens
tccttcaaaacagagcaatggcttggaatgagactgctgatctggacttgatattggtgcccaggagaaccccttggatatcgccaggatgatcctagctgccgttcacttaatgccgctagcg

SEQ ID NO: 612798 - DNA, 612 bp, Homo sapiens
aacccttttcatcttgtacttagagtgggccaggcccttcagtttgagtcaccaaacagcctgagggccctctctgtgccgggcccatgtgagggcctggggatcagagatgaaatacccgccatgaaggcccccacaggcttgacaagtaaacgggtggggactacaccagggcttgctggggaagcgtcggaactccggttgtacgaggagaagcctgaaggtgagcccaggacgcttccccagaggatgtgacacccaaatcgaacctgattcctcagatccacaccgtcatctttgtggaatcaggggcagtttgggatcgatggatctctgagctgcctgtgggcaccaagatgctaagagcctggtttgaaagtgtgtgtatgacagggagagaaggtcagcactcccctcgacaaggagcacagacagattaagccattgtcacctacttagtggcacctaaacatcattgtttttaatgggtacaaaaaatagaccgaataagaacaagtcttgatagcacagcaggtgactatagttaataataatttaatttgtacgattaaaaataataaaagggcgggcgcagtggtcagcctataatcc

SEQ ID NO: 612799 - DNA, 828 bp, Homo sapiens
  misc_feature (5)..(5): n is a, c, g, or t
  misc_feature (61)..(61): n is a, c, g, or t
  misc_feature (63)..(65): n is a, c, g, or t
  misc_feature (72)..(74): n is a, c, g, or t
  misc_feature (76)..(76): n is a, c, g, or t
  misc_feature (80)..(80): n is a, c, g, or t
  misc_feature (90)..(91): n is a, c, g, or t
  misc_feature (95)..(95): n is a, c, g, or t
  misc_feature (104)..(104): n is a, c, g, or t
  misc_feature (112)..(112): n is a, c, g, or t
  misc_feature (114)..(114): n is a, c, g, or t
  misc_feature (135)..(135): n is a, c, g, or t
  misc_feature (159)..(159): n is a, c, g, or t
  misc_feature (166)..(166): n is a, c, g, or t
  misc_feature (171)..(171): n is a, c, g, or t
  misc_feature (180)..(180): n is a, c, g, or t
  misc_feature (182)..(182): n is a, c, g, or t
  misc_feature (186)..(187): n is a, c, g, or t
  misc_feature (230)..(231): n is a, c, g, or t
  misc_feature (246)..(246): n is a, c, g, or t
  misc_feature (262)..(262): n is a, c, g, or t
  misc_feature (268)..(269): n is a, c, g, or t
  misc_feature (277)..(277): n is a, c, g, or t
  misc_feature (279)..(279): n is a, c, g, or t
  misc_feature (287)..(287): n is a, c, g, or t
  misc_feature (289)..(289): n is a, c, g, or t
  misc_feature (301)..(301): n is a, c, g, or t
  misc_feature (316)..(316): n is a, c, g, or t
  misc_feature (333)..(333): n is a, c, g, or t
  misc_feature (335)..(335): n is a, c, g, or t
  misc_feature (337)..(337): n is a, c, g, or t
  misc_feature (342)..(342): n is a, c, g, or t
  misc_feature (360)..(361): n is a, c, g, or t
  misc_feature (363)..(363): n is a, c, g, or t
  misc_feature (385)..(385): n is a, c, g, or t
  misc_feature (387)..(387): n is a, c, g, or t
  misc_feature (483)..(483): n is a, c, g, or t
  misc_feature (542)..(542): n is a, c, g, or t
  misc_feature (600)..(600): n is a, c, g, or t
  misc_feature (634)..(634): n is a, c, g, or t
  misc_feature (695)..(695): n is a, c, g, or t
  misc_feature (820)..(820): n is a, c, g, or t
ttatnaatttgtgtgaacagtgacagcctgtacacctgtattcactcttgaacaatgcagntnnngctaaannnanatanacgggcttgnnaccngggtgtgtnatcgtcancntgggtcggagctcacggagtntcaagaggaccatcctatccagtngggccangtctnaacggtttntncttnncccaatattttctgcacgtcatcctgaggtaaaccaattattnnatgtagttagttttnagtaaaccagctatgncaattnntactaganantttgttcntnaacccatttgtnttggttttgaatttnttttttcttttttcatntntnttacnaaggcctgtctgtgctcnntngtcaagctgtcatgcatgtctnantggccagcccaaacagtgtattaatcattagcaaatggaactttaaggtgtccttatcattaaggtagtacaagtattttatattgtaaaactgangtgtagcttgatctttaggggacaggaccaccaaccaatacatgcagattttgtgtgtntggacagaaggtacttttgacattcagttttgctatatagaaacagaatgaataaatntttttttttcttttttcttttttttgcaagaggnaagtaaaagattcaatttgattcttctagaggggggaaaaaggagttgaaagtaggtcttnattttgcagtcatcatctgtacgaattcttcatagttgacttgtccgtctccatcaatatctgcttctctgatccatttcatctacttcttcatctgttagtttttctcctaagtttgtcatgangtgacgta

SEQ ID NO: 612800 - DNA, 967 bp, Homo sapiens
gctctgaacttgaaggcgtgacgtgtcaccaatcagcgagtcaccgtcatgatcttacccagcagaacgaaaactgtccatggtgataagggtcggagtcttcgtggaaattacctcgggtgtcggtatccaagagaccgttatgcggttacaacaccgctcgtgatagcaccgttgatgactcgcgagatagtgcggcgctaacagtctgcagtaccattggccctggcatggtctcctgcctttccagactctgtacggagtcgctcttcttgtcgtggcggcctacgtagcgagtgtgtctgcgtcccctgtcagtgttggcgttggggcctgagagctcgtcaagtgccccccgtatgggtgatcttccgagttctacaaagcgcatgacttggttccaccggtgtggtggagagcatcctgcccaccgacgcatcaccacgctctggtccctcctcagtggctcgctcttcctctgtttgtggcgtgccactgcatgtggttgtccttctctgtgggccttattcgttagccgctttggccgccggaattcaatgactgaatgcatgaacctgctgtgcttcgtgtccgccgtgctcatgggcttctcgataagtgggcggtcctttgacatgctgatcctgggccgcttcatcatcggtgtgtctgcggctgaccacagcttcgtgccatgtatgttcgtgcaggtgtccccatagtcgctcgtggggccctggcgaccctgccctgctggcatctctccggcttctcctcgccagggtcggctgactcatcttggcaacccgacctttggctgctgtggctatcttcccccgcccttcgtgccctggtgccttgccgcattccgtctgtctcccccccgaccgccgtgtcccctccgcccctccccctcagacaaattgctccgccccaccccgcccccccccccctccccgcctcctcc

SEQ ID NO: 612801 - DNA, 111 bp, Homo sapiens
taacttctcaggcttttacttcatggatttgttatgatctttctcttctttccacttctatgaacactgctctggctcacgctctcgctagctcctgcctgctacagtcga

SEQ ID NO: 612802 - DNA, 913 bp, Homo sapiens
atgcaggtgaactaccgaggcaggtggtgagcctgatccggatgcggaacccctggggcgaggtggagtgtgacgggagcctggagcgacagctcctcagagtggaacaacgtggacccatatgaacgggaccagctccgggtcaagatggaggacggggagttctggatgtcattccgagacttcatgcgggagttcacccgcctggagatctgcaagcctcacacccgacgtccctcaagagccggacatccgcaaatgtgaacaccacactctacgataggcacctggcgggcgggggagcaccgcggggggctgccgaagactacccagtcgcaccttctgggtgaaccctcagttcaagatccggctggatgagacggatgacccggacgactacggtggaaccgcgagtcaggctgcagcttcgtgctcgcccgttatgcaagaacgcaccgatcgccggcgagcgccgcttcggaccgctgacatggagactattgggcttcgcaggtcgtacgaggtccctccggagctggtgggccagccggccgtacacttgaagcgtgacttcttcctggccaatgcgtctcgggggcgctcagagcagtgcatcaaggctgcgagaggtcagcacccggttccggctgccacccggggagtatgttggtggtgtgcttcaacttcgagtcgcaacaaggagggggacttcgtgctgcggcttcttctcagagaagagtgctgggactgtggagcttggatgaaccggaatcagggcaatttccccgatgagcaagggctctcaaaaaggggatggcaggaacttcaggcgcttcaggcctggcgggggggcttgagatccctgaggggttggggcaactctctggtctttaacaaaccgggcacggtcgta

SEQ ID NO: 612803 - DNA, 409 bp, Homo sapiens
  misc_feature (119)..(122): n is a, c, g, or t
acccggctgcagagcacctcccaccttgcttctgtcccaaaagtacatccctacgtgtggttctctttaacaatcttaatgtctgggttggggaagcatgttaagcgcgtaaaggcaannnntactagcaggcatggttgctgactccaggccgcgttccaggaaatatcggtgggaagaacggggacgggcttgggacccttcattgaggaagtatgatgtgatcttcctgagtccctcctgattcttggatgctgagttctcccatataacatcttccgcctctttttccatgatggtctgggccgagcgccaacttaacctgacaatctggtggaagccgaacacatgctttactttcttcttcaaccatacttttgttttgagatatatgtgtattctgaaccat

SEQ ID NO: 612804 - DNA, 584 bp, Homo sapiens
  misc_feature (30)..(30): n is a, c, g, or t
  misc_feature (82)..(82): n is a, c, g, or t
  misc_feature (99)..(99): n is a, c, g, or t
  misc_feature (157)..(157): n is a, c, g, or t
  misc_feature (214)..(214): n is a, c, g, or t
  misc_feature (240)..(240): n is a, c, g, or t
  misc_feature (349)..(349): n is a, c, g, or t
  misc_feature (393)..(393): n is a, c, g, or t
  misc_feature (429)..(429): n is a, c, g, or t
  misc_feature (457)..(457): n is a, c, g, or t
  misc_feature (481)..(481): n is a, c, g, or t
  misc_feature (499)..(499): n is a, c, g, or t
  misc_feature (518)..(518): n is a, c, g, or t
  misc_feature (571)..(571): n is a, c, g, or t
acaacataaggccaaaggcagggagccggnatttttcaataatgaattagcaggggctccaagaatacaacaagagaaagtnatttttcacagtccttnagaggcttaacctttcccaatcctcctttatttgccaaggtgtgggcttgcccatttnagttacaatattcaagacgtccatgtccctcacttcagtccctggtatactccagancccacatgaacatttatgcatacccnatcattccatcaggcattggagacatgtactgggctcgcctagaacaacaatttggaccaacgtttgcatgttcccatcccagaaacacttgttggttcagggtggttnaatattttgattgttcaaacctggatcatctacctatccctggnattagggatggtttcagttcaatccgaagacagggnaggccatcttagattgataagccatctnatgttcccagtttcttttttaaanaattatattctgagagcnctcgtagtgtgaagctttnttctacatgttaaatttcacagggaaccatgttttttcaaacaaaggcataanacccagggttagg

SEQ ID NO: 612805 - DNA, 1512 bp, Homo sapiens
  misc_feature (270)..(270): n is a, c, g, or t
  misc_feature (298)..(298): n is a, c, g, or t
ggcctcgtgctgggtaccacgcagccgcatgtgtgactaccgggcagcaaccttggtgcgcacagtcgactcaggctgaatgccatgagggttcatgagtcggagttcacctggggctcacgatgaatcatctccacgtagcgaagggtccctgaccacgcatcgattgttcatgtcgatgggccatcgtaacaagactagacgcgtgatggtccacagattccagaataaagcaggagatgtgcactcaatgcattgcatgagtccagnagagtctggagcctagcacagttctctnatgatgagacccctgtttcgactggtggtgaggtatgccgtggggacgcgagagcttgtatacattgatgtaaattctacacacgcatcctcattatcagcataagtgatggtgccggctggcgggaaatttccctgtcccatgggcatcaggggtagcaaatagtgagtgcgagacctttggccttgcgcgtggcaagttccgtagggggcggtgggaccaccgcgaacaaggaagggcagttagtctacgccaaggggacaccacctggacaggaaaggaacgagcctaggcaattgcggaaagggcctttgtgtggacatctaacgtgcgggcgcattgggtacgcgccaactttgaattgtccgcgtaacaggataggcgggatctccattaaggctcatgttatgagcgccaacaaggagacatgatcgagtccagcagagctagaattccagtgtggggcgccattgacatcgcggctggacatcgggagaggtcccgggatggacgacaactttcaagttggaagcctagaaaattgtgcgcccaagacaagggggttcaatgtccacgttataaaaccttttttcccaatggcaaggccccaatgggagcacaaacagacacagggtttgtagcgcattttgggttccccatgtctttcccaaagcaaggggaccccttaagcatgaacattggacagcgtcggtgcacaacacgaatgtgctgagcacaatggcagtcaacccactttgccgacaggacacacgataggtcgtatggtgcccatgaactttctttgcgaggtgtgtcagcaagacgagactcaccgccctccatactccaagaattatgtcgtgtgagcttgccctgagagacaccttattccaccaaggccacaggcacatgtcccaatgagacgccagactcaattccacctgggggagcaacaaaaggggaagcggacggtccaacacacaaacattcgcacaaccacagcaacatcagggtcgtcagacggaacagaacaaagagacaccatacatcgtcggacgaccacgaccacgatgaagacagacactctacgccacactccgagaacaactccgcatccaataaccagcacaggtgacaagtgacaaatcacagaagggacaacagtagtgagtcgcgacaccacgaactgttgatccatttcaccacacgatccg

SEQ ID NO: 612806 - DNA, 185 bp, Homo sapiens
cattctcaggtgactctaaggatccccaggcagttgattcgagtgctgccacgagtgagatgtgcttgggcgccttttaaggccagggaaccctcccaggccccactatgggaagccagggccattcaacgccgtcctagctccaaggtgcggtcgatcacttgaaaccagaagtttcagaccag

SEQ ID NO: 612807 - DNA, 171 bp, Homo sapiens
gagttgtttctcagcttctatttgtgctttgaaaagctctagattctccacggaacacccagtatccagatcgatctcgctcctctggatgtagaagtgtttccaatctctccgataaaacctatgtgcaaattaaacacactcatgattggaatactcaaacagtattca

SEQ ID NO: 612808 - DNA, 113 bp, Homo sapiens
ctagcgttgttctgcttccaattaggtgcaccagtaggctgcctgcagtaactgttagcggttaggcgctacggccaggactattggttgagcagagtcgcgctattgatgag

SEQ ID NO: 612809 - DNA, 557 bp, Homo sapiens
tccggaggaagggttccaagtggtgccgaccttgcaaagagaagattttgatgtggaagcagctgactcagcgggaaactgccttgggaggttattttttgaagcaggagagcggcaatttggtccttactgtggtcatggattccctgggcctctaaatattgaaaccaagagtaatgctcttgatatcatcttccaaactgatctaacagggcaaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtccacctgtggactgtggcattcctgaatccattgagaatggtaaagttgaagacccagagagcactttgtttggttctgtcatccgctacactttggaggagccatattaccac

SEQ ID NO: 612810 - DNA, 284 bp, Homo sapiens
gttcccttataaaagaaccccagaaaattttttttccccccctttttccccccgggtgaggaaacaatgtgaaatcggtagtttccaaaactggaacttggccaggggggcccccttatatcaaacgtcccgcttccccaactgtgagaaataaattcctttttttttataagcccccccgtttgtagtatcccattatagccccctgaattaaggccttttcccatggggagattttaatgggatgtaatttaaacccaataaagttttttaaaagacccata

SEQ ID NO: 612811 - DNA, 310 bp, Homo sapiens
  misc_feature (24)..(24): n is a, c, g, or t
  misc_feature (34)..(34): n is a, c, g, or t
  misc_feature (36)..(36): n is a, c, g, or t
  misc_feature (50)..(50): n is a, c, g, or t
  misc_feature (67)..(67): n is a, c, g, or t
  misc_feature (78)..(80): n is a, c, g, or t
  misc_feature (106)..(106): n is a, c, g, or t
  misc_feature (133)..(134): n is a, c, g, or t
  misc_feature (144)..(144): n is a, c, g, or t
  misc_feature (147)..(147): n is a, c, g, or t
  misc_feature (151)..(151): n is a, c, g, or t
  misc_feature (155)..(155): n is a, c, g, or t
  misc_feature (159)..(159): n is a, c, g, or t
  misc_feature (182)..(182): n is a, c, g, or t
  misc_feature (213)..(213): n is a, c, g, or t
  misc_feature (267)..(268): n is a, c, g, or t
  misc_feature (309)..(309): n is a, c, g, or t
atttacccaaataaagtataggcnatagacattnanacctggcgcaatanatatagtaccgcaaggnaaagatgaaannntataaccaagcataatatagcaaggnctaacccctataccttctgcataatgnnttaactaganatnactntccnaggngagccaaagctaagacccccganaccagacgagctacctaagaacagctaaaanagcacacccgtctatgtagcaaatagtgggaagatttataggtagaggcgacanncctaccgagcctggtgatagctggttgtccaagatagaatnt

SEQ ID NO: 612812 - DNA, 797 bp, Homo sapiens
tgctgtgtggactgtggacgaagcgggagtatcagtaagcggagatcgccaaagatgacagtggagccccaccctggtgaatgaacatgatctctggcctcagctatggagcacttaatgccagctaccagtgccgtcctggccgagatgcagctttccccctcctcaacagccctggcatgcttgaaccctggctccgccagcagcctgctgcccctcagccactgatgacgtgggtgcccctcgtggagcctgttgcccagcaacaggatagcgagcgagccgctcctctggctctccccgccccgagtatcagccgaccatgtgtgcaggtgacatggaggatccagcagatggcagaggaagacatggcatgcccggtgcctcccctgggcgccacctaatcgccagcgcctcgtgggcctccgggaagacgagaggagcctggaggaggagctggcgggagaatgaactgtcctaagggcctgtaatgaccggcagggctggggtgagacccctccctttccagaatccattgggccccatctacccaccgaattccaccagggcgcctccacgaggtctcaaggaaaagttgcaggaactcagtagcggtgtaggggcctgtggggctagctaggctctcagttggttgagcttgacaacaaacacggtcggggcagggaacgtgatcaccaacacactatgggtaggtacccatggaacttggacccaagaaatggaaatggacggggttacgagactatttaaaattgttctcgatttaagtatgtccc

SEQ ID NO: 612813 - DNA, 230 bp, Homo sapiens
ttatcctgagtcagcctcctgagtagctggggctacaggtgcatgccaccaccaccagctaatttttgtatttctagtagagtcagggtttcaccatgttagccaggatggtctcgatctcttgacctctagatctggccgcctcggcctccaaaagtgctgggattacaggcatgagccactgcgcctgggcaggagcatgtgttttctcatcttgggcctggatcgag

SEQ ID NO: 612814 - DNA, 218 bp, Homo sapiens
tagcagggtatgtgcgtataactaactgtaaccttaagctcccaggtcaagctggtcctcccagcttaagcctcccaagtagctgggaccacagacatgtaccaccacattgggctaattttcttttcttcttcttttttattttttggtagaactgtctcaccttgtggcccaggcggactctagagcccctggcgcaaaaaaatatctctggcctc

SEQ ID NO: 612815 - DNA, 149 bp, Homo sapiens
  misc_feature (24)..(24): n is a, c, g, or t
caggtgcttcaacatcgccagccnctgagctactggatgtgcttcacttctgcttccagttcactacaggtttcttttgtggcgaacttgggcctgggaaacataaagcagaaagaattctgggaagcacagttccagcttagatattg

SEQ ID NO: 612816 - DNA, 104 bp, Homo sapiens
cgacgcgtctctgtagggctgggatcctcctcctcctggtcttggacatcagaattcccggctctctgactatgggagctccaggacttacagcactgccccca

SEQ ID NO: 612817 - DNA, 158 bp, Homo sapiens
catcttagagatcccccggaagcggctactgtagatccgcttcttcctctgattcttctatctgtcagtcagtttctaactcagcgttagccactcgattcacctggaacatagtcttgccttttcccggatactctttgtggttattactctttctt

SEQ ID NO: 612818 - DNA, 894 bp, Homo sapiens
  misc_feature (58)..(58): n is a, c, g, or t
  misc_feature (108)..(108): n is a, c, g, or t
gagtaggctaggtacgaggccttgtgttaatcggcaccgaggcagtaatggcggagcncgcaactcccggaacaacagccacaacatcaggagcaggagcggcaagcngacggcggcacagctcccccaccccgatccccacagtcaccgccccgtccctgggggcgggcggagggggcggcggaggaggcaggggggggtggataaacaggtcacctgcaggtattttatgcatggggttgtaaggaaggagacaactgtcgctactcgcatgacctctctgacagtccgtatagtgtagtgtgcaagtatttcagcgagggtctgtatatagtggagaccgtgcagatatgaacatagcaaaccattgaaacaggaagaagcaagtgctaccagagctaactacaaagtcatcccttgcttgcttcctcaagtctctcatcgatagttggcccatttgttgaacttgaatacaggcgaagctgagtcaagaaattcaaactttgcaactgtaggagcaggttcagaggacgtgggtgaatgctattgaggttcgtcctgggcaagcctactgtgggcgtactgcgcttcctgcaatgaagcaccctgcaggctcagtgaccagggaagaatcagagaagagcaaaccgccgtgggacaaaggaagcaggtgtgcccctattcttgcagtgcgaagtgccgatacgggcgcactgtgtttcctcccgggatcttgtactgtttgcgtgaggtctggctccatggtttgccagaggacgaggtataatcggggttgggccctggagggctgggccatggggggcgcgaggacgcgtcgggccctgcgggctgaagcccgggcggttgagccccatgccccgttggcccgggggc

SEQ ID NO: 612819 - DNA, 211 bp, Homo sapiens
tgaaattaactcgttaaacacagtctctcacttgagctgttaacaattcacaaccacagtgtatgcacctctgcactcacaagaaaaacaatagatcatgtctaatcttggcagagtcctactacagatttttaacaacgagggaggtcagtccatttccttatagcctgtgtggtgatgatttgtacacatggaggtcttcaatgtctgg

SEQ ID NO: 612820 - DNA, 417 bp, Homo sapiens
ccccttaaatgcgcacagaagttagaggagagatagtgttaggagccctttggagaacgccaggtctcccaggccccctgtcatctatcgagtatgctatgttcacaatcatctctgatcttgtgctcagcatgattctttaatagaagttttattttttacgtgcactctgctcatcttgtgggtgagccagtgtaccagcgggagacctgtgccatttcaagggcacatacatttagctttgagtttttgtggccccaagcaactatggtgtaatccgtgcctttttgcattctccactgccctttttgtaaatgctagtttttatatactttttattctctacgtgacctttgggggagcctgagtctaacagtttagtttttctctatcactttctgtgcccgtctcaagggt

SEQ ID NO: 612821 - DNA, 738 bp, Homo sapiens
  misc_feature (738)..(738): n is a, c, g, or t
aatatcattcgatgggcagcacgagataaagaaagcacagttatctatagagaactcgtaaatgctagattcctgttcttcacgagaaacatagtagtgaaagaaattattgatggatgtctttgctgacatctagcaattagctcatattccatgagacagagtggcctacagaatgatttcatgttactctatccttctgaagctactcacttgatgtgtctagtacctttgaaactaagcttttctttctttgttcatgacagtttaattccaaatatttactattttctcttgtaactgttagaacagttccttttgacattaattctttgcctacatatatctttcttaagttgagaccaaatcgttgcaagtgttgagcaagtaacatttatgatgtgtgtcatattggaacaaatgtaaaagggttacaaagattagaaacagagtcatacacaccctggcttgatttactaaaggcattaacttattggtgctctatataatggcactatactttgaactacaaatttgtctatacagtatgtcagccattcttagtaacttctctttgaatcccattttaacatatctaatatttgtacagacttgacagcagtaccattcttcaggcccaattacctatccaaacttataataactttataaaaattaacacttccaaaaattacattcaccctagtattcaagaaccaccagcccctacactgctan

SEQ ID NO: 612822 - DNA, 834 bp, Homo sapiens
acccagagagcgttgtgtggttccccccacacaggccgctcccaggacacgccccgccgagggcatctgtgccgcgtacacacatcaaagagataagtggccgtgcccgcaccaccctctctcttacgtcccttctataggggacgcctcacttccaagagcatggtgtttctcacttaccatccccgtcgcgcaagaaaccctctttgataggggcgcgacacgctctcttgccgccggcgtagcgagacaacgactattctgtctcatcaagcgtgccacctctcgcgcgcacacacaagggagcgggcgatcctccccacgagcgctgccccgcgagtgaaaacgccctccatattaccttcgcccccccacccgcgatgggtatttatcgcccgcccgaccccgcccgcacaaggcccgcgccgcaggatcagcgctctcaacgctcgacgagggctagcgcccgagagccgccgccgcgcgctcacaaacagatatctcgcgtacgagaggaggcgtagccagccagctccccgggcatagatcccccaacacaacgaggagggaggaaacgcgcttcgcgagacaaacaagttcctccccgaccgcgcagtctcccgggccaccccagggcacggcacacaacaaacacagtcccgtgggctcgcgcagtggagcgtggcacatgccaccgccgcaaggcgcgcttcataaagggcgccgactttcggttccgttagcatcagggcatccccactcccctcgcgaaaagacaggaggacgttttctcgtggcacctggaaaaaaacccccgccccatcaaatgaacaa

SEQ ID NO: 612823 - DNA, 106 bp, Homo sapiens
tttccacagggtagtacctccctacagctttgtgtttttagccacacttaaaaaaaaaaaactggttatttaatcatccattcattctttaaaaaataaaataaaa

SEQ ID NO: 612824 - DNA, 819 bp, Homo sapiens
  misc_feature (344)..(344): n is a, c, g, or t
  misc_feature (353)..(353): n is a, c, g, or t
  misc_feature (362)..(362): n is a, c, g, or t
  misc_feature (364)..(364): n is a, c, g, or t
  misc_feature (366)..(366): n is a, c, g, or t
  misc_feature (504)..(504): n is a, c, g, or t
  misc_feature (511)..(512): n is a, c, g, or t
  misc_feature (533)..(533): n is a, c, g, or t
tggccgcatcgttttttattgcttacacatgatcaaatactccttacataattaaggagaacaaaatggaacttaaaaaattgatgggacatatttctattatccccgattacagacaagcctggaaaatggaacataagttatcggatattctactgttgactatttgtgccgttatttctggtgcagaaggctgggaagatatagaggattttggggaaacacatcccgattttttgaagcaatatggtgattttgaaaatggtattcctgttcacgacaccattgccagagttgtatcctgtatcagtcctgcaaaatttcacgagtgctttattaactgnatgcgtgantgccattcntnanatgataaagacgtcattgcaattgatggaaaaacgctccggcactcttatgacaagagtcgccgcaagggagcaattcatgtcattagtgcgttctcaacaatgcacagtctggtcatcgggcagatcaagacggatnagaaatnnaatgagattacagctatcccngaacttcttaacatgctggatattaaaggaaaaatcatcacaactgatgcgatgggttgccagaaagatattgcagagaagatacaaaaacagggaggtgattatttattcgcggtaaaaggaaaccaggggcgggtaaataaagcctttgaagaaaaatttccgctgaaagaattaaataatccaacgcatgacagttacgcaatgagtgaaaagaggcacgggagagaagaaatccggctcatattgtttgcgatgtcctgatgaactattgattcacgtttga

SEQ ID NO: 612825 - DNA, 161 bp, Homo sapiens
gggcgcgctgacaaatacatatacaaccgatatgggttggatgccttatccttatgcgtgtggggtgaggcgcggatcagcgtttcgcgatcggcccgttcgcgcggcagatcggccgtcagtttcccgtccgccatcaccatcacccggtcggccagtga

SEQ ID NO: 612826 - DNA, 391 bp, Homo sapiens
gaaggtaggtcttgttacattggtaaccacccgggcccccatatagtaaggtctatactagataatcctagatgaaatgttagagatgctatttgaaccaactgtggccatgactgaggaaaggagctcccgcccaaagattgggttgttttcccggaggccaaacccaaaaaggtttggcaaagtcagggtcagggagattttgccctgttgcagacctcgggggggacacacgctgcaaaaagctttccttgaaaacaaaggggtttcaaaacattttgcccccccattagcttttttttatttttttaactttttggggggaaaaggatttttgaaaagtttgtcttgcaagggatttaaaaaaaggaaaaaaagtttttccccttta

SEQ ID NO: 612827 - DNA, 202 bp, Homo sapiens
ggggccggaaactaatgtaagaagaatgaagaggtatgatccacacatgattacgaaagctcagatatgcttaaatacaaatttatggataagttgcagcccttttttcatgacatacaacttatacgcacaatgtgaatacctctttctttcctaaccttcttctgacgttcctgggttcaattattttatgtctgtgggg

SEQ ID NO: 612828 - DNA, 970 bp, Homo sapiens
  misc_feature (725)..(725): n is a, c, g, or t
  misc_feature (967)..(967): n is a, c, g, or t
ctattttaagagaatgtttctctctacacataaactgggctgttctgcgtgaggggaagtacaggctgtgagaaacaaaagtgcatgagccatccggcgttcccagtgtctgccgcagacccaaagttaaggtttgcctttaattttatcagctctctttacccgctattttgtagtaaaactcattttctattttcatcatatgcttctcagattctcactagtttgatagcacacgcatatacatcttttactgaaataatactttctaacgtaatgagcacttacattaatagcctaagcaccacccaacacacatccattcctctcagaagctccccagtccctgagcctagaggctcggcctccctcagctccaagtaattcctcctcaaggcaccagtgtggagggcatcgcagaacgcatccgccccagggactgggagctcacactggcagccctccatggggagctcccccttcagatctgacccttttctgattctctggccattgttctttccaccgcaatcaaacatgaaagagcgtttttgccttcctgttcttctctagaattgtgtttatttaaagtccttaagagaacatcaagaagtgaaagaattactattctcagtagtaccaccattctaagcttgcacataaacattgtctctcctgggaggaaatgcctggattacctgaagacccggtcagtgtgttgtggncaggtctcagcctggtcagtgtgtcatggccggtctcagccctggtcaggtgtccatgcaggtcagcctggtccggtgtctggccggtaggggccctcagatctcggcactcaaggcctctaaggtgtgagctccggtttgacgcccttaacgggccggaactgttacggttagcccacgggtcgggccaaccgttgaggccaatgggctttcgcctcctattttcctgtggctggttacanaca

SEQ ID NO: 612829 - DNA, 264 bp, Homo sapiens
tatggtgtgtagttgcaagagtttgtgaaggtttttgacaattattttagccttgtgaagtattcgtaattgtaacaatgcctttcagcgatggtacatgacattgattaaacatctggttctgaacttacacactgatgcgtagtactcatcaaacataatgtgacaggtcctcagcaagggagccatacatttttataacattctgatatgttttaatgcatctgagttagattttactgaaataaagcactctttcaagga

SEQ ID NO: 612830 - DNA, 168 bp, Homo sapiens
  misc_feature (74)..(75): n is a, c, g, or t
tcgactctaaggacttcaacacgcatctgattattattggtatattgaagttagagcatgatcacatatgtatnnaggcattgaaacactgtcatcttcttattcacttcctgtcattgaatcctagattactgaggagactgcccctgtgggaggtcctttgtgggt

SEQ ID NO: 612831 - DNA, 275 bp, Homo sapiens
  misc_feature (55)..(55): n is a, c, g, or t
  misc_feature (66)..(66): n is a, c, g, or t
  misc_feature (84)..(84): n is a, c, g, or t
  misc_feature (87)..(87): n is a, c, g, or t
  misc_feature (99)..(99): n is a, c, g, or t
  misc_feature (146)..(146): n is a, c, g, or t
  misc_feature (162)..(162): n is a, c, g, or t
  misc_feature (212)..(212): n is a, c, g, or t
  misc_feature (218)..(218): n is a, c, g, or t
  misc_feature (223)..(223): n is a, c, g, or t
  misc_feature (242)..(242): n is a, c, g, or t
  misc_feature (255)..(255): n is a, c, g, or t
  misc_feature (258)..(258): n is a, c, g, or t
cccaattttaaaatggttcaggcccccatagctttaggggatgaagaatttgccntactttgcccngttcctaagactgtgagntgncaaatccctagnctgtaagcttttcaaggagcaaaaggggcattttttccgggtcatgnaatttttttaaggggnttggcagccctttggaccctgtggaggactcaggaccttttgtttgatgntgctgncaagncctgaaaaaaaatcccttnaaaaaaaaacccnttnaagggtagcaaaaccga

SEQ ID NO: 612832 - DNA, 559 bp, Homo sapiens
ctcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaaagaccgaattccagaaaaggctgtcctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggcc

SEQ ID NO: 612833 - DNA, 221 bp, Homo sapiens
agttgtgtcctgcagactgcacaggaagcaatgctatctgctctgggtgaggcctccagaagcttaccatcatgtgcagaaggtgaaggggagccacgtgtgtcacatgtgtccgagcagggagtaacgagagagaagggggccgtcccacggctgtttctaacaatacagatctctatgaactccctgagaagaactcactccagtggattgtgctaaat

SEQ ID NO: 612834 - DNA, 218 bp, Homo sapiens
gcagttgtgccgcctctgcctctcctgcccccggcacgctccccccctgggccgtggcccccatcgcaggctcccctccgtccttctcgcccgcgtcgcgtcctgcccgcccctggcgcactccgcgcctgccgccgccgtttttttttctggttttcttccccctttcttctttccgcgtttcccgcccctggcctcctgcacacctggtcgcgctt

SEQ ID NO: 612835 - DNA, 620 bp, Homo sapiens
  misc_feature (490)..(490): n is a, c, g, or t
  misc_feature (544)..(544): n is a, c, g, or t
  misc_feature (555)..(555): n is a, c, g, or t
  misc_feature (570)..(570): n is a, c, g, or t
  misc_feature (593)..(593): n is a, c, g, or t
gaaattcaattgagactacccacagtaggatatattatgagcttcctgcctctattcctttgtacttacttaccttttgcttgggcaaatattaacagcaatggaatgaaagtgagagaaacttaacaagttttaccttagagcaaggtaaagctttaaagagagcatcattagagcctttagagttcctcctttgctgtgtttaattcaaatattagttgaaataaaaagcagtactgagttatattccatcaaatgattcttcatctttagaaaacactaagacaatttgcctgaactgaatgtttaccagtttttattgctactcctcctcctctctccaaataaacaaaacaaataaatatccaagactgcaagattacttcatcttccacaggtttgcatgtacaggcatacctcggagatagtgtgcacttggttccagaccattgcaataaagtgaatactgcaataaaatgagtcacaccantttttttggtttcccagtgcaaagttatgtttacactgtattatagtgtattanggcgtgcaaangcattatctcaaaantgtacatacctttaatttaaaantactttattgttcaaaggtggctatga

SEQ ID NO: 612836 - DNA, 937 bp, Homo sapiens
  misc_feature (69)..(69): n is a, c, g, or t
  misc_feature (125)..(125): n is a, c, g, or t
  misc_feature (176)..(176): n is a, c, g, or t
gggtggctgggccggggaaatggcggcttcagcgagagagcgggacttcaggcggcggaggcagcaccnaggaagcatttatgaccttctacagtgaggtgaacaaatagagaagagagactcgnttctaacttcgaaaatcagattgaaagactgacccgtcctgtcctctactncaatttgacccatttgagttcttcagatcagcatcctggacagttacagatgcacgcaaataacacaagcaggtttcggcagttatccatcttggtgcatcctgacaaacaatcaagatgcatgctgacagcagcaccaacacggctctttgaagctgtggacaacacgcttacaagttgctacctggactcaggacgcaaacagacagacgggccctgtgatgtaattcacggcacggacacagaatacgtggaaccagcacctgtgacaagaaggcgacaaaaacaaaccatacttaacagaacggacacggacacaacctagcaacttggtacgacggaacggactgattcctgacgactggttcaatcaaccaacgctggctctactacaacccggacccactgaatacctgctcctggcacgacgcttggcccacctctcccgcctcggccacgacgacgacgacacgcccacaaccaccacttgccttgacacacggcaacactgaccccacgcggccccgacccgacgcctcgcaggctcactcgcaaactccagcggcacatcacgctgccaccatcgatgcaggtgggcaacagacaaccatcactctttgtctggtcacctgttccgacaccttggctctcgtgctgcgccctctgactggcgtcctggaaacggtcccacaatgtccacatagcgaaccggtgtgaatgtacaacctcacgacgctcgacacttcgcgagcctgttcccg

SEQ ID NO: 612837 - DNA, 908 bp, Homo sapiens
  misc_feature (8)..(8): n is a, c, g, or t
  misc_feature (73)..(73): n is a, c, g, or t
  misc_feature (130)..(130): n is a, c, g, or t
  misc_feature (136)..(136): n is a, c, g, or t
  misc_feature (138)..(138): n is a, c, g, or t
  misc_feature (147)..(148): n is a, c, g, or t
  misc_feature (154)..(154): n is a, c, g, or t
  misc_feature (164)..(164): n is a, c, g, or t
  misc_feature (167)..(167): n is a, c, g, or t
  misc_feature (244)..(244): n is a, c, g, or t
  misc_feature (317)..(317): n is a, c, g, or t
  misc_feature (321)..(321): n is a, c, g, or t
  misc_feature (339)..(339): n is a, c, g, or t
  misc_feature (423)..(423): n is a, c, g, or t
  misc_feature (427)..(427): n is a, c, g, or t
  misc_feature (432)..(432): n is a, c, g, or t
  misc_feature (522)..(522): n is a, c, g, or t
  misc_feature (530)..(530): n is a, c, g, or t
  misc_feature (780)..(780): n is a, c, g, or t
  misc_feature (828)..(828): n is a, c, g, or t
  misc_feature (839)..(839): n is a, c, g, or t
  misc_feature (869)..(869): n is a, c, g, or t
ggggtccngggggggtggggggggggggggtccatacccagtccttggagttgggcagggtaggacgctgggnaagggcagtgctgtctcttgcttacagcctgggggctgcgggggcggcgggtgtggnctgggngntcccaatgnngggggnttgggttggngcnccatccccttcctggctgggctctttggagggctcttaaaggggtgggatggggtgcgggcgaggtgctttgggggntgggtggtcaccctattcctgcttaggggtagaggaagaaggtgaaggcggctaggtgcccataagagggggntggngcaatcttcattcccgcnagtgtgatttcagtctcaaaagatgtgtttttggctgagaaatggaagggtactccaggctccctacggtgttgtgctggggcnttgntgggntgcccttgctggctgccctgggtgctgggggcgggcatgcggggcactggggagggtcagggccgcgaggtggggggggatctcagagcncaggctcnccactgagcttggccagcgagctttgggctccttctgaggggctaaaagtgaaggaagatgacatcctcatttctacctgagttgtgctcgcacgggagggacatctgtactcctgtggatgagaaggggaggccgcatacttgcctcctgtgtcctatggaggagatttccatcacatcctttccacccctccctccccggcccttgggcccagctctggccaggaaagtggggaggccataaaggagnaagaacatgcctttcattttcttcctatgtccttatcgtccatacatnccaaatactanggagctgaagaagacggtgactcccaccanggagacagtggcaggtgctgtgtaaaattggcggtaatt

SEQ ID NO: 612838 - DNA, 118 bp, Homo sapiens
cggagatcgcgccactgcactccagcctgagttgacagactgagaatccattctcaaaaaaaggacaaagaaactaaattgcttgtctaacagaagtggtctcctggaggtcttctga

SEQ ID NO: 612839 - DNA, 396 bp, Homo sapiens
ttggtctcaccacgtcggcaggctggtctcgaactccttgacctcaggcaatccgccggcctcggcctcccaaactactggggatcacaggcgtgagccaccatgcccagccggttggtttggtttttggggacagtctcacttttatggcccagggctgggggtgcaaaggcacgatctcggctcactggcaacctccccttcccgggtcaagcggttctccggcctcagcctccggggtagctgggattacaggcatgcgccaccacgccagtctatttttggtattttaagtagagaccggggccttctccatggtgggccaggtgggtctcctccggacttcaggtgatccggctggcctcggcctcccaaagggctggggggtaccgagct

SEQ ID NO: 612840 - DNA, 325 bp, Homo sapiens
gtaacattcggtcacatcaaattcctttaacttagtttcttagtgggtcccccccacacgcagatatcataacttatgagtgtaactacagttccaaagtaccctcatttatatggttttcttcaatttttcactacaaatttctgaatgtttctaaattatccttgcaaagtcagaagacaaattagtacagtcactgggattaaggttgagaagctagtgcttttcctgacaatgatgcctccctagttcatagtcatttgtgtctaggagaaaacatatggacagaatgttcaggacagaatgttcaggacacgaatgttca

SEQ ID NO: 612841 - DNA, 1238 bp, Homo sapiens
ttcctttttcgtcagtagtttttgtgtgaaaaagttactttgtaatccaatgccttcgtacctattttgggttggcttctctgggattttgcgatgtgaaaaggctctgcctgctgatgccaggtcccttggttgtgttccagcgtaaacgttcacgtggtggggtctcattttgctctaggtttttgtctttagcgaaggcccttgtagcccagaatatgtgaaagatcatggtggatggaaaggcgccctgaccccttttgagatgggcgaacgtgagaaagacgtggatgtgagatcgacgggcgttctcaaacagtatgtcaatagagggcttcgacgcgtttgcaatgcaacatagtcttaaatagttgtaagaggattgggtaaagtgaaagtcgtggttatcacagaactcgtgatggtcatgcgtaaatcaggcacgtctactacacgggcattatgacgcatatctgagagcgcacactaattgtatcaatgccgtgttgctaggactttttaccacagtactcaagcatagctcatgtgattagagaaacctctctgtaatactgtgtgaaattgcacgagtgtttgttctgacctttgcgtgttttgcacccgaatttctatgtaattgtaggaaactccagtttgtatcattattatctgcggaaatatttcttgtctaaaagagtgatttctgtcttaatcgcaatttcgttggtaataccacatgtgtgcaaagttagtgaaatcttagtaccttaacttcaaacatttctgcttctacgaataagtgtcccattattcatagagatctcgagactaactataggttcgattggatatgatgtatgtgtgtgatagttgtagtaagctcttctactattattagggtcaatgttaatgggcaacgtcgataggtgttcgtgtcgtagagtagacatagactacgtatgttatcaacgactagtcaatgtgtgtctatgaagtggtatgattgatgaattctatagtttgatatgtctatttaagttatcctgattctcttaaaagtagttatgtgggagtacgagagcaacatcaatataataatatttccgtgtaatagccaccaactgttcaggcataggttttacttacaactgttaaggaggtctttgcttcttctttagataacaaacttgtttgccctaaagaatcctaatttgtacacttaacatgtattaacttcg

SEQ ID NO: 612842 - DNA, 446 bp, Homo sapiens
taccgagactcagggcttcctcgaagaggggggagactctaaagagtatggacacccccgattcgaaggagaggacggccgtaaggaaggcgccgatgcctgcagggccaattgccacctacgagaccgtacagtgtatcaaaggcggacacggcctcaggcggggtttcgtattacttctctgaaggcaactgcaagtaagatacctcgttataacggctcgttaacgatctcacgagtaggcctacctagcactaaaagccagttccaagcgtacatgcgacatctaggtgaccactctgatgtaactggggggaagccagctgcatcccagtgcggactggaagcacgctactaaacgacatgacgtgagaatggctaatgtgctccagagcgacgtctacaaccagtgcgctcgggtccctgatagggagcttagtcgggct

SEQ ID NO: 612843 - DNA, 816 bp, Homo sapiens
tgggcaaggcggccgcgatggctcgtagctcgggcggtggcggcggtggccggaggcggtggtgcctcctcctcctcgccccggcgccggcggtgatccgagctgagcggcctccggcccccgatgagcactgctggcgggctggctgtgccctgagcctggctgtccgtgtggctggcgcggaggatgtggacgcattgcggatgcccagcaccaccccggattcccgtgataccgtgaaacattgaacttatgctggcccaggagatgtggccctgtcagggaatggcacctgaggaggacggcgcagcggaaggggacgaaaccgcaactcaatgatgcgatactggttgtggcacacacgacagaaggaacaaattcacctggcgagaaattcaaccttcgaaggggcttggctccttatggacagccagagaagatataaccccttgcaatccaactgggaacacaaccaggcatctctattctttatagcaaccaaagaatggccacttttgaagcgaccaattcggactgcttggggcactaatactacattccgacacgtttaatttaatatccaatttctccttatacatggggttggccttaccagatacggtggggatatcacaacacagcccccatgagtctttgacaaattggcttcctctaaggaaacaccagattctttaacgtccaaaacgtgggcggttttgagccttaagtcggcacatcggaaagtgacactcccaaagtgggtagcacagggcgggattatacggccaccccgaggaaatttccagggtgagtcca

SEQ ID NO: 612844 - DNA, 452 bp, Homo sapiens
actctagccggatccttatctggccagcacgaatctcccggggttaggcatttgtcgtcaccgccagatgcctgcgccgtcgctgatgggctagtgcatgccctgctggaccttcggttagggcaaccggacttcaaaggcttcggcatacgtgaagagaacggcgagaagtacttggcgtacgaattccagaacccgatgccggtacgcgaactgaacatccgtggcgcacacaaccagtccaatgccctggcggccttggcactcggtcacgcggttgggctgccattcgacgccatgctcgcgagcctgcgcacgtatgccgggcttgagcatcgctgccaatgggtgcgcgatctcaatgaagtcagctattaacaatgactccaaagccaccaacgtcggtgccggcccttgaggccatcgcaggcctgggtgccgatatccgacgg

SEQ ID NO: 612845 - DNA, 1191 bp, Homo sapiens
cgattggttgtcactgattgctccatggcctctccatttctgcttcctcgtcactggagtttcccgcttggttctgcgcttctttggtcatttttttcctctctgtatatcgccttcttttttcgtgtacccgcgacctggggccctgcccctcccttccgcttggcggttttatttcctttttcgcgccagctggttccctcgtgtatgtttcctgtgctctcttttattcatgtccgtcttctgtccttgtccccccgtagtaggtcttcccgcctctgcggccttctctttgtgtggactgtctctctcggattgtgtctcccctttttcggtgcctcttcagatacgggtggtcttgtccttttcgtccttccggggtagatgtctgcataccaatctgcactatggtctcgcctctgtcgcccatggaaaatgtagtccttaactgcataactgttaacgtctcttggtcctggtgctgcctctgtcccctggtgcgcgtctaatttctgatccctctttgtgttgtaaggtccaatccaaggtctctggtcacaggcccatgggtcatgttgatcgggccaccccacctacgccatcttggcgcccacatggtctcctgtccagtcgccatgtatccacctcctggtcccggtctccgtgtatctggcattctctggcttgatggtcgcggtgcacaagtgttacatgcgtgagtatcgtctctctactatggacttgccccgtgggtcgtggtgcagtgtgcatatcccgagcggagcctccagtcgtgtaccatctccgtctctcccggctttccgctcctcgtcgggtgccccactcgtgtgcttcttgtgggctcttcagtccgggaacccctcttcgggaagtatgaccgttgttacagaagcatcatccctcaccgttccgccgccgaactgtgcacaggcacaaggcatggctcccccatcccgcgtctgtcattctcgtgtcagtccgtgcttgatcactgggacgccatctgagctcccacagggatccctcgaggccccatcaccgttatcgcgagacccttcctaccccccattcctgcggcgctgggatctatttttgcccaatggggggggatgggcgggctggcgccaccgaacctgcacataatccacttgatctcaatgacagtatcat

SEQ ID NO: 612846 - DNA, 181 bp, Homo sapiens
ctggcaactaaaatagatggaattccaccattctgaattttttcaaaaaataaataaaatcacatacagttaaaaaaaaaaaagaatggcgaaacacatttgtcagagattacttcaccggtgttcctttaaaggtcttgaaatttggccaggcgcgattggttcaccggcaatttgaatt

SEQ ID NO: 612847 - DNA, 244 bp, Homo sapiens
ccatgcttacgagatcgaaagggacatatatccacacatgccacacagcagcacataccaacgcacagcacactccaacgcacagcacacacgcaaagacagcacacacagcgaggacacggcacacaaccgcgcaggacacgcacccacgtgcacgcacagcacacacactagcacacagcagacacaccaagacacagtacacatggaaggcacacacacgactaggtaggcatgacagata

SEQ ID NO: 612848 - DNA, 448 bp, Homo sapiens
caggctagctcctccgcgcatccacgttcaaccgaggctggtgatgttggagcggccaccagggggcgccacgatgcggtggccggtgcgcctgggattgttgtcatctatctgggcacctgaaagagagcgccaatcgctgctggatgggatctgttagcatcagttccacgctgctcctggaggccatgtactctgccatgcactccaccttagcagaagtcgtaaccccgccccatcttcaggtgttcgccactggacccaccttcattcagggctcagtccaggaccagccatgggaagcctccctggcctccacagagtccactgctccctcttctgtgcccctcagtccctgggctctcccccccttcagccctgaccaccttgtggtgttcttgtcaaaatccccagtaaaatccgacattcctgagacaggtgatcaaac

SEQ ID NO: 612849 - DNA, 532 bp, Homo sapiens
acgcacaggcccttagtcacgtaggtccacgtgatgtcgctttcctaccgtctcaaagcaggttcatgaaagcattgaacagagttcagtcttcattttacacaaaaaaaaattcctaataggggctaaaatctggcaaatttctccattcgattacaatctacaaagataagccagcattcttttctctttctctctttgggttacttttcccctatccctacgggtggacagattaattctttcacacaggtttcaaagcaaatacattatgtgggtttctagtgtatggtacagaatccattctcattcttaagtggctacattatgactcatgaggcagggcagcagtacaggtgcactctcggtatactggctgaaagtcttctggtacacatggcttttggtacccgtcgcttcgggctatgtatcttccggtactctgccctcgtctcaaagtatgtggccacctcaattaatcaggcagttgatttcacatggtgtcgaatactcagggttgatgatagactgg

SEQ ID NO: 612850 - DNA, 291 bp, Homo sapiens
gtctggaactttcaacccacatcaggatgagggggaatgggggtggatgtcaagtaagtattccctggtcctagtgcaaccctaaagcctcgaaaatagcacgcttatccaacctgtctacagaacgcttagattgctgactgtgtaagacctggagcggcttgtccaatccttgtatgagatcttgacctcccgcgagccaacatgtgggttgaagcatcagggcgattagcagcttgatttaaaaacgctctgaacagatcgatcggctatggcgtaagcctaaatcga

SEQ ID NO: 612851 - DNA, 265 bp, Homo sapiens
ctagtgggctaattttgagggtaagaggacactctagctttttgaatttgcagagttcttgcactgattttttctcttctgggtagggttagtgttcctttaactgttagtgtatgttgagtataggcaattggttttgtttctgggatgctttcaaagggttcagggctttctctgtccaggatttttatgtatgcgtaattcttgtttttggtttcacaggtgtatatgtagcaggataaattttgatggaagcgtcgcgcat

SEQ ID NO: 612852 - DNA, 993 bp, Homo sapiens
gcctaatcttattacgaaacagtagaatgtctcatgacttcataatgtgtaccatcctttagtagatgctcataccaccagaattcagatcatgaattgactgcacgagtactatttgtcggcgcagtcctgatttaaaactaagactggcttgtgggttgaatgagtatgtacaggataggaattcttacatagtatagctccgaaattcagtgaaatggtagtcaatgtggatacgccattgtaagagatatgattagacattctgctagtgatgttcaagcattattcacaaagatggtgagtgccatcttgaaacttacgggagatgggatttatatttagatttgatataacggggttatgtgaagtatatttgagatagtggggaaagttgcttgcacgtgtgcttgagaacctaaggcaagatgtgcaactgtgttgtagtgttcagtagttcattaagctgcttaataggccagggttgacatgatttgataaggtagcaatgtgtatgagttttggcttgggtatgccaagtctaattataatgccctgtatagataaatggtttctgttactgattggaagggatataggggggtaggtgtatattgaagattattcaaaggctcacatctggacagatctgtaagggtcacatgcgtttgccagtagttgcaagtccagcgttcctcttgagttccgtttcacgctagttggcctaaggtagtagtttaggagtgctctttagaacggctttgaactaaaccgttgagcgccgtttaatgcggaaggggtttggccgcttgatagaaaagaggggggaatgcaccttgacatcggtggtgcgcggctacacgcgtgtgtagaaaagggggggggaataaccgggcgaaagcacccctttgtaaggtccgaggggagtataaaacgcgtcagcgggaggcaggacgtaccgcccttttgcggccaaacgcaatatgtcgttcg

SEQ ID NO: 612853 - DNA, 167 bp, Homo sapiens
atgtctccagagctcatgacctaccagccttgactctatacttcagtgagataaacgtctctccatgatgcatccatataattctctctccgagtaactcagacagacgaacctttccccagtgcctcggatcaggatcccctatttcgccagaacctcatgtcggt

SEQ ID NO: 612854 - DNA, 238 bp, Homo sapiens
ccattcctgataataaaactttctgtgaatctgtaatactattcaaaatgaataatttctttttattagagacgtggtctccctatgtcgcccagagtactcttgaactcctgggctcaagcaatcggcctgccttccatagtgctgggattacaggtgtgagccaccacagtcggccccaatattcttttaatatacatctcaacgctttatacttctgccttagacattgttcaat

SEQ ID NO: 612855 - DNA, 412 bp, Homo sapiens
ggggagagagagagagagagagagagagagagagagagagagagagagagagagagagagagagagagaccccgtgtgtgtctcggaggctgtctctggtgtgtctgtgtgtctgtgtttttccgtcgtgtacagcagctgtagtgggagatatatcttctgccatctcatcttatcagggggcgtcgtttgggagcaaaaatagagtagttgcagctacttctatctagtgggtggcggctcgtggtagtgcgtaggaggaggagacgcagcagcgaccctcctctagcggcgctctaagcggcgtgggacgccgacgctgctgacccacacatcttcaccacactagtaggtgtcttccagctgtagagaaccgctggggtgctgtagcagagaatcgtcgagttgtcgt

SEQ ID NO: 612856 - DNA, 422 bp, Homo sapiens
aaatcgagctcggaccaagtatgacatgaggtcaaagatacttattggaactttaatacctaacaacgcccgctaagtatggacttacatggggcatatagccctttcattgtgcccaaattctccctttagtaatgagagtatttagcaaagtgcctgtatccccatagtatctttgaagtaaccaacatggttttgattttacactactcataggtggaaaagactagccttgtctctgatgagactttggacttttgagttaatgttggaatgagttaagagtttcggggactattgggaaggcatgattggatttagcaatgtgagaaggacatgagatttgggaggggccaggggcagaataatatgattcaaatttgtgttcctgttcaaatctcatgttgaattataattccaat

SEQ ID NO: 612857 - DNA, 262 bp, Homo sapiens
cacagctaacatcatggcagcaccttgactccttcggctgtgagccagcgccaacattggtctttgcaggccccctgactgtcgtcattgtgttctcgggctctgttcgttctgttcttgaggtcctttagttgacatacaggcgatgtcttgtaggactacgcgccggttcatgactgtctgcctgagacaacgattcatatatcatactaaagcgaattgtatagcatgcaccaaactgaggtctggatacaaacacaaa

SEQ ID NO: 612858 - DNA, 197 bp, Homo sapiens
tcagccttatcccaccacagaatttcttatccgccgaactaacttttataagcacaggagaaatcacgatcctttccagtaaaaagcaaatgtgggtgggcatttgttgccaacagacatatcgttacaataggtattaatattaagggagtactaaacaaggaaatgaattattgttgctagctgaataatctcaa

SEQ ID NO: 612859 - DNA, 187 bp, Homo sapiens
tcgaacagataccagcaagttggcactgacttctgaatgtctgctaggtaccctggtctagagtctcctctgtgtttacagtttgttctggctgagtcacaactgtttccaaagatactcaggagtagtgatttccctaagatgtttttcaagaagtatacagtaggaaaaattacatccagaatat

SEQ ID NO: 612860 - DNA, 145 bp, Homo sapiens
tctgagtgtgcgtcgtgtttacaacgcacggggttatgtatccaacgagggccaggcccgggctgatgaaagaccataaaggggagcagatattaccaagaacgtaataacaaaagagaagaaaacaaagccaaaaggagagaag

SEQ ID NO: 612861 - DNA, 479 bp, Homo sapiens
atccttccctatctcacggctctcccctgtcacgaaataattctgataacgacacatggactttgagaccctcttctattactttccatatgctaatccatctatacctcacagcagccctgggggtgggtgcaatgaggatgcccattttatagaggaggagactgaggtataaagagggtaagtgacatacgcacactacaggggctggggccaagtgatcagagcactcaatccccaaaggcaaggtggatgcagttaccataaaagacagcagagtcaaagctgcaaccagaatagcctgactcgcagcgacctatggtgcctgttgatcctggctttcctagaagtgaaatagataagaagcctgccacatttttactggaactgtgtttgcagaagtggtctaggtcaagtgagcagaagtctaatctgattaataaaaacagagtcacagtccccggtcaatttccagacat

SEQ ID NO: 612862 - DNA, 398 bp, Homo sapiens
  misc_feature (1)..(1): n is a, c, g, or t
  misc_feature (19)..(19): n is a, c, g, or t
  misc_feature (108)..(108): n is a, c, g, or t
  misc_feature (114)..(114): n is a, c, g, or t
  misc_feature (146)..(146): n is a, c, g, or t
  misc_feature (148)..(148): n is a, c, g, or t
  misc_feature (163)..(163): n is a, c, g, or t
  misc_feature (165)..(165): n is a, c, g, or t
  misc_feature (168)..(168): n is a, c, g, or t
ngcggatatgcaaacactnacgggggaaatagggctctagaaaaccggtacacacccgcatctcttaactaccatctgaactagttagtgccagctttccatggtgtngtgtgntgggtctcataactaggtggagtttttctccncngctgaggaaaccgtncnaanttcttttccttgtggcatttgtattataaaacttggtgtgggggaggagccaaaactccagcccatgaacctctgcccaattaagatggtgttgggttaggttacatctggttactgtcctgggaaatcatttttatagagatggccttccagtggttttaaaatttactgaagtttttaggtcaattatgtatgttgactaaatttacaaataaacttgtttatccaac

SEQ ID NO: 612863 - DNA, 344 bp, Homo sapiens
  misc_feature (324)..(324): n is a, c, g, or t
attctagaggaagaagggaaagcaaaaacacagatgtacagttacatacaagccattctcaaccagactgctatatagtcattttccaattgctttgaaatagtgtccagataaaagtaagactttcactctgccttgcaaaagcttgatgtagtaatctacccaccataagtaagcctccttgtatcttttcactgtacaaatctgttcaaaataaagcttcaaatggaatagttcaggatgtgtgcggcagttggagttggtccctcagcagcaaatagtgatgtgtgctcatgaaaactggatgcacaattgcaaaccctngagtcctgaggaccctctcc

SEQ ID NO: 612864 - DNA, 785 bp, Homo sapiens
ccacgcgtcgggaggaggaagatgaagaggacatggaggaagaggagggggtccatggtcccccagtaccaactggctgtggacgactcctcagacgaaggggagctgtttctgaagaaatcaggaggactttgagacatgaagtacaaatttcctgtttcgcaggagccggtactcagtcatcgggtcaagacgctaccctacgcagcgatctgcgtcctccgtgcgccgtaccaggatgagctgctagaataggagaagtagggaagagactcgggtagcgaatagaacgagggacgaaatgccaagaaccgggaacgatgctctaacgcagtctgtaagaacctgaagcaggaaggagattctggccaagctggagaagctgcggaacgtggcaggcgcacgaggatgctgggcctcgaggagggggaccttgaggacgacttcgacccatgtcgccagcacgaccagcgtctatgcacgaagtgctttggggacgtagtactactggggcctgtgcgaggacggagaagcgctactattgtgacgtgaagaacgaagggcttgacgactactgtaactgggacacgtgggacgggcctgatcaggagcggagactggagccagtcaggagctgcactgtgaggacccctaacttcaacattggactgccgactatcgaccctagtccagggcgaggaaggaagagaatgcgcgaggacccccttgactgggcaagaagaagcgcaagtcgcccttcgccgcggccgtggggctaggagaag

SEQ ID NO: 612865 - DNA, 334 bp, Homo sapiens
acgttggcgcagtccaggcacggcggctctgctcgtatcccagtacttgggaggctgaggtgggaggatagcttgaggccaggagttcaaaaccagcctaggcaatatagtgagaccttgtctctataaaaataaaattagccaggcagggtagcacatgcctgaagtcctagctattcggaaggctgaaaaaaaaaaaaaaaccccacaacaaactgaagtttagcagggctttgacgcacttttatagtgattcctcggtcttactataacattccgggtgaactgagggtggtgactattcccatttttatacttgaagaggatgtagaga

SEQ ID NO: 612866 - DNA, 396 bp, Homo sapiens
tgttttacgtatttaactcacttaaactttacagtaaccacataaggtatgtaccattaacattcccaatttcaaattggaaaaattaaggcacagtgagctttcataatatgttgaaagtcttgtagctagtaaatggtatagcagggtcagttcccaacaggaagaagtgaagggtaggcaaagtgtagtaggtacgcactatatattcaatagatcacactatggattacccacattatctaataatcaaggtttggaagtattggaaggcttgtttttatgaaatgctcattaatgcattctacttcataaactgaatgttggcagtggaattttattccatcagcacatttgcatataaagttctttaaatttactttttttaaatgcaaa

SEQ ID NO: 612867 - DNA, 1006 bp, Homo sapiens
acaagaaaggcgttttgagcccctgtgctcaggcccactcccacactgtggagtgtactttcattttcaataaatccccttattccttccttgcaaaaaaaaaaaaaaaaaaagccttagccagaatccaggggctcacgccgtggtaactcccaacactttggggaaggcgagacggacaaccgcgatacaacgcacaccacagacgaccaccctagagcaccaacccacgacccacggcaccaacccaagcccacagcacaccaacaacacacagcaccgcggcgcacccagacaccgcacgacgaaacacgcgcgacgcaacaagcagagaggagagcgagagcgaacgaggggagcaagagtagaaggaggcgagcaccgcggagcacggcccgagcgagaggagacgaagaggcgagagcaagggagcaggagcagggggcagtgagagaggccgggcgccggcgacgcgcgccgagccggcggagcgggggatcggagggcaggcgcacgggagagacacgcggggacgagacgagagaaaagcggcaaggagagcagacacgacaggaagcacacagagaagcggacaacgcgggccaggagcgcgagcacgaacgacgtggcagcggacggacgacacacagacaggcgaagcgagaacccgaaaaggggagacgacagaagaggaggacgggaggaagccaaagccgagcggagaaagcggcaaggaagaagcaagagacgaaggccagagaaagggcggaggggagacgggagcgaaccggagacagcaggcgagaagccgcccgcccagagcacgacagcagcacacagcacgacacgaccagcagcgaccagaccgaagcaggagcggacggcatcgacccacaacacgcaacagagcagggcgaacgagaggacgaaggcaggagcgacagcggaccgcagggaacgacgagcacgacgcaccgaaaggcagacgaagacggcgcgcgcgtcc

SEQ ID NO: 612868 - DNA, 212 bp, Homo sapiens
tgacttgtttgcccagctgctaagcttcaactttagcagacccgctggattgagaaaattcagttgcaaatgctgtagctggatggttccggcctgctcaatttttgggaaggccatgaatcccgccagaatgccatcaacttcgacaaagcggcctgacgattctacaaagaaaaagtatgaatcctgagatataaaaccctctgtatcct

SEQ ID NO: 612869 - DNA, 186 bp, Homo sapiens
gggcgggcttgggtttttgtggtttgtttcttttcggtagtagttgtgtgtgctcgttttttgttctggtttgttatatctttgtgggttgggttttccttttgctgcatttacgcgtccttttcccctttggggcccttagatcgaggtcacagttgacaaagcagctggaaacgcggccagaat

SEQ ID NO: 612870 - DNA, 690 bp, Homo sapiens
cacgcgtcggtgaagcttgaggtaggatgtgggaatgggcttggagtcataggcgatgagagggacattaggatattatgaagcccgtgaactcaacttctgagaaggacacagcagagcgagagaaaaggtatcttcaaaagaggctgatgttcagtgggtacgggcttttcttttgggatgaggaaaaaaatgttttagaacttgtgagaggtgttggttgtgcagcatcgtgaatggactaaatgccaaagaatcgttcactttaaaatggttaattttatgttgtgtgaatttcatcgaaaacaaaaaaataaaaagggtgaatcccaatgaacccgggtcgtttacatttcagaagctctaatgcctaactcagggttgggctcagagtaaatgcttactaactgtttatggacaagaacaacctaacattggcacagtcaacaaagctcttggttatacattagctcatttcattttctaaagaatcctctgaggtgggcaggggtaagcatcctcgtgtcgtacaggggaaactaaggctttgagaggagtgtggcttgccacagtgtcccgctagctagtggcagcactgccagaattcaaacccaaaaagtctctggctccaaagtctgtgctggtcaagcgatactatttgggctacctcaatggttccagagggacaga

SEQ ID NO: 612871 - DNA, 184 bp, Homo sapiens
tccgccaaggaaggaaaggaaaaggggacccagtccctccctccatccttccaacatatatttattgaggacctactgtgggccaggggctggtgggacagtggtgacatagtttctgccctcataaagttgattgtttagtgaggaagccaagcctttttaaaaaataaattttaccttccca

SEQ ID NO: 612872 - DNA, 602 bp, Homo sapiens
  misc_feature (55)..(56): n is a, c, g, or t
  misc_feature (229)..(229): n is a, c, g, or t
ggggctccaggggggggggaggggtgttcccgggggttttccagctccccccccnnggcgctgaggggtggttgtgggccaaaaacggggggttcctaaagtgtgtaccccccccccccttccccccaagggggggggggtggggcgggggggggtttttaaacccggcgctttttttggcccggcgggccccggggggcccccccccccgtttttttccccccttaanaaccccgggggccgtccccccccccggttttttttttgggggggggggggggtctcttttttccccggggaccccctttcccccttgggcccttttgggggcccctttaaacccggtggggccaaaaaaggggggggggggggggggggttttcccgggtttttttccccccccgggcccccctttttaagggccttaaagggggggggcccgggggggggggtccccccaaattttaaaaatttttgccccctttgggggggccggggggggggtttttgccctttttttggaaatttccccaaattttttttttttttttttagggggggttttgggcttttcccccctaacccggtttttttccctttta

SEQ ID NO: 612873 - DNA, 321 bp, Homo sapiens
cagcctcccagctacttgggaggctgaaataggagaatcacttgaacccgggaggcggaggttacagtgagcccagactgtgccattgcactccagcctgggcaacaagagtgagattctgtctcaaaaaacaaaacaaaacaaaaaaagaactctttaaattatttcaaaatgccagaaaagtatattagctcgccatacattcactagtcattagcaagctttcaaggacttattgtaaaagagggtaacaaagaagggctagttgttgcttgaatattttattcatcccagttagaataagttagttctatactcccc

SEQ ID NO: 612874 - DNA, 144 bp, Homo sapiens
atattgattcatttcacagaaattcaccaggatccagcacactcaaatgtacgtttctctccataaagcctcatgttttccaacccttatttcttgggtatctcctgtgtgtcagacactagtacaccataccacttcctcttc

SEQ ID NO: 612875 - DNA, 531 bp, Homo sapiens
  misc_feature (495)..(495): n is a, c, g, or t
  misc_feature (523)..(523): n is a, c, g, or t
aggaggcctgccctccattcagatgcatctgcatcgcccttctgtgtgcagtcacatcgagactgcacacagcatgcatctcctcgttggaaaatatcgattgcctccgagttgttttaagcaattagaatcatggtcgctgaatccccagactgttcagagacttctagggacacctccctcacaagaagcctggcaccccccatctgtgtaccctttgagaggacaaggagtgcgtttgtattcattctgcattctgctattgtcagtggcaacagactctatcaatgatgcaaccatggtctgtgatcatgtgggggcaatcaaataaatctcttatgtaactctcggattctcacattttctgacaaagatcccagaagttgacccagttggccagacccagatctccagggtgatgagtatccccattactttgttgtgaatctgggcactcactattccttcgaagacaattggacatagctgagacanttccccatctaataaagacatctcgcgngtttctca

SEQ ID NO: 612876 - DNA, 153 bp, Homo sapiens
aactatttaatgtaatgagaggtgttctagctatgtaacccaggcgggtctcgatttctgggctcctagcattcttcccacttcagtctcttgaatcatggggataacaggcgggggccttcatgcccagttttaggttttcaaaaggtgggc

SEQ ID NO: 612877 - DNA, 560 bp, Homo sapiens
tactgaactctttattgggtgtgttggggttgtttggagacagagtctcactctgtcacccaggctggagtgcagtgacacaatttcggctcactgtaaccacctcctgggttcaaccaattcacctgcctcagcctcctgagtaactgggactacatacgcccgcccgccaccaagcttagctaatttttgtattttttggtagagatggggtttcaccatgttgtgcaggctggtcttgaactgttgacctgaagtgatccacctgcctcagcctcccagagtgctggaattacagacatgagccactgtgcccaaccttggtagttctgagttctttaaaaaatctccaaactgcttcccacaatggctaaccttatctacattcccaccatcagtgaacacgaattcccttttctctgtagccttgccagcaactgttttttttattttaataggcattctgaggagtatgagatggtatctcattgtagtttggatttgcatttctctgatgattagtgatgttgaggatttttttcatgtttgttggctgcttg

SEQ ID NO: 612878 - DNA, 839 bp, Homo sapiens
  misc_feature (585)..(585): n is a, c, g, or t
ggacagatagaatcatctcgagttatcatggcagaaggtggatttgatccctgtgaaatgtgtttgctctcactgcaacatggcaatgaagaagactgatcaatctgctaacgggcgggtcccagtcctactgcacagacagcagcagtgtcgttgcagcgaagttagcgcggcgacccgtctgcgctgataactggctagtcacgtggttacaaatgattctatgatagacctggatgttttattgcatggatctatgttcttacttgagatcgctcgctacatcgtaatgcacggaatccgagacactagcgctggagaagcgcgagacccacagtcctgcatagagtggcacatacgaatccacacatgtctcgctcctagtggatctaacgtgttgtgatactggcgaacgttgaacacataatgtctaagcagccttttgtcacagacgcaaaaacggaagcggacacggagtgacccacgaagtcacctctttcacagcccccagtgtgaggagagctagtgtcttgtccccttgtgcgtagtctggcagagtactgggattcggtgagtgtgcggccncttcagttcgaacgcatttcttaggaaaaactatatacaggtgtgagccacatgggttgtatttttgccccgcatgtccccttcgcgtgttataaacctcgcgccagttttgcccctgagtgtctaagcctcgttgagttaagtttgtccggagagtttgagacttgactttgagttacttctcttgaaggaggcccacacttttctgcgtcgcggggggggctttgtggtgccggcgtctcgctttcttccca

SEQ ID NO: 612879 - DNA, 231 bp, Homo sapiens
ccgtggtagatcgcttcaggtcaggagtttaaaaccagcctggatacatagtgagacccctccatctctataataatcaaaaattagctgggcatggtggtgtgtgtctgtagtcccagctacttggaaggctgacgtgggaggattgcttgagcccagaaagttgaggctgcactgagctgtgatcatgcaacagcactcagcttgagcaacaggttgagaccctgttac

SEQ ID NO: 612880 - DNA, 159 bp, Homo sapiens
tctaccatacgatcagatgaacccagagtagctatcagtggagtatatttaacttttactctgcagtctatttgcttaggaacaaaaggaaaggcagtttcttgcttgactcaactttcagctttttttttttttctattttggttaattaattggggt

SEQ ID NO: 612881 - DNA, 222 bp, Homo sapiens
taagagcggtctctggtaccacagagtgacccaagccactgcagtaacaatgctggatcctttatccactctgtcacgaggtaatgcctcttaactcatgttacactgctagcattccactgtggtacttgttactcttctttttcagatttttcttggctatatttgcttgcttacttctctatatgaattttagaacagtaatggataattcagaattac

SEQ ID NO: 612882 - DNA, 456 bp, Homo sapiens
gtattagggcgtacagcacatggagagtctcccctcaagctctttcccaaaatccctcctcataaccctccgtgtcctggaagagcttgaaggtgtacgacaggcgttccttataatgacttccgctccatcctccccagcaatctgctgactgtctgtcaggagggtaccctgaagaggaaaaccaagcagtgtgtccagcatctctcaggtcagacctgaacgcggcatgccactttacaacggtgtcacataataagggagttaacatttccattgggaaatgcttcgggaaactcattacaactgggtgaagaagaatcggtagaaggaggctaggtaactccaaaaatatatggattgccattgatagcccgaggtgatggaggccacccccagtgctgatctctactacacttccttcagtgaccctctctacctgaccatgtacaagat

SEQ ID NO: 612883 - DNA, 330 bp, Homo sapiens
tgtaactagccgacggttcaggtcggtccctgcccattgtgcagtgggttacagatccggcgttgccgtgagctgtggtgtagtgttgcagacgcggctcggatcctgcgttgctgtgcctctggcgtaggacagtggctacagctccgattggacccctagcctgggaacctccatatgccatgggagcggcccaagaaatgtcaaaaagacaaaaaaaaaaaaaagattcccagtttccccgtggacccgaggccttgcatccccatttcttcacatccactcagttctccttggatcactatattattcacagcctattattcagca

SEQ ID NO: 612884 - DNA, 153 bp, Homo sapiens
ggttaagtccaggtaaattaaaactaaaaattagggcggcgtagcggcgcccttattcttcctttccactcctcccagccgcctctttgaccagtgtcgttcggagacgcacctgtcggcacctctgatctttccccgacgtctactatccca

SEQ ID NO: 612885 - DNA, 594 bp, Homo sapiens
gatatagaattgaatcagactgtatttctttcctcaggaaacatatagagtactgggggaaacatcaatttgaggacagtgtgatcaatggtgtaattaaggtagatacaaaatactgaagaaattttcaaggaactgcaaatcaacaacaggaaaaataaaaaaacaatgacaagaaacccaatggaaatgtggctaagtacttatgatacccaatgcaatgaaaaaaataaaaaaaaaaaaaaagtgggcaaataactatagataggctttcatgggaaacgagaagttcaagtggggctaatgaccataggaatggaggtcctaacctcttagatcagagaaatgcgattttaacaagtctggacagtatcaggtgggaactctatagatgtccggtgtacgtcatgtgcaaacacaaatcacctggcgtctatcataatcacgggatctatttccccatttttaaaccctaggggtatatatccctgagagagtctggccatagggtcccaaagagataccctccagggtcatgcactgggcatactcggttctcactgcgcctcgggggcctgtcactggcctcactgg

SEQ ID NO: 612886 - DNA, 121 bp, Homo sapiens
cgaaggtaaggaccggggtggggaagagggagagggagagggacctgggttttctttcttttctttttctttttttttgggagatggagtttcattctggtaacccaggcgggagggcaag

SEQ ID NO: 612887 - DNA, 1153 bp, Homo sapiens
ggagccgacaaacatcccatgaggtgttggattcggtcatcatgaggaggtcagagaagtcgaatttatatccccttgaccggaggacgctgcccgcgcccagaatgttccggattgccctcttcgggagcactccccagaacctcacggatgcaatacatccacagagctggcttccggcaagacgtgaacgctacctcgagtgcgtcgtgcagactctacgtcatcgatcgtgacggcggtactctcttcttatgcagctcgcgtaaggaatggtgacaccgatcgtggtcacaatatcttcaagacaaggctctgtgggccctctacttcgcacctatatgcccagtcgaatggatggattgtattgactctcccattgagctccatgtcgtcactcagtggaggacccagtggagccgtgagagccatgactctgtgcttggatgctccctgggggacaacacctcttaaaggcctgttgtgtggtgcactgttcggaacaatgtctgcgtgtctcgtgggccatctcatccctggtgccacggctgacatgccatgatcgaactctccctgtacaaggtgaaggaaacacttctcaagatgagtagcctttgaggcataggagtaggtttagcaaagcttgcctttcgatcttgggggggctaaatgatcgcaacgtgctaggacatggctttggatctgcggtggctacaccatcccaagttgcgactcccaccaagtgtccaaacacgctatcactagggtctccctagggtgctttgtccacagatcctagtgacagggaggtactcccgtacttgcttggtccttggggtcggcacgtgcccaaggggaaggcacaagcaaacagtagagggggcactatgagagagctcaatcctgaaagaacacgtgccggacttgggcccctttcgtcggacgacacttgagaagtgggcgcatcctgtgtggctcctttccgctaacgcttccccttggccttctgttcccttgggcctctggcgcgctattcgagggcattcccttacttgggcattcgccccacaccttttcttttttttccccaatcctaatgattggtgtcgcccgataattttttcctggctggcttgtgggacttttcacgttc

SEQ ID NO: 612888 - DNA, 301 bp, Homo sapiens
gcccggggggtttccccccccccaaaaggggtttttggttcccccccatgggcccttcccggggcccgggggtcccggaaaggtccccagggtgtttaaaacccccctccccccgtttttttggggaaacctgggggcccctttccctttgtttggggccccccccggggggttcccccccccgggggccaaattggtccccccaggtggggggaccccccacttttttttaaggggggtttttggccgggggggggggggggccccttccccagggggcccctttccctttttttgggga

SEQ ID NO: 612889 - DNA, 156 bp, Homo sapiens
agcgagctcatgtatgggtcaagcggaccatgagctctgtaggtccggcggcgcatcgtaggtgcttggttcactaggatatgcgcaacgaccagagaatctacatctaaacccttaagtgcagcattactctctgcgctatgaaagccatgtgca

SEQ ID NO: 612890 - DNA, 440 bp, Homo sapiens
catcatagtcatccctaatgtcacctggaatgataacattatggggagagattcagatgtaagcagccacgccccttccggggggaactcaggccacacttgaattccacatgtcacggtgcaaagtgacttttactctggggggatgtcagtgatccagccggcgggtttctcggtgaacccaaattctgttatcagaagggaccctccccacttggggtcaggggcagattggatcagtttccccatggagtcatggatgaagatgtggtgagaatgatccccaaccctctgtgctaatacagagcactcggtcggcttgggtgtgtttaattatggatccagccacaagtgaggaggggaagtggtgattggaaagcggtcaccaagagattggggggattcagtaacaaaacggcgggaaggtagagagccgggca

SEQ ID NO: 612891 - DNA, 428 bp, Homo sapiens
  misc_feature (40)..(40): n is a, c, g, or t
  misc_feature (134)..(134): n is a, c, g, or t
  misc_feature (269)..(269): n is a, c, g, or t
aatgaaaatgaatgagaaaaatgtccttaaaggtaaaaanccattatgtagctaaatgaaattgtggctgtgtgtgagtacattataatataatttccatctgatgtgtatttacttgaactcatcattccttntgaattccttaaccattaagaaaaagactagattaatcaaaggaattacaaattattccatttttacaaaataccctgtttctatactgcaaatggccatgttgggtatatgtctatatacgccttacttagacnattgtattgtatataaccgtgtgtagaactatagacaatagtcaccaaatagttatttaaatattaattttctttattaatacaacacatttaataagtatctacctatgccaggcactgtgctaagttctattactaaataaaatttggtccctgtca

SEQ ID NO: 612892 - DNA, 205 bp, Homo sapiens
aggattccacatagcaccacgactaggggattcatggataggtttatagcatgttgggtggttggagtaaataagtgaggcaggcagtccgcaagaggtaagttgtggaataaaaatgcattccggatactagtcataagagatcaggttcgtcctttagtgttgtgtctggttctcatttgttttgcagagttagtttgattag

SEQ ID NO: 612893 - DNA, 110 bp, Homo sapiens
aaacgccgatccccaaactgcacacgccgaagcaccaggccgaatcgccgatcttcacgtgcacacgccgaagaaccaaagcgtgtcgccgatcttcacgggggatcctc

SEQ ID NO: 612894 - DNA, 237 bp, Homo sapiens
cggtcccgatattgtggtctgcagactcatgcaatgccctccatgttaatattcatcagaaaatggatattaggggggccagcaaaaatatcaagggtcaaatatcgcacatttctgtttaggccatctatggctttcatctcctctgaagtcaactggaattcaaacaccagcacgttcttgcccttgtagttgaagatgacatgaaccttcttggtgccagaaccacaaatatcg

SEQ ID NO: 612895 - DNA, 571 bp, Homo sapiens
taggcccattggagtatttggtttcaattagggaaatagtgggtattaggattaggatggtggtgaagtatagtagggatgctactggtccaaggatggtaaaggggtagcttacgggtggtcctccgattcaggttagaatgaggaggtctgcggctaggagtcaataaagtgatgggcttagggggcgaacatataatgcttggtggtgggatatatggaggatggggattattcgccaggatgaggatggcctagcactagggcaaggacgcctcctagtggtcagggacggcatcggaaaatcgtgctacgccactacggaaatactcatcccggcctcgaccgcgcggaacgggtgtccacacggggtcggctacgggaataatgcggcggggcacgccgacgcacgccggctgaccaatccggtgtccaaggcctgtaccggaacacaccggccgacaaccacccgacgggaagcctcacgacgcgtgccccaacgggcggcacgggcctccccgcacggcggccggcgaccccaggggcgaacacccgccccgcccaccccacg

SEQ ID NO: 612896 - DNA, 118 bp, Homo sapiens
tctcctacatgtcgtagccctctcctcctgttcacacagcctctcctcctgttcacacagccgtcgcctcctgttcacgtagcctctcctcctgttcatgtagccgtactcctcctgt

SEQ ID NO: 612897 - DNA, 210 bp, Homo sapiens
cctgaagcctcgttttgcctagacactagagggagaaaaacatcttttacatttagccggatgccagagctcgcaggctgcatacataatgagcacgtagccaagcctgtcagataatttaaccacttgatggacttgaagctgagcgcttgagtagcatggttactaactgcgtgactgcctacccacttcatctgacactcatagatc

SEQ ID NO: 612898 - DNA, 148 bp, Homo sapiens
  misc_feature (31)..(31): n is a, c, g, or t
  misc_feature (61)..(61): n is a, c, g, or t
atatatgaaatttttcccaaaaaaaaatatnggggaaaaaatggaacaattaaatactccngtttcaaaattaagaaaaatagcatttatcaggcctctacttgctttactgatatttttctattatcactcatctgtgatatgcaca

SEQ ID NO: 612899 - DNA, 218 bp, Homo sapiens
  misc_feature (18)..(18): n is a, c, g, or t
aatggtgaaagtactttntccagcttaaattgtaaatgtttgataatatcttttttttaattggtggtaaaatataactttaccattcagtgtacagtgtataattcagtggcactaaatacattcatcttgttaggcagctgtcaccaccaaccatctgaactttttcatcatcctgaactgaaactctgtgtccattaaacagtatctgcctccta

SEQ ID NO: 612900 - DNA, 112 bp, Homo sapiens
  misc_feature (75)..(75): n is a, c, g, or t
gccactgatactgtaaacatgggtctgttcacaactgcgaacttcttggctctgcaagattgtgaatgtacaacnaataaaccacacacagttcagcagtcaccttttttgt

SEQ ID NO: 612901 - DNA, 276 bp, Homo sapiens
atctaaatctgtcggcgctggactgagtgatggcgtatgatagtcgtggacacgactacaccctccttagggtcgagtcacctatcatagacactccaagaatcagttttccctgaccgtgacctctgtgaccggcgagacacggcgtctattactgtgcgagagaggtcggattgttcctaccccaagctgactgatgctttagatatcttggggtcacgcggacaacgggtcacctgtctcttcaagcctccaccaaagggcccaatcgggtct

SEQ ID NO: 612902 - DNA, 184 bp, Homo sapiens
tctcggacccgtgcacaccagcgctggaccaggtcagctgaaggtgctgggtgcaccctctgttgccgtacctgatgcacgaacaccatgcccggtgttgactttttaataataaccattctgactggtgtgagatggtatgccattgtggttttgatttgcatttctctaatgatcagcgata

SEQ ID NO: 612903 - DNA, 291 bp, Homo sapiens
ttccgcccgcatggagatcactgaggccaaagttcgagacccagcctggggaacttggctggaacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctaaa

SEQ ID NO: 612904 - DNA, 112 bp, Homo sapiens
ctatactgacgcccgaaaggtggaaatgaaccactctgtcgctagacagctacaggtttgaaacctgcaccccagaccactgaggatcggtagtatagataggtcagtatag

SEQ ID NO: 612905 - DNA, 134 bp, Homo sapiens
cagcatcttcagggcacattgaaatcctgagtgagtgctgctgatccagactggagacaaagtgggagccagcgaagccacgcgtgctgaacatgctcaacatctcccccttctcctttgggctggttatccag

SEQ ID NO: 612906 - DNA, 847 bp, Homo sapiens
  misc_feature (501)..(501): n is a, c, g, or t
  misc_feature (586)..(586): n is a, c, g, or t
  misc_feature (726)..(726): n is a, c, g, or t
ggggctgtgcgtgtgtcccagtctgcagttaagggggcatgagtggcgctgctcacctctggtgccaaagggcggcgacagcggatgccgatgctcggccctggaggcgcgtgagtaacatggtgcagcaggttcttgagtgtaccctccggcattcggtcgcgcgttctggcccgtcgcgagtgagggttctcgtggttcacaatccctgcggctcacggtggagctgggctgcgccaggggcgcccgccgttgtggccctcgtgctgatgctactgtaggatgccagcgtctagggcagcatccgcttcctagaagaccaggtcatgatgatgggcagcgcccgagtggcggatgctgctgcgtgctctcaccggtcggcggaagtcctcaacgtgctgccgaccccgaccacgtctcactccgtacccgtgtcactacgctgtccgggagggctcctggacacgctggtggtgctgcaccgggccggggcgcggctgnacgtgcgcgatgcctggggccgtctgcccgtggacctggctgaggagctgggccatcgcgatgtcgcacggtacctgcgcgcggntgcggggggcaccagaggcagtaaccatgcccgcatagatgccgcggaaggtccctcagacatccccgattgaaagaaccagagaggctctgagaaacctcgggaaacttagatcatcagtcaccgaaggtcctacaggngcacaatgcccccgccaaatccacccgctttcgtagttttcatttagaaaatagagctttaaaaaattgtccttgcttttaaccgtagatttattccttcccccattaccgtaaatgtccc

SEQ ID NO: 612907 - DNA, 357 bp, Homo sapiens
  misc_feature (80)..(80): n is a, c, g, or t
  misc_feature (85)..(85): n is a, c, g, or t
  misc_feature (239)..(239): n is a, c, g, or t
  misc_feature (247)..(247): n is a, c, g, or t
gctgaacttttgaaacagatcatctgttggctgatttcacggcgtcccagctggatggaatggcgcgcactccagcctcnccgtncttgttagatctatttacgtagaggaatggcgcacactccagcctcacctggacctcgttaagatgcatttacaggctgagatgtgtgtggaactttgtgtggatggtagttagatgagattttggacttggagttgatgctgaaatggtgaanacttttgnggacactgcggctgtcacttgcacgtcggaggggcccaccatggggcaaattgtcatgcactgaattgtgcccctcgaaaaatgacacatgaacccctaactcccggtgc

SEQ ID NO: 612908 - DNA, 312 bp, Homo sapiens
aacgggtgtcagcatggctcgtacactgggcacgcggggcgcgtgaatggcatgatgttgcctgcccggaggtggccatcgaatggcaggtggttcagccgagcgagcgtggtgtcgtatcgccggtgttctggcggccgagcccgctgtgcaggctcgctttcgtgcctgcaccaaactcgggcaggatgtgctgcacgcgcaggtgttggtgaacaggaggaagcctgaagccgtttgcttcataccagtatccgccgtactcggagggctgtccagtggttgctcgagcgcgttggcgatcgattcgat

SEQ ID NO: 612909 - DNA, 405 bp, Homo sapiens
aggatcgacctctaaagtatcccgatcgggagattactgacagtcttctttgtacataagcacagcgtcaatcgacgctctttccttcctgttactttccctgtgtctcttgagttttacaggaatcaaatcctgtgatatttaacagaagtcgtgacttgcagctctctggcgccacatagcctgattgattaagaaagtctctggtgggatgcggcggctcacgcctgtaatctcagcactttgggaggccgaggcgggttatcacttgaggtcaggagttcaagaccagcctggccaacatggcgaaaccttatctctattaaaaatacaaaaattagctgggcgtggtggctcacacctgtaatcgcaactctttgggaggccaatgcgggtggatcactt

SEQ ID NO: 612910 - DNA, 713 bp, Homo sapiens
cttgggcactcagcacaccattattagggtccctctggtcaaggacatgcagttagcatgggaatgatgtagtagctgacactctgcccagagtgcctctggtgggttgatgctgcactttctaagaaaagaagccaagattgttcctatatgtgctggctctcctaacgttctatctctagctcgattcatattactattacgaaaatatgagacgagcgggacgacgtttgcaggtcgagtcgttcgtgtagagtgcattatggagagatgtgaccaaatccgtatcatttcctgaggaaaaaaatcttacaagatagaattttttttccttttcctttctttttgtttctttttttttcttgttttccacaattatattctcacagctgcgagacagcaatgaacagacatttctaattagtcacctaaaccattggtgcataactagctctgaacgcaggttaaagctgtgcctcggtgataagaacctggaaagccagatgtaataagtggggagtattaggggtttataaggggcgttcaccttaaggattttatcacactgaaactaccttaagtgttacataatttagtgacaaagggaagccacaccaggtgcccacaatgttccgggggacatgtcccaaggtgaaacgccttgttcctaagtggggagccacctttttattgacccatttacgcagtggtgt

SEQ ID NO: 612911 - DNA, 130 bp, Homo sapiens
aagccagctatatgactcacgggctgtacccttcactgatctagagagcgctggtcccatcaactaacaacatgaagtggttccctccatggaatgttgatgcactgagagctggtcagagaaggtgggg

SEQ ID NO: 612912 - DNA, 584 bp, Homo sapiens
ccctccgcgaccggggctgctgagctcctcttccgagcagctgttagtctccaggctctcggcctccgattccaaagccctccagtaccagcagcgcgtcgctcgtttccgtgggttcctccccggccttcggggcgcaacaggcggctgggcttcggaggggccgtctgaggagtacacggacacgggcagcaacccccaccgactgtcttgacccccggccccgccggctgcccgagccccagagccgccaactgcgcctctagtccagccgccgggccccaggtccgctcgagcgccaagcccggcggcagggccttggggtccagggcacagcggtgccggggacacagcagttccgagggtcccggctccggggccgcctccacgtcctcctcctccggcggccgacccacgttgcggaacaccatcagctgcggcggccgggagccccgcgggccgggccgcgcgaggaagggtggcggcggggggccatggcccgggggcggtggcggagggcctggctcgggggccgcctctccatagccaaggaggcggctcaggacgcggtacgaagcggccgc

SEQ ID NO: 612913 - DNA, 321 bp, Homo sapiens
tgggtcggatttcttcttctcctgtctggctccttgggtttcttcctggtattggcccttttccttcctaacttggcgaaatgggagttccggcaaggaactcataccacgcggccggcaccaaagtcgggagcggccgacgccgaaacggccgatacaccgctttggaggacatcgcagagccagacctccaagaagactggcagacaggcttctccacagtggccccggcccacatattcgagaggcaagataggtgtctccaccaacattcgacaagacggtgcaaacagaagctggccgggtgccatccatgcccaa

SEQ ID NO: 612914 - DNA, 145 bp, Homo sapiens
  misc_feature (40)..(40): n is a, c, g, or t
  misc_feature (51)..(51): n is a, c, g, or t
  misc_feature (138)..(138): n is a, c, g, or t
attggatcacgagggcagatttctcccttgctgttctcangatagtgagtnctcatgagaagctgaatggttttaaggtgtagcccttcctcgctgtctctctcctgtccccttgtgaagaaggccttatttctcttntgcgttc

SEQ ID NO: 612915 - DNA, 385 bp, Homo sapiens
ctagaggatctacgagtgcatggctgactgatatagcaacaggaaagtctgaaatctaatctaagacccaggaaagaggctctcatccccaggactaatataggaggatggtactagtattccagcatgatgcatccacagagtcgcgtgaagaagctgggctgggacagaaaggccccaccacagcactgcagtagtcctgggggtccagcacctcatcaagatagggagggagggatatgttggggacatcaggagaaaacagcttctacttcaagtctcttatgaaattaaggacttacagactccctatgtgggggagacgctcgggttagtgtgactacccaagtttgacctttaatctgtttttttattttttattttg

SEQ ID NO: 612916 - DNA, 1477 bp, Homo sapiens
tgtttccggtaaatagcatctttatggttccacggggtgcaaaaaaaaaaactcaataagtgggtgagtgcattttccgtggataaattttacaatgtgaggggtgattacattaaatttatattagactcacaagttttccttttatatacatatttataaacacccaatttattattggactaaattatgtgttccagagaggaaaacaatgtgggttctctataaggggatgtggctgtgagtctccaagattatgtgcaaaatatattagccttctgcgggtttgtgggaccatgtgggtggcttataaaatttcttacaaacgatgtgcttttaattatattctctcataagttttaaggggagaaacatctcgtataccctgtgtggcgcttaatctctgtggccaattttgagggggagacaacgcccaaaagatgtgaattttccacatataccaggatattctccctttatcgtctcataaaaatgttaaccctctacaaaaagccccaaaaagagaacagaacaaaagagagagaaaagagaacagaagagaaagaacaacacaagaaacacacaaaaaacaaagagacgagggggggcgaggcggcgcgagaaagagagaaagactccccagggaagggggagggcccccacagcagcatgcaaggaggcacgcaccccagcgaatctttcgtgcgagcacaacacagaaggcggagcccaccaaaataagaaggaccgcacctgcataaataaaacacgcgacaaagaaacgcgaaggagacacccaacgtataaacaaccacgaccgcgcacacagacaacgtaggcaaaaaccacaggcatacacaaccgcgggaaaaacctactggagaaaaagaacacaccccccacacacgaaggaggagagccggccacaacacacatgaggcgaggaaacacaacaacacaccccacccaagaagacaagcatacaacgccccactctagagggagaccaacatccaaacacatgcataagcagggaacacacggacggccaacacacccagcccggcataatatcaccccgccgcacgcaaaagaaacatgcgccaccaaggagaaaataataatcacagcacacatccccggcgggacggcgcacaaactaaaaacacgagaacgcaccacagcaccaaccacccacagccgcgagcccacaacagccgccaagacagaccgcggcagcacgagccaaaccacagcgacgagccgagcagcacaagcacgcaaacacaacacaaagaacagctacccgcagagaccagcagctacgacagaggaggaccacacgcgggcagaccaaacagacaggcagaagacacggagacagaagaccgaggagcgcgagaacacacaaacggacacaaaagcagggcagcagaaaatcaagcagcgaagaagcagagaagcgccaacattcagc

SEQ ID NO: 612917 - DNA, 144 bp, Homo sapiens
gatttcctcttcgccctcctccccctcccttacttccctctgaaatgtctcagcggctgtctcaccctgtgctggttaccactggggtgtggaagcgaaccagatggtctctgtcccaaatggcagcctggggtgtggggtggg

SEQ ID NO: 612918 - DNA, 750 bp, Homo sapiens
  misc_feature (182)..(182): n is a, c, g, or t
agcggagcggtgcgggaagtccgtacgcagtagctccctgcaagacgagagcgctgatagtgggtatgtttaatccccagcaggatgcaaatgggcggagagtgccctgatgatctaaaaactgcccaatgacagttatcacctaggactcatcaaggcaggtgctccctgcatggtgtcanacttctcctaaaggaggcccggtatcgccatctccgcgaaggctctcagcttgtctttctatgcctgtactgtccacagttcatggtgtcatatagctaagctgttgcgatgtgcacaatggcacaagacgggaatacggcgtgaagttccacttgtatggtgtctctctagtccactggtcatacgatggtagtttccacgacgcattcgtttacctccacttgaaaacgaagtctctgagtaaagacattgattactgctggtgagcaatgaaaaaggcgagataggagcgcctttatgatgctttataacgtatatgaatggacagagatgagcacaaaagacatgctaagacctctcgagagaggcctatgacaaaagaccaggtggatgagggatccatgagtgacacgacgaaagagcagtgctagtaacgaaatatcgaactgatatgaacaggaagaaagttggacattttgaataatggcgcagggttgacctgtggcccccttggataaggtacgccaccttgaaactgaggaccgttgcttacagtgtttgctgtga

SEQ ID NO: 612919 - DNA, 202 bp, Homo sapiens
ctgaggggctcaggcagacgggaatggttatggatgggcctgtactggccctgggtctggcctcttcgacttgccgggacgctgtcagggctgctcacatcgccgcgccatcagcacctcaccctccccccgttggagtcggttccgtggtgtggaagtgcccactttggcttatgcgtttatcagttgacggatagtgggt

SEQ ID NO: 612920 - DNA, 948 bp, Homo sapiens
  misc_feature (247)..(247): n is a, c, g, or t
  misc_feature (306)..(306): n is a, c, g, or t
  misc_feature (335)..(335): n is a, c, g, or t
  misc_feature (472)..(472): n is a, c, g, or t
  misc_feature (475)..(475): n is a, c, g, or t
  misc_feature (480)..(480): n is a, c, g, or t
  misc_feature (524)..(524): n is a, c, g, or t
  misc_feature (538)..(538): n is a, c, g, or t
  misc_feature (541)..(541): n is a, c, g, or t
  misc_feature (580)..(580): n is a, c, g, or t
  misc_feature (617)..(617): n is a, c, g, or t
  misc_feature (641)..(641): n is a, c, g, or t
  misc_feature (656)..(656): n is a, c, g, or t
  misc_feature (679)..(679): n is a, c, g, or t
  misc_feature (757)..(757): n is a, c, g, or t
  misc_feature (772)..(772): n is a, c, g, or t
  misc_feature (777)..(777): n is a, c, g, or t
  misc_feature (805)..(805): n is a, c, g, or t
  misc_feature (808)..(808): n is a, c, g, or t
gccgggagctcccgaactcttcagccgcccggaggccgctcccggagcccggcgtagaggctgcaatcgcagccgggagcccgcagccgcgccccgagcccgccgcgcccttcgagggcgccccaggcgcgcatggtgaaggtgacgtcaactccgtctggcccagaaggaggccggagaaggacgagcccaagagcgggaggaggcgctcatcatcccccccgacgccgtcgcggtggactgcaangacccagatgatgtggtaccagttggccaaagaagagcctggtgtggtgcatgtgcttnggactagcatttatgcttgcaggtgtatnctaggaggagcatacttgtacaaatattttgcacttcaaccagatgacgtgtactactgtggaataaagtacatcaaagatgatgtcatcttaaatgagccctctgcagatgcccagtgctctctaccagacaattngangacanatattaaaatctttgaagaagaagaagtgaatttatcagtgtgnctgtcccagagttngcngatagtgatcctgccaacattgttcatgactttaacaangaaacttacaggctatttagatcttaacctggataangtgctatgtgatccctctgaacanttccattgttatgcnacccagaaacctactggagttanttattaacatcaaggctggaacctatttgctcagtcctatctgattcatgagcacatggttatagatcgcatgaaaantgatcacctgttctntattnatcgatgtgtcatgacaaggaaattacnaantgcaacgcaagaaactattaaggtatcagaaagtgaagccaggcaattgttggcgcaagttcggcattttgataacaaatttgcgtggcaactttattgtcttgaaccaggtcagaaaaacattattgaggaaaactata

SEQ ID NO: 612921 - DNA, 1186 bp, Homo sapiens
gcgccttcgccgccgccgcccgcaaaccttcgtgcccggcccgtcctcgcccccgtttgcgacgacggctcggcgcgagagcttgcaggtcgcacccgtcagacaatgtccgaggtccaagagcgaggcccgacgtatgcttcgttatttcgccgttcatgggcgcctcggccgccatggtcttcagccgccctgggcgcatagacatataggcacagccaagagcggtaccgagcatttgcggccatgtctgtcatgcggccggagcagatcactgaacgtccattatcccagtggtcatggctggcatcatcagaccatctacggcctggtggtgggaagtaccgtcatcgccaactccctgactgacgacatcagcctctacaagagcttcctccagctgggcgccggtctgagacgtgggcctgacgcggacctggcagcccggctttgccatcggccatcgtggcgggaccgctggcgtgcggggcacctgcaccataagccccgactattacgtgcggcatgatcctgattctcatcttcagacgagagtgctcgggcctactacggtctcatacgatcagacctcactctctaccacacagcaggaccctcatccgagccaccagccaacaggaatatcatgtacagaccaccccactcgtcagtccagaacgaacagtcctgacacatacgccacggggccgccgaccccagtaaggtagctcttgcaccattgcgccagtgtactaagttggccagtcgtcttggtacccaggagcagggtcataggcccggcgaagagacagagacacacgggagcactaaggcgacacaggagcaccgccgcacaaaaaacgaaagagagaacagagccaccacactaagcaacgaaacccaacagaagatacaaaaaaaccgaacgaccaacacgcaccaacgccctcccccgccactaaccacgcctacacagaacacagacccgaccacacacacacagatacctaacccgatcaacaccaagaacaaacacagcaccaatccgctacaacctacgacaacatcacacaacaaccacagctaactctgcaccacatacggtcgcggactgagctctccctactcttctccaccactcgtactcccgacaagcccacccacgcagatcgaacaagaaccacac

SEQ ID NO: 612922 - DNA, 967 bp, Homo sapiens
  misc_feature (283)..(283): n is a, c, g, or t
  misc_feature (330)..(330): n is a, c, g, or t
  misc_feature (336)..(336): n is a, c, g, or t
  misc_feature (347)..(347): n is a, c, g, or t
  misc_feature (354)..(354): n is a, c, g, or t
  misc_feature (364)..(365): n is a, c, g, or t
  misc_feature (376)..(376): n is a, c, g, or t
  misc_feature (386)..(386): n is a, c, g, or t
  misc_feature (419)..(419): n is a, c, g, or t
  misc_feature (421)..(421): n is a, c, g, or t
taagggatttccagtctccttctccacttatttcaccgcctcctccacgcgtccgacttataccagtatgggttcctatatggtgggtgattgagaggtgagtgttatcgagccgatgacaatcagcgatgctggctgtgaccccggaagagactggcctccagcgacgttctcagccagcgctcgcagctgtccggggcttctctggcagaagccatgtctctcacatcatgtgccagcctccaccctcacgccatttccaggaacagactgcgggtatgtngcagtgtagtctttaacctgctctgatacatattcagagtatggatngttgtntaaaaagagtngcatgtntaaagagttnngtactagcttntcattatttngtatctagattatcaacaatggggctaccactntnccttggttatatatccattatcctcttggaagtactagtagcttatgtgacctgtaggatagttaccccggactgggcaacctgcaggacgtcagggacagacggcagactgtgagctggaggtcagggctctactgcattagtagtgtagagtcttccaacatgggactgatgggagcagtgggcatcctcatatcacaagggctagccaggatgcgtcaatgaaggaccatacaccaagcctgaacacaaccagaagaggaagagaggagaagaggacaaatcaacagagacaggagactgagtggagtcaacagcagaagaaacactgggagatggagcaaacacaagcaggccagaggaccaacgatggacacaatcaccacgggaaaaagatgacacagcaagggtacagacacagggaccataaccagaaacaagaagaaggaatgacaagagaaacaaccagaatgaagcacataaaaatgcacacaagagaaaaagaaagcaacaagaaaaagtagaagacaaaaaacaaagaaacaa

SEQ ID NO: 612923 - DNA, 757 bp, Homo sapiens
  misc_feature (757)..(757): n is a, c, g, or t
gcggagctgcgcaaggtggagtgacgtgcaggagccaagtgcgagcccaggcagccacggctgtatcggagctcaggactctaaaagtggcagagcagctttctccaggaccggcggtggattcaggtgtgcagctatccgttttcagaataagcctgggcggcagcatggggctgctggacgctagaaagcgctccggcctagcgacccagaggcgccggagcaaagcggcagcagtagcggacgaaaggggcctgcaactggtgggtatcgacccgggaacaaacgaagcgggtgaagccgacaagtccaagtggatacagacagagcccgtgacagctggtaacacagaggggcgggggttaacgggcggaccttggacgcaggcggaaaggggggcacgacgggaaactcctgagcccagaggagatccacgcgccgtaggggtgcatagaagttcccacccccgggttacagggcaggaaccacacgcccgaggttggtggggaacccccaaacggaagggggactccattaggggaggaaaggcgggagacaaggggcatctgagcccgtaacttagggacgcccgtgggggaaaccaccacagcggcaggggaacacaatggggagcgcgctgcgccggtaatcggcgacgaacgaagaaagacgggcgcacagaaacagagccaagtgttgggggggacgaggccagacgcagacgcgcacccgaggcggacagaacagaaacgtgccn

SEQ ID NO: 612924 - DNA, 193 bp, Homo sapiens
ccccaccaccctcctcctgcctcctgacccagaattgcaccagcactgcacacacacacacaccccacatgatgtgtttgctttgtatgaatgcttcacatgtatgtgtgccttgcaacatgatgcttgtgctaactacatgtgcatgtgatgcccttgtgatgaaatgaatgccttgttgcttgttgtgtga

SEQ ID NO: 612925 - DNA, 296 bp, Homo sapiens
gccccaggttggtaaagccccaagttgagaacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctccgctgagctgcccactgcaacatattttcacaatttctctaataaatctgcccttctttacctacaactatcttggtaaatggctttaccacctgcaaaactgaccctaga

SEQ ID NO: 612926 - DNA, 84 bp, Homo sapiens
gttaccccattatattatttaaaatgtttagtatttaccaaaaaattatgacataagcaaagaaatgccagtgtatctctccca

SEQ ID NO: 612927 - DNA, 143 bp, Homo sapiens
ccaaacaacactcaaacatgccttaatatatctagtacaacgggaaaatcttacccatgcgccctctatcttgcaacttagcgcgcaaagcccaagatgaatctcacatacagtattcctttcttctacactaatctcaaagc

SEQ ID NO: 612928 - DNA, 160 bp, Homo sapiens
atcttctttgaatctgcggacacagtcaggaaagccaccattggatggttcaaacttgtcgtgcactgaaaaaccgtctaggcgccagaacagtataacggcagctccttagatttgtctgtcagagactccagatatgaatggtttccgtaaggaacaa

SEQ ID NO: 612929 - DNA, 447 bp, Homo sapiens
ggtcagataagggaataaaagcaggctgcggagccagtagcagcaacccactcgggtccccttccacactatggaagctttgttctttcgctctttgaataaatcttgctgctgctcactcttttgggtctgcactggctttatgagctgtaacactcactgcaaaggtctgcagcttcactcctgaagccagcgagaccacgaacccaccagaaggaagaaactccaaacacatctgaacatcagaaggaacaaactccggacacaccatctttaagaactgtaacactcactgcgagggtctgcggcttcattcttgaagtcagtgagaacaagaatccaccaattctagacacattagcagcaccattcaccacaggcaccatgtctcggcagcaccattcaccacagacccatgtctcagcactgttcaccacagacacctgc

SEQ ID NO: 612930 - DNA, 165 bp, Homo sapiens
acaagatataattcactaggaatgggccacatattgccgacgtgagtgtgcttcaatagttcaggaatttttgttccagaacaataattaaatattcatgggtgaagtatttctgctcccatggatttatgatgcgacagagatcacatattgccttaaggtttt

SEQ ID NO: 612931 - DNA, 396 bp, Homo sapiens
gagagagagtgagatagagacacagcgttagagacacagagcgacacagagcgcttcagagatgtgcttcatatccggtggccgaggattccgactttcccatatcacaacctgtcctatagcggcttctcgaccagaggcgacccaagaccgaggataggtgtggccattggcgaccagatcctggacctcagcattatcaagcacctctttacatggcctgtcctcttccaccaggatggcttcaatcagcctacactcaacagcttcatgggcctgggtcaagctggctgtgaaggaggcgagagtggtcttgcagaacttgctgtctgtgagccaagccaggctcacagatgacaccgaacttcgggtgtgcattcatctcccggcttctgc

SEQ ID NO: 612932 - DNA, 145 bp, Homo sapiens
tgattcgattgagctgtggcatgaaagacagcagctcagtatcagcttttcagagcgtgaagtctgcagaagcctgctggactgagtcaagatgcttagtgcaacttggggagcgcatacaaattttagtgctcagtcgaacgga

SEQ ID NO: 612933 - DNA, 106 bp, Homo sapiens
cctgaggcatacctcaggcctctactagtcaagcaagcctggcttgtagctagataggcttacctagagcagtacataaacttagattaatctcccggagtgcccc

SEQ ID NO: 612934 - DNA, 205 bp, Homo sapiens
  misc_feature (71)..(71): n is a, c, g, or t
  misc_feature (73)..(73): n is a, c, g, or t
gatgatctccggcctagacatgtgatttcacttacactgcataacggttctgatactagggctacttaccncncacactaaccatataccaatgatggcggggatgtaacacgagaaagcacataccaagggcaccataaatcagctgttccaaaaaggccttcgcatacgggataatcctatttattacctcagaaattttttt

SEQ ID NO: 612935 - DNA, 111 bp, Homo sapiens
  misc_feature (40)..(40): n is a, c, g, or t
  misc_feature (47)..(47): n is a, c, g, or t
tcaagcttctaacgatgtacggggacatgcttctcagggntcaaggnctttatgttaaagcttccctgtcgggcgctgctaggtcagcattaaagtaaggcaaccaaaaaa

SEQ ID NO: 612936 - DNA, 376 bp, Homo sapiens
ccgacggcatcctaacagggcagagatacctttcacaagtttccacgggctgacaaaaaggggaacacctcagtataacccccgtaacctcgggcagggacttaagagcccggggctgggaatttctccagggcaccagacccaggatgggggtaacagcacttaagaatactaggaaaccacaatcccgagaacatgggggtaggggctacggagggaccgaacactatccacttccctaggtgagctccatacgcccttctacaacggggagaaccagggaaagaggaatgcatcccgggtgaggctagatgagctcaagcctcccggtagcccggccgggccctgaactcaggcgggctggttttactttctg

SEQ ID NO: 612937 - DNA, 332 bp, Homo sapiens
ctcagcctcttgagtagctgcgactacagatgtgtgccaccctatctggctaatttggtttattttgggttgagatggggtctggtgctatgttgcccaggcggatatcgagctcccgagctcaagtgattttcccacctcagcctcccgaagtgctgagattgcagcatgataaatatggataagagttccaggggtatttaatctaatctcattaaatcctcagaacaattctgtcacaatgggccccatttcacaggtgagaaaccagaggagcagaaatgtggcgtaactggcatgacgttgcaggtaagaaggggcagagaatttag

SEQ ID NO: 612938 - DNA, 105 bp, Homo sapiens
ctcagttatcactgtcctatggtggtaatgagaatcaaaagcagagctcatatagcctgcacccatatataagcgaggacagcagctaaacatggaatcatcagg

SEQ ID NO: 612939 - DNA, 256 bp, Homo sapiens
gggcccctctcctatacaacttgcctcctcccagagatcttcctcagtgctggaagctgtgccttctatcaccattccctatttctctttgccgggctcagccggggccacctttacatgtaattttttttctctctgaaattccgtgtaaaattgtgaagtctatgttcgctatatgtaataagtggattaaaaatgttgcttggggtttttcttttttttttttctttttttttttttccctctttttttaata

SEQ ID NO: 612940 - DNA, 867 bp, Homo sapiens
  misc_feature (180)..(180): n is a, c, g, or t
tccaaaaaaggatattttttttattccaagtaactggcaaataggaaaccaaagagggagccccaggtctgggacaaattcagggcatacccctccccaacagaacagggggaggaggtggccccatacacccttaagtggtcgattcgggcccccgtgctcactcgtgcagtgaagcantccataggggacagggccccaccttcccgtgggacgggggatagtcggtaccacccagaccgtgccagtgccccagccctttttccccacaaagagtatctggggggaggggatcgtgggcaagaacaggacggcaatgacggatgaccattgggacgctggtagcagcagcattgacgtgatgtcgaaagaatggaccatgtgaaccaaaaaccaacacacagggctccagaaggatagttgggtgaacagaggcacaaagggacccagaacctggggggcagggagagacaggaggaggggataggacacggccagggtgagactccgtgtcatcggtgccccatcggcaggcagggggacatgagcagaagaggcgagacagacaacagaacggatcagggagaagaagacacgcagacaactacctaaaggatgagaaggacacaaaggactccatggggcccacaagcgggaacaacaacagatgcaagtggaactctccataccaaccacagaagacattgaacaccaagaaatccaagaggggaagagacaaaggaggagcagggcggacagcgaggaaagcagggacataagaggaaacacacaaccctacgcgactaccggaagcgagaaagggtatgcccacccaatagacgaagacgaacggaaagttgggcataa

SEQ ID NO: 612941 - DNA, 635 bp, Homo sapiens
  misc_feature (14)..(14): n is a, c, g, or t
  misc_feature (39)..(39): n is a, c, g, or t
  misc_feature (42)..(43): n is a, c, g, or t
  misc_feature (75)..(75): n is a, c, g, or t
  misc_feature (82)..(82): n is a, c, g, or t
  misc_feature (86)..(86): n is a, c, g, or t
  misc_feature (89)..(89): n is a, c, g, or t
  misc_feature (100)..(100): n is a, c, g, or t
  misc_feature (112)..(112): n is a, c, g, or t
  misc_feature (115)..(115): n is a, c, g, or t
  misc_feature (118)..(119): n is a, c, g, or t
  misc_feature (126)..(126): n is a, c, g, or t
  misc_feature (146)..(146): n is a, c, g, or t
  misc_feature (163)..(163): n is a, c, g, or t
  misc_feature (165)..(165): n is a, c, g, or t
  misc_feature (172)..(172): n is a, c, g, or t
  misc_feature (175)..(176): n is a, c, g, or t
  misc_feature (179)..(180): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (207)..(208): n is a, c, g, or t
  misc_feature (233)..(233): n is a, c, g, or t
  misc_feature (238)..(238): n is a, c, g, or t
  misc_feature (240)..(240): n is a, c, g, or t
  misc_feature (270)..(271): n is a, c, g, or t
  misc_feature (304)..(305): n is a, c, g, or t
  misc_feature (307)..(308): n is a, c, g, or t
  misc_feature (324)..(324): n is a, c, g, or t
  misc_feature (332)..(333): n is a, c, g, or t
  misc_feature (342)..(342): n is a, c, g, or t
  misc_feature (345)..(345): n is a, c, g, or t
  misc_feature (353)..(353): n is a, c, g, or t
  misc_feature (360)..(361): n is a, c, g, or t
  misc_feature (370)..(370): n is a, c, g, or t
  misc_feature (376)..(377): n is a, c, g, or t
  misc_feature (386)..(386): n is a, c, g, or t
  misc_feature (389)..(389): n is a, c, g, or t
  misc_feature (393)..(393): n is a, c, g, or t
  misc_feature (397)..(397): n is a, c, g, or t
  misc_feature (438)..(438): n is a, c, g, or t
  misc_feature (456)..(456): n is a, c, g, or t
  misc_feature (463)..(463): n is a, c, g, or t
  misc_feature (466)..(466): n is a, c, g, or t
  misc_feature (469)..(469): n is a, c, g, or t
  misc_feature (485)..(485): n is a, c, g, or t
  misc_feature (490)..(490): n is a, c, g, or t
  misc_feature (508)..(508): n is a, c, g, or t
  misc_feature (514)..(514): n is a, c, g, or t
  misc_feature (522)..(522): n is a, c, g, or t
  misc_feature (526)..(526): n is a, c, g, or t
  misc_feature (534)..(535): n is a, c, g, or t
  misc_feature (538)..(538): n is a, c, g, or t
  misc_feature (559)..(559): n is a, c, g, or t
  misc_feature (575)..(575): n is a, c, g, or t
  misc_feature (613)..(613): n is a, c, g, or t
gcggtggcctccgngcgggtggacgagtcgcgggcgatnggnnctgcgctgcgatgccgtccgctggtttcagcntcggtgnaatngcngccgcgcgaangtccgccagcgntanttnntccgganctttctcgtgtctagccttngggggctgcttgcggtngntctgagngtnnccnncncntancctcgcgctctctcaaggtnnagaaggtacccgctggcggagaagngcagncngatgggcaaagaagccctggagaagcgggnncacgaagcgcgcagagatacgaacacgtcggtnngnncatcgttaaacaactncaggacgnnaagatgggntanatgtgtangcaccgnntgttggttntaggtnntgcggcggnctntgcntgcngggaggctaggggcgccgcgggaaccgcgggagggggtggnagggctgtctggtggggntaggggntcngcngtgggaggtgggggtncaggnaaaggtggggagaacttnctaganagttccangganggaccctnnctngcctgggagcgggtggggatntttgtctggtattctnagtggccgagagtatagtgcccctccaggggagaaaangtgggtgccggagcggacaact

SEQ ID NO: 612942 - DNA, 253 bp, Homo sapiens
agccggcccaggctatcaccctataccactactaacccctagtcacaccattctactttctgtctctaggaatttgactattttaggtagctcatgtcggtggtatcagccagtgtttgtctttttgagtctggctgatgtcatttagcatgctcatccattcaaggttcatgcttgcagaaggcgtaaacacttccttccttttaaaggctgagtaatattccattgtctggatacaccgcggtggtatagt

SEQ ID NO: 612943 - DNA, 323 bp, Homo sapiens
gtgttcgccccatgggagagggtgacaggagtgagtttatgtttgggatctttatgttgtgcgtgttagcctgaacgctttcttattgtggctcgctctaggcctactatgggtgttaatcttttactctctctactacgttttttcctagtgtccaaagagctgttcctctttggactaacagttcagtttaccccggggatttagagggttctgtgggctaatttaaagttgaactaagattctatcttggacaacccgctatcaccaggctcggtaggtttgtcgcctctacctattaatcttcccactattttgctaca

SEQ ID NO: 612944 - DNA, 114 bp, Homo sapiens
agcacacagaaggggatggagcacacaggtggagcacacaaggtggggatgacaaggggacatttaaggggaaatgttgagagagttgcagcgtagagctggagcacacaggtg

SEQ ID NO: 612945 - DNA, 105 bp, Homo sapiens
gctggaccgcttgagcaatctggtgggcagccatctaagacccatcctctcaatacacagtggctctgttaacgctcgggatcctgtcacagacacaaacttctc

SEQ ID NO: 612946 - DNA, 286 bp, Homo sapiens
cagtctccactccacctatccctcaaccccgacatcattaccgggttttcctcttaaaaaaaaaaaaaaaaaaaaaaaaaaaaaaattggaccacagggaaaaaaaaccacaaaaacaaaaaaacggtaattggctccaaatgccgggttgtgttgttttttttgggttacaaaaaaggggggaagtgttaaggattgtgacccattctccagtgataggtaagggccacttgggtcacattgtccgttgaaatggggggcccttctcctgtgtttgaaagcccag

SEQ ID NO: 612947 - DNA, 1098 bp, Homo sapiens
gagcccacttgactgtcatcgaagcgaggagcagcagatggactggtctgagtgcagctgataaaggccctccgttgccttcccgatcctgggctgcgtactgcggtcgctgtgagtgaaccacgattcccttttcccgtactacgtttgatgggtaattgctcggaccgtacctctcgcaggggacgttcatctgtgcatcacggtgaactctgtatctatgttcgttgcacgtagtaactaatcgttctcctaggcgacgtccctttaaggtgagctgttccctctagtcaacaccggcgcatacactatggtgcactcgaactcgtgacaagttgcgcgtgatccctctatcactcagaagaaggagaatacgcctcccctccttcaaatgtagttaccgagtggccttttcttgttgccgaaacattgcaatgcgaggtctatctgggatgtgcgaaggcgagcgacgatggaactaactgctgcgcgggggtacaatccgtccggggcgcgtgaggccgacggagtgggtcctggtgatctgtccccctctggttgcatgccccgcctgcttgggttctgcactcgtgagcccctcacctccgtattgctaccctgcctctcgatcatccgcgatggtcctccctgcgccaccctagatttgcttagcgagctccgtggtcgaggttctgtcccctgaagaaatttctgcgttcctcggtctccatggattgtccttgcacctgcgaggtccatgtctgtcagtgacacccagaacgtactgttttcctaggccctccggcaacacctcgtggtagctgatggccggtgggccttgcgctacacattttccctgggtctactggtgcctgcggggttgtgcgccgttatccccttgatctgaacgggatgcttccggcaatggggttcggtgtccccctgccagggctcaagggtggctgacctgccgctccaaaactgtcccctgaggactctaactgtgacgggcccaggcccctgggcccggcccgggccgcggtctttggccccgggcgtcccccggatgtggccccccccccttttctccgtttgcgt

SEQ ID NO: 612948 - DNA, 160 bp, Homo sapiens
cgcgccatgatcctaagtcacagtcagcatctggggaaaggtgaagaaagacaagtgtggcctatggggaaatcttaccttccttcacactacacactcttaagcttagcgatcactctgcgctcggggctacccgcaggctcgatacttcgctaaatct

SEQ ID NO: 612949 - DNA, 99 bp, Homo sapiens
  misc_feature (16)..(16): n is a, c, g, or t
  misc_feature (74)..(74): n is a, c, g, or t
gaattcgagctcggtnccccattggataagcggatgagggatatgaggagaatgaggagtttctgaggaccatncaccacccgctgctggaaatgctga

SEQ ID NO: 612950 - DNA, 953 bp, Homo sapiens
cagtggtgccgctgtgcacactcttgcgcccgcagttgttgtcttcatccgggggtccttatacaacgttgcgggatccctctccggggttgccaatacaacgggtggaggtgtcgcccaaaacggaaatgttgctcgccaaacagtctcttttctgccagccagaggctcttctgtttaactcgccctcgcgttctggaaattggccctggctgccccaccgataggctccacgctcgtggactgaatacctttgccgcgctctgatatctgcgcggcaaatcttccgggatcacaactgtggacttcccccccggggggtctttttctcaaccacagggcccaccattcgtcgcttctggtcacctccccaacaagttaacctcccacacactccgggtgccgccttctgcaatgagcacatttttttatgggacctgccccctgaagaatgaagtcccccttcgctggcggtttaagcacgcgggtccgccgtgccgcccctcctgagtggcgctagattcaacccacggctccctcttcacctgcgtgccgttaaccccaccgcactgcggggatcttgctgtgtgcaaccccccgccactggtggtctgtggattctcttttccctgttagtcctcggtgtgttcacgagaataatcggccacaaccccactttgttctcccaactcgacatcagactcgctgggctcaggtctctcgtttctcccgcaatctccctgttcttaaaagaagacctggtgaataacctccctttttggaacataaacaccggcgcgccatattcagtacccttgtgtgagatgtttttacgttctatgcaaattgtatcttcacctgaccgccattcttctagattcaattcccgctaccctctccccgcaaaaaaccctattcccccaaaaaaagttggcccgcggcccaacataaca

SEQ ID NO: 612951 - DNA, 471 bp, Homo sapiens
tcttaatggtttgcacaatgaatttttacatatgaatacagctgtgggaccaccagccagatcaaggtggaggccatttcctgcaccctggaaggctggttctcctgagctccattgtaatgaacagtgagggcacaacctcctccctcttgccacaagaggggtatggggagttagccttgtggattctggagttgtagcacagtgagtttgatcccagctccacctcttgggctacctctgtgaacctcagtttccccaccagcaaaataatgacaattaaacatttatatttattagctcatttaattttcacaatgctcccacaaagaagggggcctgttatcattccaaacttttaaacaagaaaactgaggcacaggagaggttaagtaatcagccaaggtcatacagccagtaagaggtggagctggccagcctgggcaacacagggctaccccatctctacta

SEQ ID NO: 612952 - DNA, 1217 bp, Homo sapiens
gttctcctttcgcttgttttcctcactgctgttgtttctcaggtgtctttggtctgtcttcactcctgtatttatggtcgcgtggttttgctttctctgtgggtagtcgtggggcccctgttcacggagctgtgtgtctccttgatctttgtcccgggtgattttcccagggttatgcttgttcttcattgtgggcgtgccaaaccgctacggtggctgcgtgccctgttcacgcggcaggggcccgtgccatctatttttattatgtggagctctagtggttgttctgcccggccccttctcgggaactatccccctggggtttactcttggctcttataggttgggctcgctgtggctcgctttttgggaccttgctccttgggtgggccatatggggacgagtttcgcccaattttgggacctgaaagtgctctttccgcggattttataatgtaatttgtgtctgcgcactttggcccgttttacccggcgtcgccttcgaaggtgtgtactggccgatcgtttctcccatgccctcctagaatgtatgtttatccccggagttttttttgccgaggaatctttggtgaaaatgcccccctgagagtccccacagaggccctcttcgaggcccccacctcccagaggatgatgccctctcccacgaggtgcctttaaagagaggaacccccacctcgtataaaaactcttgaagaattcacttgttttggaagctcgtaaccccacttattgccacagacccaaagccgcccggggaccaccagttgtttccgcccaggcccagaggtatccacccagcctcccgggttggataaagagccacacatgtctggccacaccaacgggccacatcaccaagccccgaatccagaatagtagaaagagcggcggttttccaagggccagaaagacctctgggttagagtgtaagaaaagggaaagaaggcgcgctctcttgtgtggttctaagaaacccagcgaaggaaccctttcggtgggggaaaaaaggccagaccagcttcccaggaaaccacgcccctgaataagagagcctgcacagagatagaaacctatctacccgaggagaagaagcctgctgcatcaatcttttataatttgattattccactaaagaggtcacaatcacttttggacacgctttttttgaataaagacctgattataccggccca

SEQ ID NO: 612953 - DNA, 431 bp, Homo sapiens
  misc_feature (1)..(1): n is a, c, g, or t
  misc_feature (15)..(15): n is a, c, g, or t
ncttgaggacccccngcctcacatcctgaaggcaccatgctgcttctccatctcaatgtgtaccctctagtgcatggcatacttatattcaggaagccatgctgtgcacactggggtggctgctctcactccttgtgaaattgctggttctttacaaccagcttctctggaagtccttctttgtcacctaattagcctatgggctacacagtaacaggatgaggaaacgtggttaacaggaagaagccctcactgcatctgtcctgagctttctgagcaactggctgtcctgagaactcaacaatgcctttccctaagggccttccttgatcatccacaatgactacagccctctccacctggccaaagaaaagtcttcttccaaaagtttgttagaaggtttcagactgtaagggatgcactatggcagg

SEQ ID NO: 612954 - DNA, 1824 bp, Homo sapiens
  misc_feature (1824)..(1824): n is a, c, g, or t
gtgtgacagcgccgagttcaggtgatgatctgttgcatacgtcgttggcgtatggtcgtatactcacggcgcacggataaacggaggcagtacaccgtccattgtgagcgctagttcaggatctgacacatatggggggaagtgtgatgctggacgggtggctcgcagagacgaggcattgaaggtcagcatatttgacccagatatggcatgctcaggaggcatcatctagactctggtgttcaaggagattagcaccaaagcatcatttgcgcgaagacaatgtcctctagttccgcatagcaaccaaccgcatcgattgcaagatccatgtggcgcgtggagcgagcgtggcctctcgaaacaaggtagcgcggctgctgcagaggagtcaagcttggagtgtgggcgctagcgtaggatcgagttctcattggaagctcgtcaagcgcgagagaaggaggaccgccaagggatagcgaaagccaacgctagcccgttgtcgggcgcgttatctaagtagagactgagtgccaacccgtgaaggaatgtcactcaattgggtcagttgggctagcccttccattgagcgaaggaagaggacagacttcaaagggaaacagctcccacactaggggggcccattggcccagtagtcacgcaccaccaaagaggcctagacccctagttgggattcaagttcccgtggactttcgaggacgatggccggcatagcaaagcttaaggaaggcgactctgggtcgcggaatatccgaccctggtggaattcctcccggtatgagaggaggtaaggcacatggcgagtgaggccgaaatggtggcaacgcagagaaacaggaaattccagtgccctgttgggaaagccttagggcaaccctggagaaacagggtggggcttggaacacaagagcgaaggaagacaacaacactaggggaagaaaaacggagcgagaggggagtggagcaagggcgttttcctaaccggttggaaccctaaccgaaagccacccaatcaggtgaaggctttggacttggcttaggcacgcgattgacaaggctatagcttgagtaaagcgtccaatatcccagaaagaaggcattggctagccacagaagagggggacttaggtcgggacgcagggggcaaatggcaaggcgcccttgggggacactaggtggaaggtcaccccattgtggcataggatcatgcccttgagcatgtccaccacagggatgtattgagctccgatgagaaaggatgcgatgtgaccctatggttttcgcagacacaaataaggagacacagacggggtccagcgactacaagagccattatgggggagacacaaatgtacaacgtaatttagtatagaagcagatattggagcacacagagtgagcgttatcgcacgagcggtatgcacgcagagtagtcaggagatccccccatgtgttagcaggaagatgacaccagagtgttggatccccgaaagtgtgcttgtttagaccttatactttggttgctttgtgctgctacagacctagagtatgactttataaaaggcgcgatcgatggcaactaatagtatgattgtttaaaaccagcacaagataaagtgagtgcttacacaataacaacgaaggacaaacatgcataggtagcagaagagtaattatggcaggagcctaatatagtacaagtaagaacaacaacgtgatatgaagagaacggttggattaagaaaaaaaatggaggttgttgaatagatttaatatgttaagaaaagtgaatattaatggaan

SEQ ID NO: 612955 - DNA, 118 bp, Homo sapiens
gcgagcagcaaaccataccgaagtaagtcgaggccaagggttgctaattccgctcaatgtactaggggtacaacacgtttttcgccaacaagagccaggcgcacgccacacgcgcaca

SEQ ID NO: 612956 - DNA, 128 bp, Homo sapiens
  misc_feature (120)..(120): n is a, c, g, or t
gcaccaaacaccaaactcataagaaagagttcttgaaggaaattaaaagtgctgctccagtgaacacctggacaaaacagcattattgctggtatagagaaagtttgagtggcctggatnaaagataa

SEQ ID NO: 612957 - DNA, 744 bp, Homo sapiens
  misc_feature (1)..(1): n is a, c, g, or t
  misc_feature (104)..(104): n is a, c, g, or t
  misc_feature (133)..(133): n is a, c, g, or t
  misc_feature (158)..(158): n is a, c, g, or t
  misc_feature (177)..(177): n is a, c, g, or t
  misc_feature (191)..(191): n is a, c, g, or t
  misc_feature (194)..(194): n is a, c, g, or t
  misc_feature (205)..(205): n is a, c, g, or t
  misc_feature (213)..(213): n is a, c, g, or t
  misc_feature (217)..(219): n is a, c, g, or t
  misc_feature (224)..(224): n is a, c, g, or t
  misc_feature (226)..(226): n is a, c, g, or t
  misc_feature (230)..(230): n is a, c, g, or t
  misc_feature (233)..(234): n is a, c, g, or t
  misc_feature (251)..(253): n is a, c, g, or t
  misc_feature (255)..(255): n is a, c, g, or t
  misc_feature (257)..(258): n is a, c, g, or t
  misc_feature (261)..(261): n is a, c, g, or t
  misc_feature (279)..(279): n is a, c, g, or t
  misc_feature (286)..(286): n is a, c, g, or t
  misc_feature (288)..(288): n is a, c, g, or t
  misc_feature (300)..(300): n is a, c, g, or t
  misc_feature (321)..(321): n is a, c, g, or t
  misc_feature (323)..(323): n is a, c, g, or t
  misc_feature (337)..(337): n is a, c, g, or t
  misc_feature (341)..(341): n is a, c, g, or t
  misc_feature (361)..(363): n is a, c, g, or t
  misc_feature (387)..(387): n is a, c, g, or t
  misc_feature (447)..(447): n is a, c, g, or t
  misc_feature (494)..(494): n is a, c, g, or t
  misc_feature (586)..(586): n is a, c, g, or t
  misc_feature (600)..(601): n is a, c, g, or t
  misc_feature (653)..(653): n is a, c, g, or t
  misc_feature (674)..(674): n is a, c, g, or t
  misc_feature (723)..(723): n is a, c, g, or t
ngagggctttgggatacgattgctgggcccgaggactcaaaagggggccgagggtcactgtcagggggtctgcgtgaccacggggtacagcagagccagacgcncggcaccctgcaccggcagtgggcgtcanccgtagtggaggacgagcccgggcncgccggggaagggcccgcngtgttggcccagcnccncctggttctcncgggtccncgcnnncctcngncgcnggnngccctggctgcccctgnnncncnnggngccgtcctgggggctggnctcactnanccgccctaggtngccgcctcccttgcagagggncnggaggctctctgcntccnccctgtccccggggccctcnnnccacggctgtctctccaggggcanggctgggtccacacgctccgcagctgggggcttctgggcggaggtctccggacctcttgnctgagcctggagtcctctcccactctggactgtcaaactgcactgcnaacgccctggagatgtggtctttcttccactcccagggctgatcatactcatctgctggccgtccatcttcctggggcatccggctctgcgngggcttctgcccannagggggtccatctgctgtctctgggtcctgttcctcacaaggggtgtcacanagctgcacccctctgccgggnagttcactcatgacccattgggcatcgtagggctccatgtacccatcanccgggggtgcaggatgaggct

SEQ ID NO: 612958 - DNA, 336 bp, Homo sapiens
gtttgggcaaaagtatgagtcctgtggcacggtaatgtggttgagccggtggtcccctccacatggccctgcccccctgtgagtgtcctggtgcctgctttcagctttgcgttctttgtggcagcctccagaaaggcttttaggtcaggtttttggcattacaaaaaaggagtggactgtgcaggctgccctcatttttaccccccccagttttgtaaccagaacgaggcacttggcctttgtgttttgagagtttttcccctcagttgtaaagtagaattcgaatacctgtttggcagggtggcggttcggactaaatgaggggcccctggccca

SEQ ID NO: 612959 - DNA, 116 bp, Homo sapiens
tcggtataagggccaatgaagggtgggcagaggggctaatgccgtatcctgtctggggtgctgtgctggttgtagatcgggctacacaaactgttgctgctgctgctgcttcttgg

SEQ ID NO: 612960 - DNA, 903 bp, Homo sapiens
  misc_feature (903)..(903): n is a, c, g, or t
cgactcgtcgctagacgtgcgccgtattgcctctcgggctgggcaagtggtcccggctgccggtcgacgaccgcccgcgtcagtgcggctcctcggcgtggctggccagtattgtctgtgggtgctgggacttcccgtccgtggcgtgtattgttgcagaggaatgtggtcgcttatggtcagaggagcagcctgctcaccctctccactgtggtgggctgtgtacctgggtgaggaggagctcctgcatgacccgatgggccaggacagggcagcagaagaggccaatgcggtgctggggctggacatgcaaggcgatcacatggtgatgctgtctgtgattcctggggaagctgaggacaaagtgagttcagagcctagacggcgtcacctgtggtgctggaggagcggtggattcaaggtgcaacgtccgagagagccttttctctctggatggcgtctgcagcaacacttccctgacagagtaagaggagtattacacagagccagcaagtggcggaatctgtacgcagacccgacgagaggactccaataacactgaaagtctgaaatccctcgaaaggtgaactgtgaggagagacgagcttacaggattagaaaatttcagtctgaatgagtttaacatatgtcacaggaccttatggatctcgtgaatccaaagggcagtgactgtactctagtcctgtttttacacccccgtggtgccggtttgttcttgccagtttggcccctcgactttaaacgtctcttgcccggggcattttccagctccttcactgtttgggcactggatgcatctcacgcccaggcagccttttctagcaaggtttggaaccgtaggtggttctaattatttacatcatttcacggggcgctaaaccn

SEQ ID NO: 612961 - DNA, 1267 bp, Homo sapiens
  misc_feature (752)..(752): n is a, c, g, or t
  misc_feature (956)..(956): n is a, c, g, or t
  misc_feature (968)..(968): n is a, c, g, or t
  misc_feature (1031)..(1031): n is a, c, g, or t
  misc_feature (1110)..(1110): n is a, c, g, or t
  misc_feature (1138)..(1138): n is a, c, g, or t
acgtcacacaatttagcttacgaccgccccgccagtgcagtgaacgcaccacaccaccataccctgagtgtgagtaccaatcgacaagccagttttgaacacgagagagaacataccacgtaacgccacgctcataaacaggagaacacgaacatgtgtccccccccatcacacagatatggtagatagactgatcatgtgttactgggacataagtgggcatgagtgtaagtacggcggaaatacgccaaaggcgccacgcggtccacctgacagttcacaacccacatcaccaattacatgcaatgtcgccacggagggatacacaagtgtagactgttctgattcggagtagtatcaccaacactccaccaaccttgtcttaccgtagtgcgcatcttcccagttaccacaatcatcgcctcccgatcaatgatagaggacgcattaaaacacactcacaccacatatacaatattagtatacccggtcgcacaacaagcctctgctttgcctttaagctcacatacaccgagggtgcatcacgtcaggtcacgcgacgtgtactgtatattagctttgctctcgtcgctcatactgccatgcgcgccatagagctgaagatacatcacacctatgtcttagtaccgagccaccgatctaccttgaggacgacacgaatcacagctctggacagacattatggaacgggcgcttactgtattgatgccagcgtgacgaagaaccgtccncgagacatggacgcggttgtacgacatgtcatcggccccccgctcgacccgcactactatacaccaccatcgtcgtctatagatagatagttcacccgtgtaaagcacaacatactgttcaatcgaatacaacacatgagggtaagaacgagcacgcccaacgtactgccacattccaccatcgccatatcacgttccaatacnacatgatccagnactcatgatgtccaaccgcacgtatgtattccaggtatagctggaaatcacgcgtctccatcnttagcgcgcggatatgatgtatatacagcacacactatcagtacacacattcgatacacagtagtcataccgagacatngcagttagctccgtctgccaccatcaanataccaccgagctcaccacacatgtctacaatcgcatatctcctgttgtggcacttcacagcctacgccaccgccctgcacagatcgtgtgtcccccacctctctagttattcatagccactcgacagt

SEQ ID NO: 612962 - DNA, 481 bp, Homo sapiens
taggccggacctcataggttcgcggatcataggatatagtggagagagggtcagaggtaaacaggtgaacaaaggtctctgcatcataaacaaggttaagaattaagtgctgtgctttagatatgcatacacataaacatctcaatgccttcaagagcagtattgccgcccgcatgtcccaactccagccctaaggcagttttcccttatctcaggagatggaatatacaatcaggttttacatgagacataccattgcccagggacgagcaggagacagatgccttcctcttgtctcaactgcaaagaggcattccctcctcttttactaatcctcctcagcacagaccctttacaggtgtcgggccgggggacggtcaggtctttcccttcccacgaggccatatttcagactatcacatggggagaaaccttggacaatacctggctttcctaggcagaggtccctgcgaacctatga

SEQ ID NO: 612963 - DNA, 1027 bp, Homo sapiens
  misc_feature (5)..(5): n is a, c, g, or t
  misc_feature (67)..(67): n is a, c, g, or t
  misc_feature (72)..(74): n is a, c, g, or t
  misc_feature (79)..(80): n is a, c, g, or t
  misc_feature (82)..(82): n is a, c, g, or t
  misc_feature (98)..(98): n is a, c, g, or t
  misc_feature (105)..(105): n is a, c, g, or t
  misc_feature (111)..(111): n is a, c, g, or t
  misc_feature (175)..(175): n is a, c, g, or t
  misc_feature (256)..(256): n is a, c, g, or t
  misc_feature (263)..(263): n is a, c, g, or t
  misc_feature (360)..(360): n is a, c, g, or t
  misc_feature (383)..(383): n is a, c, g, or t
  misc_feature (693)..(693): n is a, c, g, or t
  misc_feature (706)..(706): n is a, c, g, or t
  misc_feature (830)..(830): n is a, c, g, or t
  misc_feature (854)..(854): n is a, c, g, or t
  misc_feature (857)..(857): n is a, c, g, or t
  misc_feature (866)..(866): n is a, c, g, or t
  misc_feature (877)..(877): n is a, c, g, or t
  misc_feature (885)..(885): n is a, c, g, or t
  misc_feature (894)..(894): n is a, c, g, or t
  misc_feature (898)..(898): n is a, c, g, or t
  misc_feature (900)..(905): n is a, c, g, or t
  misc_feature (939)..(939): n is a, c, g, or t
  misc_feature (942)..(942): n is a, c, g, or t
  misc_feature (944)..(944): n is a, c, g, or t
  misc_feature (950)..(950): n is a, c, g, or t
  misc_feature (952)..(953): n is a, c, g, or t
  misc_feature (956)..(956): n is a, c, g, or t
  misc_feature (960)..(960): n is a, c, g, or t
  misc_feature (971)..(971): n is a, c, g, or t
  misc_feature (988)..(988): n is a, c, g, or t
  misc_feature (991)..(991): n is a, c, g, or t
  misc_feature (1016)..(1016): n is a, c, g, or t
  misc_feature (1020)..(1020): n is a, c, g, or t
caccnacgcgccccgtgaccgcgaccgggcaacagcgcaggggccacagggagaagaagagatccanacccnnngtttnncntcaatcttacaaagtntatcaanaatctntctctctctacattaacaaaaaccaaaggctacaagagcggttgtatatacaaaacacggaganattgcttcacttgcaaacaggttccagaccagatggggagacgagacagaggagggggacagggagggccgagagggcgcntcgcgtncaggagaggggaggggagaggggagagggggggacgggcttctccctgcatcaatcaacaggcagaggtgggaggcctgtgcgagctgctgtgtgcngaggagcgggtgggcgctgagancccggggggtccgcctgccccggcccccgctgcctggttcttcgggctttggcccagagcacggttctgggtggggacgacgggctggctgggccacccggtcacagagggagggaggcaatcgctccctagagtcggccaaggaaaaggggagaaggcggcgccgtccgcccgtcctcctcgcctctggccagccccgtccatcctgccgccctccccaccccgccaagacgctgtggggacccgagtttcatgggtgcagcaaaccggggcttctatgcttttccccgggcaggacggggtagcactngctcctgttcttnctgtggccccggcccggccgttcagagctcactggagggctggaacgagccggccacagagggacagcagggaggggccagaggataccgtggcgggggcgggcggaggacgttcacgcacgcngggtgaggcgcaggggacacaggntcntgcagcacntcagccttttnggcatccnaccgtccgngggntnnnnnnaccttaatttcaccacgtttttcccctgggactngtngntgggancnnggntctncaatctgtttntgtaaacgaatcggganaangtctgtaagaatgtcttgaaatgcntccnctacgtt

SEQ ID NO: 612964 - DNA, 176 bp, Homo sapiens
ggaacgcggctggaggccccaacggtgtaggcacgtacgctgtagtacacagtttcgcagacgcaataaaactcttcaccaaagaggcgctaggacgggacaaatctaccatcaccaacaaacctcctgtcactcatatgagctcatcctgaggccagtagcagcaccagggggat

SEQ ID NO: 612965 - DNA, 476 bp, Homo sapiens
ccttttccaatcatgataatcactgtaacaagcaaacagcagtcctgtaccagccttcatgaggttgctcccccaataccaactattaatctttcatgtaacctcctgggaacacagtttagcttttgcctctaagacttctaacaggaagagcaaaacattaaataaattaattccaagtctgtgctgtactctaggctgaaatttaaccccattctatttatttcctatttcagaatgggaaatattcaaatacagtgcaccagaatgagataaataatagtctaaggctcagcagcctagctatattctacatttaactggaaacttccctcgttttgaagctcccaggaactacaacccatatgttaaattctctctcttttgtatgttaaagtccaaagaaaacattcttctactgttttttgtttttgttgttgttgttattgtgacagagcgagactccgtctcagaaa

SEQ ID NO: 612966 - DNA, 443 bp, Homo sapiens
  misc_feature (381)..(381): n is a, c, g, or t
atagcctagcaagtaccatatattaaatattggatcttccaggttattggttatatggtaattccactcttttgctcacaatcttcactgaatctctagtagcaatcaatgaagtacaagttcaacctggtattctaaaccctgcccaacatggtcttaacctcctgccatgcttctttatttaccactctgtatgtatataaatatatatcatatattcttggccattaattgttccctgagattgcctcatcttttcctaactacttagcttcatccatgctatttctgccacgtggaatgccaccctgcttctgaccatcttctgcttcttgaaatcctaaactggcccttaaaaggaccactggaaaataatccccntcttttttaatggaattccttttccctggagggcctcccaaactttttggaaaccaggtaaa

SEQ ID NO: 612967 - DNA, 114 bp, Homo sapiens
acaccgtggtcaacagaataagaactcacaggctacatgtgctcccccatacatagagcaagcaggctacatcacagcccccgatacatgggcacacaaggtatacacatgcag

SEQ ID NO: 612968 - DNA, 163 bp, Homo sapiens
tgggcccgtcttggcgcacttctgatcaccaattgtgtgaaatcacacacacacacacacacacacacacacacactaactcaatgtacgtttctctattctttcactcgagcgaacaatcaacacggaatattttgtgtgggtccagaagtgcgcctgggtg

SEQ ID NO: 612969 - DNA, 214 bp, Homo sapiens
  misc_feature (145)..(145): n is a, c, g, or t
  misc_feature (177)..(177): n is a, c, g, or t
aattcgcggccgctcgacacggctgcgagacgacagaaggggaggaggggtaaggcagaagcaccagctgtactactagaagggagcttttggtggtagatcccctggtgtctccaacctgactaggttgacagagctcgaggcntcttaccgctagcgaggtgataggacactggnttgccacagaggtctgttcgaccagacatatcctgct

SEQ ID NO: 612970 - DNA, 87 bp, Homo sapiens
ccagaacatttattgcatgactaatcgttgacattcttaagattgcgacgctttccaaacgatgacgttcccttctgtcgtcttctc

SEQ ID NO: 612971 - DNA, 276 bp, Homo sapiens
cctctgactgttttctctttctgagagtacgttttccttccctggtcaggtctgggaggccgatgcgtcctcctgtcaggggctcaggccactacctcgtggtatagcagctcagttgaccttgggcccacatatccaggaatcaactctgaagccgacaccaggcagtcccaccctcagaagggaccaagcacagaggccgcctctgcagaccgactgcacagctggacccgagtagggctcctccctcgggaactccagattgctcctcaccct

SEQ ID NO: 612972 - DNA, 264 bp, Homo sapiens
ggtaatactcctcctcctgggttcacgccattctactgcctcagcctccagagtagctgggactacaggcacccgccaccacacccggctaatttttttgtatttttagtagagatggggtttcaccgtgtaggccaggatggtctcgatctcctgacctcgtgatctgcccatctcggcctcccaaagtactgaaattataggcgtgagccaccgcacctggcctatgagtggtcttttaattaggaacaaatctaatggaac

SEQ ID NO: 612973 - DNA, 811 bp, Homo sapiens
gaatgcagtagcgtgatctctgctcactgcctgcaacctctgcctccccagttcaagtgattctcttgctatcagcctcccgagtagctgggatcacaggcacgtgccaccatgccctgctaattttgtatttttaagtggagatggggtttcaccactgttgtgccattgcaggtcatcgaactccatgaccatcaatgtgatcctcccacctgaagccgtcgaaacaagagcatgggaaaacagtgctgtgagccactgatacccaagaatgggactatgatgtaagttatatgttccaagttgcatagattattacattgagttgccacatagggcaaagaagcacatagccgatgatccccaggacatcagtaaagccacacagctataccattatgcgtacctccttgaatcgcaagcaattgattatcgtgtagaggtatgtattgaacacctgggtacttctaatccaacaccactccacatcttgggtacacattggacaatgggagggcaatgtgtgagttacttggacggttcatgatcgcacgtacataacgggcactactttattcttctcaagttggtgtatcgctcaacaaaggcaaacagtgcttatgcaactataatgtaaacaaccatataatcgcagaaattcttctgcactaccgttggaacttctagtgtcacaccccagacaactacaagcagtaacaatgacgtttcacattacacgcgcatcatagcagtatacacatttgaacatacgaacacgtctaatgaacctcgcaatatgaggtaaacaaac

SEQ ID NO: 612974 - DNA, 177 bp, Homo sapiens
ctgaggatcccgctcacgcccactagactcacggaaagttccaggccccggaagctgcgaacctgtgcagaggagagtcgcggtcctggcgtagggctggggaagcgccaccgtctgtgactagacgctacgccagagatggcaggctgtgctgatgtctctgcggtggcgacttgc

SEQ ID NO: 612975 - DNA, 89 bp, Homo sapiens
cctctttagcggagaccagacgagaggcgatgaaatagagtagaattgagaaaagcagtttctcagacctccctgtgaagtttttctta

SEQ ID NO: 612976 - DNA, 1138 bp, Homo sapiens
  misc_feature (897)..(897): n is a, c, g, or t
tcagctctggttcggagaagcagcgagctggtcgtgggtcagtccgtggtgtaatggtgcgccctcgatgaaacatagttgttgcggggcaaaaagggtcttgccgggcctcgcatcgtgcagggtgcgtatctgggcgcctgagacgcggcgtggtgagccttgggagccggcgcagcagggggcacacccggaaccgggcgctgagctgcccagggaccagtgaacgggggaggccatcttgcaagcgccctttgcccacacattcccttactcaaaactcgccgaccttgcggctaacctgagcctgcgagcgcctcttggcaactgtgtcgtccggcaccgccacgcaagacttggcgcgtccaggtggccggtgaagcaacctgcgacattccagcactccggttgcttcgacaggtgaaacggacacaggatgtcttaagaggaagctgaaatttacgcaaaagctagatataaggtaacatgcgttccaagtttgggaatttgcagatgagcctgaattctggggaatagtacgggattacattgccaaagatgggatcatgacactgaagtcctagataggaaaaagtggaatatctgatgtttgctggggcatttgagatttcgcattcgtggatgaaattggcccttgggtgtaaatttacctggaaatgatgatgcgtgcttacttcatcatgacttgacgactcagaagtatcttattgggccagggaatttcatggttaagatgcagaatttgggaaatcaacgtggtgcaatgatgtactttaaagtcaggaagtagaaatttgtacaacaaggcaggacaatattattgcaactgaaagtatgaacgtgaaagagttaggggccagttataaaggacgcacnatattgcgtatgcgggggatacacaggcgggggtatctgtgacaaagcgttggagacgttagcagcacttgtggaaacgttgattggtcacgggcatgactgtaacaggtagaaggttatggtagcatgcgcggaatagtattatcagcgggggacacagcagaggccttaagcaagctagagcggccgccaaactatacgttgtgagttagagtgtccatgacagagcatctaggaccag

SEQ ID NO: 612977 - DNA, 133 bp, Homo sapiens
cctcacaacctgtgaaagaaaggcagaagcaggaagcagcagaagcaggaggcagaagcaggaagcagcaggcaggttatgtacaaggaggtttttctcttcactggggagaccctggggcagaagcaggaag

SEQ ID NO: 612978 - DNA, 455 bp, Homo sapiens
aggaacatgagaaacagatagaatgaatgatctagaaaaaattttcttttggagatggagcgttgctcggtcacccagactggagtgcagtggtgcaacctcagctcactgcaacctctgcctctggggttcaagcctcatgagtagctgggattacaggtgcacaccaccacacctggctaattttggcatttttagtagagacagggtcttgccatgtcggctcgaactcctgacctcaagtgatcctcctgcctcggcctcccaaagtgctggaattataagcatgagcccctgtgcctgccctaaattacattttcttggctttggttttttttttttttttttatttggaaaaggattcccgctctatggccagggggggagggcgagggcaaaacccgggctcagggcaccctgggcctccagggttcaagcattctgggggccaaagc

SEQ ID NO: 612979 - DNA, 157 bp, Homo sapiens
  misc_feature (150)..(150): n is a, c, g, or t
gtcactgctgagagagactcttgtgcaggtcgggggggcctgctgcgcttcagggctgctcctgggagaggtcatctcttctgggctgaagagcatcttcaccaggtcatctgcctagcaccctgcctgcaatgacaaacccctgcccanttgagag

SEQ ID NO: 612980 - DNA, 962 bp, Homo sapiens
  misc_feature (361)..(361): n is a, c, g, or t
taaatcttccgtgccttattcacacgcagccattaagcccacaaagacattgacttaccaacgctgtggcccctttgcacccattactgtggccttcagcaccttaaaatgtggacaactttgtgtaccttaagtgaccgccccacctgtggccattattatcgtggttgtggcctctctttcctctgtgttcaccagggggtctctatagtctcggttgacccacatgtggctgttgtgttacaggtcggtgcgtggcggttgtgttccccattgtggcgggacattggagggagcactgtgtgtccactgtgtgaatcgtgggttttgtcgcacagattgagtgtgtgagggatctccnattatacacaccgttgggtgtggtattaccgaaagagaggtcgtagagatatgcgatatatctcctctaaatctcaccggaagagacacctcctgttcttgtggggaaacaacacaaagactcttttctttatatttcttcccaaatctttcgtgtgcaaagagagagtctttgtgccaccagaggggaaagaaacaagggcgcgagtataaactattcccgtgtgggttgtgcaaccacatcttccaacgagtgtggtttgtctgctgggaaaaaacccaaaatgccaacaaggtatgttgccctcgtgtgtgtgggggggaaccccccattctcaaggactcttgtgtgtgggtttttgtgcgtagaatacaggcacacatattatattataccagcacaaagagaatttccccccccatcacggagttatacaaattatcaataaacgaaggcttagtgtggggggacacacacagtgggaggaggggagcatccgtgaggattcttagtataaccccccaagggggcacaggaaagtagcatatatgggggtagagaaacacccaggggcatctaacgtatggaaagacttccacaa

SEQ ID NO: 612981 - DNA, 431 bp, Homo sapiens
gctaggctctgagggaagatcctggctgccttcctggctggccgcgccccctcactaggctctaacccaagatcctcgctgcctctccagctttcctggtgcacgcagtgcttggcttgcggctggttcactccgatctctgcctccctctgacgaggccctctgcgattccagtggaccccccaggacagtcagctcccatcttcaggcccttcgctgagcccacctgcagggtccgtggaagggacattcacacgtccgccgactgcaacatgggtatctgtaggaggccattatttagtctacaatagggccactaactactctctagtttacattcaaaatttttcttacttacatgttttttttttctgtgactgctgcatggggacatgaaagtaatgaataaataaaaagctcattcctccaaa

SEQ ID NO: 612982 - DNA, 170 bp, Homo sapiens
cgtctctgaggatcccccttattagcgaggctggaggtactttgaaagtcaagtagaccataaaccctaacaggtacagtgaggatggcaacaggggatggaatgccatatgcagtaaactttttttaaaaagcagaaacgaggaaggcctctcgtgcccacagaatcct

SEQ ID NO: 612983 - DNA, 809 bp, Homo sapiens
gccgtgtgtgcgcccggtccccgcctgccggaccatggagagctaccacaagcctgaccagcagaagctgcaggccttgacaggacacaggtcgaaccgcctacgtactcacgctccatccaaggccaacacatgcggctgggcatctggccaccaccacgatcatgcttgcagcgccgcacgcgatcatcggctgtccatctttttccaacaccatgcgctacaagtcccagagaccccggaatccgcacaatgaccgcatttgtgcatctccaagggccatgcagctcccatcctctacgcggtctgggctgaagcgtgagtttcctggccgcagtgcggacgcttgcttgaatccttgcaggcacagattcaggttcctgacattggaaccgtggcacccagtgtcccgaaaacaagcgtttcaccagacgttgggcactgggtcccttgggccagggcctcggggccgcattgtggcgatggcctacaccggcaaatacttcgacaaggacagctaccgagtctattgcttgctgagacacaggacagctgtcagagggctcttgtactgcggaggccattgtgccttcgaccagcatctatcacgctggaccaaccttgttgcccatacctacgacacattcaatccgcccctttgtgagccccacagaacaggtgggaacccccggggtccacccacaccttgacatggacactcgagtaatgggacacttctaaccacgaacagcggttgcgcaagggcccttcgggtttggctatgccatacatccgtgcgatggacacat

SEQ ID NO: 612984 - DNA, 1010 bp, Homo sapiens
ggcgagccaggattcccggatccaggagacgatggccccggtatggggatggagcccgaaggtgtcgtcagaggagtaacctgggaatcgagagtgtcgacatgcttcgatgacatgaaccttctcggcagtctccttctccgtggtcatctatcgccttatgggtttcgagaagcggctctgcctatcctagtcagacgaggcgcgattcgtacgcttggtaatcaaggggcttatgatggtgactagtttcaagctccaatctggtgacttgggaaaacgggccagattatgccatatcgatttctgccagcatgatttgaaatgagaatcttaacaagccagctccaggccgttgtgtgcctagcgaccgcactcgagagactctggctcgagtccagactacacgacaggtggtcatggctacttaaggaagactactagtgggccgcctccatgttgagcagaccttgatatccgtgggggcaccaaaccggctgacggtggctggagagtgcctgagaacctagcagcatgggaacgctacaccccaacatcatacgagagagtaacgcacctggacacgaagtggttccagactgattgcttcacagccggagataaggctgggcccccgaaattagatgccaagaatcgctgtgtcactaggaatgaccggctgaggaaaatgctcacaaggcagagggaatcccagagggaaccacaggatccgtaatggacactaatatcccgcaaaaagagacaccaaacggcaggaaacggaaccgcacgggataagacacagggcgtggttcaaggagcaacgaaatggcccttcgatgactgtaacctcatggaggtagacacaaaggaacaaggtacaattgaagggggaaaccacccatgccgggaatgctctgtcccaacgaaagggacagacgttcgaaccctgggaaggggaatccggcccagttcatacaatgcaaagtggaacgcgagcgacgcagtcc

SEQ ID NO: 612985 - DNA, 361 bp, Homo sapiens
atccttccctctctgacgccagagattccttggcctctggggtcgtggaagaatgtgcccaggggtattactctttatctccctcttgctaatttataaagcctttacttccataagtactcgcctgattaacaccacttgcattaaaatcttactgtgactttccttagctttcccagcacaacttttttgtgctttattcatgtgcaccattattaatttgtactcgtgtgaatttgtcacagatgatgaggcgctaccctctaatctccctactgtggtgatagatttctttctttgaaaaacagagactttcctgctcaggtgctcattagcccctatcgcctatgggataaaatct

SEQ ID NO: 612986 - DNA, 657 bp, Homo sapiens
  misc_feature (6)..(7): n is a, c, g, or t
  misc_feature (437)..(437): n is a, c, g, or t
  misc_feature (628)..(628): n is a, c, g, or t
aggcgnnaaactgtttattgctcacattattcatactttattaatttattgtttaattgacaagtagtaattgtgaacatctatggggtacagtgtcatgtatcgttctatgcatacatggtataaagattaaatcaagtaatgttttgatctatgcatacattgtagaaagattaaatcaagctaattaacatatctatcacctaaccaacttacctttagtgtgagcgtgatgagaacattaaaaatcctttattaaagcagttttgaaatatgtaacacatgatgattaactctggtcactgtgcagtgcgataggtcactaaaacgtattactaccgcctgagactttgtggcctttgaccaacaccttgtacctgtccccacagcccctgatataaccaccttattactctgtaactatgagatccactatnttagatactatatataagtgagatgatgaatatggatattctgcctaattcagtagaccatatgaggcttgtgacagaaactgcaattaaaactaaaatcgatgaggagacctaggtgcttatgaacatcggtatagaaaaggaccgaatgctgagtaaattcaggaccccaattattaagtgccacattnggagaagtggacagaagtttgctctagta

SEQ ID NO: 612987 - DNA, 107 bp, Homo sapiens
ttggcaggtggtcatccccccgtacggccgtgaacaatccactgctgtgaactttggcgctctagaaattttgaccgcaagtaactgaataaatgtggtgttctcta

SEQ ID NO: 612988 - DNA, 335 bp, Homo sapiens
gatccccggcggcagatggggaaggcagagtccagtcagagaacacagagtgtgaagacggccagtgtcaagttctctcagagagacagtagttagaggctgaatagaaaacattgcataataggcaggctaagaagcagcagtagatcagcatgcttcagagacagctggaagagtcttgctcatgaagcagtcagttggttgatatcaccgagaagtcaagaagaggagaaccaaaaagtatcctttggatttggcaatatagcgtcctgcttaatctgtggagtacattcccagcctcccagtggatgcgtgaaaccatggataggactgaa

SEQ ID NO: 612989 - DNA, 217 bp, Homo sapiens
tgaggattgcgcgagattatggggctctttggatgaagagttttagggcgtcagtgaagggttgtagtagacccggtaggggcctacaaggtgggggccttgcgtaggttgtatatagcctagaatttttcgttcggtaagcattaggaatgccattgcgattagaatgggtacaatgaggagtaggaggtggggcatgggtcgcggttaaggtcgc

SEQ ID NO: 612990 - DNA, 644 bp, Homo sapiens
gaggcagctgtaccctttggccagtgtataacgacggtcagctgataccccagactcgaccgatgataaatagtacaagctaaatcgctgggcgtagtggcaggttgcctgtaatcccagctactcaggaggctgagacaggagaatcacttaacccaggaggtggaggttgcagtgagccaagatcgccccatagcactccagcctgggcgacaagagcaagactccatctcaagaaaaaactcaaacaccaaatacaaacgaaaaaggactggagtatccatttgattgggcagttagtacccttttggagaccaattccagtggattggtagaggtgaaatctggctaatagaactacgtaatatggagaggtcaggcggtaagtcaaggatgggaatacttcaggcatattaattgaaagagtgaccggattaagtaaaagctggagctcagtagagaatgataataaccaaaaagcgggttctgaagagaaaggagtgtgaacatgagcacgggtggatgtggttaagttacatggtctacttctgcagacgtttgctgagcacttcccgtggtgccagccactctactaggtagaggggtcaagcctactagggaaagccaattgagtgagaaagtgg

SEQ ID NO: 612991 - DNA, 114 bp, Homo sapiens
aagacatgatcgaatcgagctcggtaccgcagcgacatctcagtgtgaaatatgtttacagtttggagaacaatagacaatgatcaagcaactgaagagctgagctggtcttca

SEQ ID NO: 612992 - DNA, 185 bp, Homo sapiens
tcccccccccggggggggaagagacccgcctctgtgtttttcccttttttcccacagcacccccggggggggggggggcccccccctgggggggggggggggggggggggggggggccggggggggtttaatttttgggggggttttttttttttttttttaaaaaaaattggttttttttttta

SEQ ID NO: 612993 - DNA, 722 bp, Homo sapiens
  misc_feature (198)..(198): n is a, c, g, or t
  misc_feature (482)..(482): n is a, c, g, or t
  misc_feature (486)..(486): n is a, c, g, or t
  misc_feature (498)..(498): n is a, c, g, or t
  misc_feature (501)..(501): n is a, c, g, or t
cggcggtgaactgcttcctgcaggctggccatggcgcttcacgttcccaaggctccgggctttgcccagatgctcaaggagggagcgaaacacttttcaggcattagaagaggctgtgtatagaaacatacaagcttgcaaggagcttgcccaaaccactcgtacagcatatggaccaaatggcaatgaacaaaagtnggttatcaaccacttggagaagttggtttgtgacaaacgatgcagcaacgtattttaagagaactagaagtacagcatcctgctgcaaaaatgattgtaatggcttctcatatgcaagagcaagaagttggagatggcacaaactttgttctggtatttgctggagctctcctggaattagctgaaagaactttctgaggattggcctgtcagtttcagaggtcatagaaggttatgaaatagcctgcagaaaaagctcatgagattcttcctaattgtggtantgtngttctgcaaaanaanccttccgagatattgcatgaagtctcatctctacttcgtacctccataatgagtaaacaatatggtaatgaagtatgtctggccaagcttatgtgctcaggcatgcgtatctatttatcctgattccggccatttcaatgttgataagcatcagagtttgtaaaattctgggctctggtatcagttcctcttcagtattgcatggcatggggttgacgaag

SEQ ID NO: 612994 - DNA, 783 bp, Homo sapiens
  misc_feature (649)..(649): n is a, c, g, or t
  misc_feature (652)..(653): n is a, c, g, or t
  misc_feature (663)..(663): n is a, c, g, or t
  misc_feature (676)..(676): n is a, c, g, or t
  misc_feature (681)..(681): n is a, c, g, or t
ggtcaccgctactgggcgggggtctggggagcgcagtagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccgtcaagntcnnggtgacgctnaagcccctcggtntctgnaaggcctgggcaagccgaggccttttctgggatccagacaagggcgggcagaaaaaataacgcaggctgtcggtccctcgagaaatggggcccttttcccaa

SEQ ID NO: 612995 - DNA, 752 bp, Homo sapiens
  misc_feature (228)..(228): n is a, c, g, or t
  misc_feature (512)..(512): n is a, c, g, or t
  misc_feature (516)..(516): n is a, c, g, or t
  misc_feature (528)..(528): n is a, c, g, or t
  misc_feature (531)..(531): n is a, c, g, or t
cggcggtgaactgcttcctgcaggctggccatggcgcttcacgttcccaaggctccgggctttgcccagatgctcaaggagggagcgaaagtaagtggctgcacaggcaacaggaatgagcacttttcaggcattagaagaggctgtgtatagaaacatacaagcttgcaaggagcttgcccaaaccactcgtacagcatatggaccaaatggcaatgaacaaaagtnggttatcaaccacttggagaagttggtttgtgacaaacgatgcagcaacgtattttaagagaactagaagtacagcatcctgctgcaaaaatgattgtaatggcttctcatatgcaagagcaagaagttggagatggcacaaactttgttctggtatttgctggagctctcctggaattagctgaaagaactttctgaggattggcctgtcagtttcagaggtcatagaaggttatgaaatagcctgcagaaaaagctcatgagattcttcctaattgtggtantgtngttctgcaaaanaanccttccgagatattgcatgaagtctcatctctacttcgtacctccataatgagtaaacaatatggtaatgaagtatgtctggccaagcttatgtgctcaggcatgcgtatctatttatcctgattccggccatttcaatgttgataagcatcagagtttgtaaaattctgggctctggtatcagttcctcttcagtattgcatggcatggggttgacgaag

SEQ ID NO: 612996 - DNA, 764 bp, Homo sapiens
ggcagagctgactctgggaggcgttagggcccagagtacctggatccgccgcttgctccgcatggagtccgaatcggaaagcggtgctgctgctgacaccccgcccactgagagtaccctaagttcttccatggtgatgaagagattatcgaggtggtagaacgttgaatcccgggttccagcacgtcacccaggatgaccatggcaccactgagatggactgatgtggacgttttgcaggaacaagaggagcgaatgagggcgtgcgaagagtggcgtgtgcttcttaaaagccctatgaaagggtctggtcgcgcagcaatggaccggacccagactgaataacgagcggtcaccagttgctgtagccatcagccattctgtttgatttagtggtcgaacgcgcgttaggattccccaaagtattcaaatatcgctttggcaattgcgaaccagggagttatagaaacgatttacacgaaagacgcattgctgtaataaggcgggatcaaggcaagtggggagctgcatcctttgcattgttgcaggctcataagtgaatctgtgacttgtagctcggttgtcaccctaatgacatccatctcgtgagtagtccagcgagggtgaccatgagtggccccttggaaattgctgctagggtcgtacaataacaggctgagcgtcttctcccttaggaaccgggaaccactggcctcggttcaatcgcatagtccgcgcgacctggtctgtctgggatggactgg

SEQ ID NO: 612997 - DNA, 1433 bp, Homo sapiens
  misc_feature (864)..(864): n is a, c, g, or t
ggtcaccgctactgggcgggggtctggggagcgcagtagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcgggtctcctgacaggccctgggccaagcccgaggacccttctcttcctggaggatcccaggatcaaggcgatcgcagccaagcacaaataaaactacaggccaggtcctgatccggttcccatgcagaggaacttggtggtgatccccaagtctgtgacaccagaacgcattggtgagaacttnaaggtctttgactttgaactgagcagccaggatatgaccaccttactcaggtacaacaggaactggagggtctgtgccttgttgagctgtacctcccacaaggattaccccttccatgaagagttttgaagctgtggttgcctgctcgtcccaagtggactatactaaccatgttgttatcatatgccctcaatttattattcccttgcaacatgtagtcatggccatgtgtcacatcagacagtgggacagcaaccatgtagcagtggccatgcgagggcagtgtctacgcttgatgtctggatctcaatgagccctgtcagatagcagtagcaagtcatcattcccagttgtgcttttgcccctatctattcttaccccttgactggggagcaacaagttaacaaaaaccattggaaacaatttacacccaccattatatgatctgcaccacaagcagcaacgcgacaaatcataaccacgggtcaaaaactagatgccaacttaacaggttgagatttatgacctgcttggacactggaaatcctttacaggcaaagaatttcgtc

SEQ ID NO: 612998 - DNA, 866 bp, Homo sapiens
ggtcaccgctactgggcgggggtctggggagcgcagtagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcgggtctcctgacaggccctgggccaagcccgaggacccttctcttcctggaggatcccaggatcaaggcgatcgcagccaagcacaattccccaaggctgtgacaccagaacgcattgctgagaacctttaagtctttgacctttgactgagcaggcaggatatgaccaccttactcagcttcaac

SEQ ID NO: 612999 - DNA, 1424 bp, Homo sapiens
  misc_feature (855)..(855): n is a, c, g, or t
ggttgtgagatagcagctcggtcagtgaagattgtgctgatcatactgatctgcagcggtcgcctagatgtgcatacttgagggtgcgtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcgggtctcctgacaggccctgggccaagcccgaggacccttctcttcctggaggatcccaggatcaaggcgatcgcagccaagcacaaataaaactacaggccaggtcctgatccggttcccatgcagaggaacttggtggtgatccccaagtctgtgacaccagaacgcattggtgagaacttnaaggtctttgactttgaactgagcagccaggatatgaccaccttactcaggtacaacaggaactggagggtctgtgccttgttgagctgtacctcccacaaggattaccccttccatgaagagttttgaagctgtggttgcctgctcgtcccaagtggactatactaaccatgttgttatcatatgccctcaatttattattcccttgcaacatgtagtcatggccatgtgtcacatcagacagtgggacagcaaccatgtagcagtggccatgcgagggcagtgtctacgcttgatgtctggatctcaatgagccctgtcagatagcagtagcaagtcatcattcccagttgtgcttttgcccctatctattcttaccccttgactggggagcaacaagttaacaaaaaccattggaaacaatttacacccaccattatatgatctgcaccacaagcagcaacgcgacaaatcataaccacgggtcaaaaactagatgccaacttaacaggttgagatttatgacctgcttggacactggaaatcctttacaggcaaagaatttcgtc

SEQ ID NO: 613000 - DNA, 1412 bp, Homo sapiens
  misc_feature (843)..(843): n is a, c, g, or t
ggtcaccgctactgggcgggggtctggggagcgcagtagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagaatgaggtgggggtggccattcaggagaagctcagggagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcgggtctcctgacaggccctgggccaagcccgaggacccttctcttcctggaggatcccaggatcaaggcgatcgcagccaagcacaaataaaactacaggccaggtcctgatccggttcccatgcagaggaacttggtggtgatccccaagtctgtgacaccagaacgcattggtgagaacttnaaggtctttgactttgaactgagcagccaggatatgaccaccttactcaggtacaacaggaactggagggtctgtgccttgttgagctgtacctcccacaaggattaccccttccatgaagagttttgaagctgtggttgcctgctcgtcccaagtggactatactaaccatgttgttatcatatgccctcaatttattattcccttgcaacatgtagtcatggccatgtgtcacatcagacagtgggacagcaaccatgtagcagtggccatgcgagggcagtgtctacgcttgatgtctggatctcaatgagccctgtcagatagcagtagcaagtcatcattcccagttgtgcttttgcccctatctattcttaccccttgactggggagcaacaagttaacaaaaaccattggaaacaatttacacccaccattatatgatctgcaccacaagcagcaacgcgacaaatcataaccacgggtcaaaaactagatgccaacttaacaggttgagatttatgacctgcttggacactggaaatcctttacaggcaaagaatttcgtc

SEQ ID NO: 613001 - DNA, 471 bp, Homo sapiens
cagaatggcttttgttgcatgggttgaagaggttgtggcatgactggtgtgactgctgctgactggctcctgggagcttggagtgcaggagctgctccctgtgatgcccactgctccccagtaagctgtgcagtgcatgtccagtcaggtcccccagcccacccagtcctccgatgtctggctggtccgatgatgctgcatgagctggcttgtggctcatgtttcccagcaggctctgcagtgccaccctcaccgcctagcgcagagagttcgtggccgctgcttccgctggaccccagtgccccagtgcatcggggggtttgttcagatactcgttgacatttcctggaaattgctcctcatcctggtctgtcttgggttcctgcatccagaagaaaagccgattggaccctgccttgaacttcagcacgtagaccctcccgctggggcactgcggaacccgcttgaact

SEQ ID NO: 613002 - DNA, 481 bp, Homo sapiens
ccgggccgcgtgcctctcccagtcatcaagtgttatgaagtctgtactctaccccactgctggccatccctacctgtcatgggttttcggtgttcgccatgactaattacaggttcttggttgttacccattcctggggaggagccttcagtcggccctggatgtcagcccatagcatgtgctgtcatagaggtctgtgctgcaggtagcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggc

SEQ ID NO: 613003 - DNA, 751 bp, Homo sapiens
  misc_feature (520)..(520): n is a, c, g, or t
ggtcaccgctactgggcgggggtctggggagcgcagtagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccatgtgtaccagaatgagaatgaggtgggggtggccattcaagagaagctcagggagcaggtggtgaagcgtgagaacttnaaggtctttgactttgaactgagcagccaggatatgaccaccttactcaggtacaacaggaactggagggtctgtgccttgttgagctgtacctcccacaaggattaccccttccatgaagagttttgaagctgtggttgcctgctcgtcccaagtggactatacctgtgtttcttggctcatttttttccttgcaaatgtagggtacgcgggcgccgtaatcagcgtgcg

SEQ ID NO: 613004 - DNA, 994 bp, Homo sapiens
tgggctatccgtcgagccaccgcgtcgatcctgttgctgtttgacagtagtgcaggatccctgggaaggctgccccaagacactgccccaagtgggtggatatctgccttcctgctgcaagtggaggcaggtccagcagccctcttcagagcccctgtaaatgctatcgcagctgagtcctgacgcctaccagttccattggtgtccgtgcaccccttctgtctgtaccctttcatggctgtgcagccgtacacgcatggagctgggcactgtcccatgtgcaatagaggtgcatccccgcatggatgactaagcgtcgcaaggcaagacggctaccccaccgcaatctgcaaacagggcctctccctatgaggttctataacatatgtgaactcattcccgctcatgaagaacgcaccagaactgcccagacaaagcccgacactatacccacaaagaagaggggctgtcatgagatctccagacaaggcgaccactccgacggagcggcggcgggcggcccacagaaagagggagcaagcggacagagactcataccggaccaccgcaacccacacacaacaccaccccataagaccacgacgccaacgcactgaaagtacacccaaatcagccaaacggcaatacacaacaagccgcacctcacagatcactcacggatgcacaccacagacacacgcagcaacatcgaaacccaaaaagacgacgacggaagcgaaaggagaaacgcccaaagcaaaaccacacacaacaacacagcgcagaagcaaacggaagggcccacagacacaaggagacggcgcaggtgaagagaagaaaagaacacggcagaaggagcaggcaaacaggaaagacaacgacagaagagccagaagactacgacaaaaccgagagcgcacagagagagcaagcgccaacggcggccggaggagacgataaacacgggaacaaagcagaaagcccgacggcacgg

SEQ ID NO: 613005 - DNA, 759 bp, Homo sapiens
ggtcaccgctactgggcgggggtctggggagcgcagtagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggttgcaacggtacccattggaagaacggggcctcgtggtgaaccgggaggccttgcccagaaagacaactccagcgaaccctttgaaaggcttggcaccttaacccttgggaacccctctttacgcttaatttccacttgggcccgaacttggtttttaaaaggccccttgtggcaaggggaactttttaccccgcattcggcactcgacgttcgggggccaacatggttgggtttcccccaaggttggaacaagcgccaaagccgaatttccttgcacacaccgatttggcgccgggccccattgcgaaacaggaaagcttggcgtggagcattcgcaccagggggccctggcttggaacagggcctatttggggccattctcccaaggtttccaaatcgccattccttcccaggattgcgccagcattcgcactccttcgacaagcaaaagcccttgggcttttggaaagggtatta

SEQ ID NO: 613006 - DNA, 230 bp, Homo sapiens
atttttgtattttttgtagagacagggttttgccatcatgcccaggctggtcttgaactcctgggctcaagcactgctcctgcctttgcctcccaaaggtttgggattacaggcatgagtcactacactggcctatttctcacttttgtgtgtccacttcctaccttggaatacctactccatctctcttattaaaatcgtccatcctaataatcctccctagtctttgg

SEQ ID NO: 613007 - DNA, 292 bp, Homo sapiens
aggccctcccagcaaccaggataccccccctttgggggctttgtgtacagaggtccgggttttagacctcataggctgcagaaatttggggcagcccccctcaaaaagcccctttcaggggccagaactcctttgccagggtggatttttcaagtcggggctgcataattaaagccgttgcagttttattttttttacagcttttttcccaaaaatgatttggagttgggtgggcagcccttcgccctgatatgtgtgctttaccataaaaacccaatttaatatattttta

SEQ ID NO: 613008 - DNA, 466 bp, Homo sapiens
acattttatagttctgtaattttaaaacaattagaaaataagggagttccttgactgcaattattgctttcataaagaaaacccagactttgagtttagcagtctaattggctgtgttgtgcaaccttggaatgaatcagaaagtctaaagacaatgaacacaatttctgttaattcactagtataatgaattcccttcctgtaggctccttgaagacagagaaggaaacttatttctctctacttcccactgcctagcagggtacccagcactcactaggtggccaataaatgttgactaaatgtcttgattcatgtattcgttaaaaaaacaatgccactgatacttgcctatttgacccttattaattcctttcaccaaccataagaagttaatatacctttgaactgcaactaaaatgaagcaaaatctaaaattaatagacaaagatagagtaagaccaaa

SEQ ID NO: 613009 - DNA, 204 bp, Homo sapiens
tttgacgcgtgctcttcctaaagcccttcacgcagtccaaaaagctgagatggttccttagagccttgagcctggccactctcccacctgctagcatctgaataaaagttgctttcctttcaccacacctcgcttctcctgcggcaagcagccaaacctgagtcagttacaagacatctcaacctcccctgatcccacagcttc

SEQ ID NO: 613010 - DNA, 430 bp, Homo sapiens
gcatggggagctgacggtggaggtcgcggctctaacggggctttctacaagggattcatccaagatgttcatgaagactcccttacagtgtttgaaaatcatggaaccagaacgccaggttccatttaatgaagttagattaccaccacacctgatcataaaaaaagaaattagtgaaggcgatgacgtagaggtatattcaagagacaaatgaccaagagaccagtggcgtcgcggcggcaaacacgtcgctcgagaaaggcgaatagaccgtggcaggaatatgcacgcggaagaagggagtgaccatgacaactcagcaacactccgacaccgaacatcccgaggacagtgctaaaccaaaaaacaaacacaggcccacaaaccaaccccccgaccacacagcccacacgagatagcacacgaacga

SEQ ID NO: 613011 - DNA, 1662 bp, Homo sapiens
  misc_feature (470)..(470): n is a, c, g, or t
  misc_feature (1082)..(1082): n is a, c, g, or t
  misc_feature (1498)..(1498): n is a, c, g, or t
  misc_feature (1511)..(1511): n is a, c, g, or t
  misc_feature (1513)..(1513): n is a, c, g, or t
  misc_feature (1535)..(1535): n is a, c, g, or t
  misc_feature (1618)..(1618): n is a, c, g, or t
  misc_feature (1644)..(1644): n is a, c, g, or t
ggcacgaggcacccaatgcctcactgatctgccccaatgagcaagaggacaggctaccctgaactcctaaagccactgaggccagttgctagatataatcgatggtgagcaggatggtatccagaaatgtccctagaagcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcttaaagggtagccagttagggttccngagaggagaaggaggaagaagaggaggaggagaaagaagcagcaacgatcattctgccattgtaaagagtgactctttccttagggatggtggtcttctccccttgccaggctttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggttngtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggaggtaagatgcccttttcgttagcgcttttgtttctcagcctggggatcagtggatttgggttcctataacctgttgctaccttttaaaaagatcccctctctccaaagagaaaagtaatacataatcattaaagaaagtttggaaaatagagaaaactatgaggacaaaaaccccccagccattcagagtcccaccacacagaggcaagcactattaacactttgctgctntcctttctagtgngntcttgctatgtcttgcgctganatcaccctgcagttcttgatcagcaggattttggcttgccaccttgtgcaggcatcatactgaataattcatttaagcatctnctaatttggtggacctttcttggctnggttttccccatcccacc

SEQ ID NO: 613012 - DNA, 552 bp, Homo sapiens
acgttgacacttcaggatattgttgttttaaaaacaaaaattggccaggcacggtaataccagcactttaggaggtgaaggtgggcagatcacctgaggtcaggagttccagaccagcctggcctcaagtgatccacccaccttggcctcccaaagtgctgggattacaggcatgagccaccgcgcccagcctgaaaatacttttgtaaatgtaagacacactgtactactgttacttataaagggcagtcagtaaatgctttagttgaatgatgaggcggcacaaaaatttcagtatttacattcttatgatgcttcaggcttttcaaagtgctttcatgtagctgatcccttttgcataacaagccactctaaatccattttggaacaggcaagacaaataaatattggaaagctgagtaaacaggctcagagatgtttaacaccttgctctgggcaaaaagtgaattaaacctagccaagactggcatctaagtggtctgtctgctagccaatgtttcttcaggtttattttttggtgttgttctttgg

SEQ ID NO: 613013 - DNA, 1897 bp, Homo sapiens
  misc_feature (470)..(470): n is a, c, g, or t
  misc_feature (1082)..(1082): n is a, c, g, or t
ggcacgaggcacccaatgcctcactgatctgccccaatgagcaagaggacaggctaccctgaactcctaaagccactgaggccagttgctagatataatcgatggtgagcaggatggtatccagaaatgtccctagaagcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcttaaagggtagccagttagggttccngagaggagaaggaggaagaagaggaggaggagaaagaagcagcaacgatcattctgccattgtaaagagtgactctttccttagggatggtggtcttctccccttgccaggctttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggttngtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggagctgattttatctgatttcctcaagagtgcattccagaaggggacctgctattcttcgaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtggggggaggggatgcatgcaggggtatgaaggcagcccaaggtctcccagaggctcgggaggaaacccttttggaatacatgtgttattgttgcattactgtgttgtgaagataagaagctgctctgtatgctaaagctttctctcctcaataaaaatataaagggtgtgtaaaaaaaaaaa

SEQ ID NO: 613014 - DNA, 114 bp, Homo sapiens
tcggatagtcgagctgtatggctgaaatcctccaaggtggtctgatatctccatcaatttcaggtcttggcgggtttgcttcaaatttccccggttcactacccacgccgctcg

SEQ ID NO: 613015 - DNA, 1890 bp, Homo sapiens
  misc_feature (470)..(470): n is a, c, g, or t
  misc_feature (1082)..(1082): n is a, c, g, or t
  misc_feature (1717)..(1717): n is a, c, g, or t
ggcacgaggcacccaatgcctcactgatctgccccaatgagcaagaggacaggctaccctgaactcctaaagccactgaggccagttgctagatataatcgatggtgagcaggatggtatccagaaatgtccctagaagcctacactcatttcatgccacacctccagcagagggcctggaagaggacccgacatctagcccagtgagagtgtgcaaagccacatgtcaaatggacaacttgacggagatttgcccttgactgactgtgcaggctggttccacttacagcacttgagtttacctttgcacagattcctgtatcagggctcttggactgacttgccacacatctggagccctttcctctcaccacattgccctcctgggcacccccggtggacagcgcccaacattgcaggctccacaactttccttgatgttgcttaaagggtagccagttagggttccngagaggagaaggaggaagaagaggaggaggagaaagaagcagcaacgatcattctgccattgtaaagagtgactctttccttagggatggtggtcttctccccttgccaggctttggactgcagcccccagtcaaaggtctttgcaggacactttctatccttggagttgcagaggaggcctgattggccattccttctgggacagacagagagagggcccatggcctgctctgagctcccttcaatttcaaggaacccttagttctgagaggagagaggaaggctgcacctaccgtggcctcacagctgggacccctcatgggggccaacccctggcctgctgctgtgcttcagtgacacagtaaagcttaagagggtggctgcctcctaggaactcctgggacttctaggtacaaactcaggtgcccttataaagagacccactgcttgccttgagtccagaaagcactgcttctgcagtgaaaaacacacacttactatgtcagttttggccataaaatgccagccaaatccactgctggcctgaactgcccctggacactggactttctgcacagtgactggcagcagagcaagtgcagccagggttngtggccaaagggaagaaagcatagtaaattcaacctctgttcctcatgggagtctgaccgataatctcaggcggaccttaggatcttgggcctggaggcaagagaaaaaagctggaggaagaggagtcgcagagaaacccagtcctctgactggtttctggtgaggtctctattcatcagtgggagctgattttatctgatttcctcaagagtgcattccagaaggggacctgctattcttcgaggggacctgctattcttcgaggggacctgctattcttcgaggcagtggaccctgtttgctgatggtcaacactctggccctgctgccccatgtccctgtggagaagtgtgaaggacgggtgccttaaacccacacttccagggacccttcagcacaggtcctgcctgttcccatggtgcttctcaccctgaaccctcagagctacagccagggatagagcagatgagcagtgagctggtttccaccctctggggcaggaggggcttgggcttccctttgaccctcttccttcctttcccagatcttcaatatttgttgtgatgtaacagccataagagctgtaagaggaactgtgggctttgggagctttcttgggttgaaagaggggtgntttgtttcattttatttaagattcaacttaccacccatttttataatctctacacataccttactctttacattctaaaaataatctttactcttaaaacatcttgctccctataacctccttaaaagcctctgttctataaacgccttccttattttcatccctcctctgtc

SEQ ID NO: 613016 - DNA, 253 bp, Homo sapiens
cccgagtcagggcgatcccacccgaaatcaacagatatatacactcttctcagcaccacatcgcacttattctaaaattgaccgcataactggaagtaaagcactcttcagcatttcgtaaaagaaaacatatcacaacaaactgtctctcagaccacagtgcaatcaaattagaactcaggattaagaaactcactcaacaactacaactcatagcaaacaacaaaaactcagaaggaagggtctgatttcc

SEQ ID NO: 613017 - DNA, 350 bp, Homo sapiens
tgagccccccccccccccccccgcagccagtaacgtagcctacccccaccagccacaaacaaagcataaaaaacttattaaaagcgaactcaagtacccatataaccttcaacgctcttgttcccctaccgacgtatcaccgtcccaacacctacaacaaacacctcctcagtccctcgtcacaaaacagctcacgcagtaaaacgccgtatagtataatagaatagaatagtaggaggaccataaaaaaggataactaatatcgaggacaacttccctatccgttaggggtaataaaaccatttttctgagggtcggcctagtcggtcttacggtcgagaaaccagttg

SEQ ID NO: 613018 - DNA, 239 bp, Homo sapiens
tcggcgaattcgtgtggtgctcgggaattcgaggtgctggtctggagaattggtggtggtggtacgatgtgtgaagttttgtggtcaggagtggggcatgacacagtatgacgagaagaccctatggatgctttaatttattaaggcgcacagtacctaacaaacccacaggtcgtaaagtaccaaacctgcattaaaaatttcggttgggtcgacctcggagcataacccaatctccg

SEQ ID NO: 613019 - DNA, 926 bp, Homo sapiens
  misc_feature (1)..(1): n is a, c, g, or t
  misc_feature (461)..(461): n is a, c, g, or t
nacttgagtttaatactgtagaatggggatgacgttcttgcaaattacctaagtcaggccctgtaagacaccccgggtggaacttcgggtgggcacaacaccttcgggggacaccggtgattcttgggcaagtgttctccccgccccatattaattggtgggttctttccgcaaatagatcccccaaagagtagtcccccccccacgcccggacccacgacagtggggggtcacccagagggccacctttatataagctgtctttagaatccacttgcggcgatgtggagcccccccttgctttcgagcgcccagggtggacccactactggtacttgtgttcgccagttggttttccacgaaagggtcttgtgccccgcgttttgatcaacgcccgcggccgaatactctgattttcaagagaccacgttttgtgttgcgcgcacggaatccgccatacncacgggtggcggtacactggaggagggcccccgccgcgactcgtgtggttgacacacctactcgggggcctcggatcacaagtccacattccccgtatagcgctcgtacgaccgtaaccgatattcaccacaccttccctggggctgatatccccgaatccccccccggcccctcccgccccggggggtagctcgctgttcccatccgcgcgagttagtattcccggcagcatcggttgagcgggccccgcggtgctcttggttcacccctcaagggagcttcatcatccgttgtcgaccccttcacgcccttggcccccccttgaatacgatggttctatttttgccccccccaggggcggtggaagaagatcggaggaaggctcgactcggggcgcactgtcgactgtggtgccctcctcgacccccccgcccccaaacccctttttttcccccaccataaca

SEQ ID NO: 613020 - DNA, 167 bp, Homo sapiens
ttcacatatatcatcatacaggcaacaacacattcagagtggtgggcaggaagattcaggaccatcaggtaagggtctgttcattcttaaagtcatgtaggattttacaaggacttgacatattcagtaatataaagtggtgagtaattcggtacagtaattcggta

SEQ ID NO: 613021 - DNA, 861 bp, Homo sapiens
  misc_feature (482)..(482): n is a, c, g, or t
ggtgactagtcgatgatagtagaatcgagtgccatgagcctctaacagggggcctctcagcccttcgtagagtgatctccgttgcctgaagtccatgtgatcctcagttccattccataaggctcgctcagagtaggtccgtacgtaagccaaacacactaaactcagtatagccacactgatggtggtgctgcatggtatacacggcatggaagagcgacgatatcgaaggcccaccggcaacaagcaccatgtcccaaaaaggccgtatcggcataccagggaattacatcccttatttgtcattacctgcagcaagttgtcttgtcttcagcgcaggaattggtccttggcagcctgtgtagccacgtccaagcctaagctccgtaggcccccgaatttagggagtggccatgggtggctcctaacagagctatcatgcgcgcgttaaagtcctctctaagacagttcgcgcacgtcanctaatacacctctcggtattgacgtccgcgagtccaaggatggtattcaactcgatcgcatgagcatcgactctactagggatctaagtaggaaaaagaagcaaaatcggagaagccacgctagtacagtgtgcttaggacagcggcgtgtagtaaacgaatattgtacctaggtggtcctacgtaatttataaccacgttctcgtaacagagtgcgcctgcaaggaagattcacctttaccgaagatcgtcacgcgtgtccaggacagttctctcgggacgggtccacatcgtatcgggcatcaatcgaatgttgttctgtcagaccactaggactttcaagcaagaacctttcacggtcccaaatttaatttgggca

SEQ ID NO: 613022 - DNA, 1057 bp, Homo sapiens
atgtatattgaattgttgttattgagtaattattttatgttttatcctgttatcgtgtgaagtaattagttaaaacttgtgattattgtggttcatttttgttgtttcatttaatatgtatgttatattatttgtgggtttattgattttttgtatttattttagtttgattttgtatgttatattggttttatgattttatatttttggtattgttattttttttttctgggattttttggtcatttttacatatttttttttttaatgtttatttatttagtattttagtgatattttttttgtctttttttcttttattatattatttttgtttttttttggcgctcctgtttatctctttgtttgtttaatggctctcttttcgactctttttccacctttcgacttttcctcgttctctagttatctcttactgtgtgttatcctttcgagttgtaatagttcttgcctcttccttctcgttgggcatgttgccatctctgtcatgtttatattgtgtcttttccatccatctctatcctcttatccatttgatgaattgttttcattatgggtgtatggttataatgtacctaaacttttatggccctgcttttgttctttaaatgttctttataataggatatatttgtttgtattttttatttacattttatatttttgtacatattgtttagggtcagtccatttttaatgatctcggatgaccttaatcctagccttcggagcgttctctgtcctacttctgactttacttgtggtgtgaccatgttcagttattaatctcaataggatgttatatttataatcctttgtaaagaaatatgcaaataattgactaacatgaaaaacatatcttattctcgatgcatggccagtaacttttttgtgtatgtacttagctgtactataagtagttggtttgtatgagatggttaataaaggccaaagataaaaggtttctttttttttccttttttgtctatgaagttgctgtttattttttgtggcctaacttgatgagtgtgtgaat

SEQ ID NO: 613023 - DNA, 134 bp, Homo sapiens
gtcgcgctacctgccgagccgctgccgtatggatgatcgagaggatctggtgtacaggcgaaagtttgccgagcaggctgagcgatacgacgaaatggtggagtcaatgaagaaagtagcagggatggatgtgg

SEQ ID NO: 613024 - DNA, 465 bp, Homo sapiens
ggtgttggaactcgccataaggcattgatcaggattatggtttcccgttctgaaattgacatgaatgatatcaaagccttctatcagaagatgtatggtatctccctttgccaagccatcctggatgaaaccaaaggagattatgagaaaatcctggtggctctttgtgggggaaactaaacattcccttgagggtctcaagctatgatcagaagcctttaattatatattttcctcctataagcttaaataggaaagttttttcaccaggattccaggggggctccctccatgctgaaaaatatagcctttaaatcctttttatattataactcgggataatagagataggtcccttttttaaaaatgttttcccccacccataaaaccctatccaagttgttttgggaccaatacatgagaaagaggtttatggagctgaaaataaaatggggtcccaagcca

SEQ ID NO: 613025 - DNA, 243 bp, Homo sapiens
  misc_feature (22)..(22): n is a, c, g, or t
  misc_feature (41)..(42): n is a, c, g, or t
  misc_feature (78)..(79): n is a, c, g, or t
  misc_feature (106)..(106): n is a, c, g, or t
  misc_feature (109)..(109): n is a, c, g, or t
  misc_feature (151)..(151): n is a, c, g, or t
  misc_feature (170)..(170): n is a, c, g, or t
  misc_feature (192)..(192): n is a, c, g, or t
  misc_feature (210)..(210): n is a, c, g, or t
  misc_feature (228)..(228): n is a, c, g, or t
  misc_feature (234)..(234): n is a, c, g, or t
  misc_feature (239)..(239): n is a, c, g, or t
  misc_feature (242)..(242): n is a, c, g, or t
ctttaatttccctatacagganatgattggcatagaattannaggagtccaacattcccagctccccagttctaaganncttttgtcaaacccaataggtttgggncanttctgtttagcacttgacagctgccagctaacagtaattctnccatagttgacttgaactnctgatgcttttattgcccagtnttctctagtgggatccangtgttttgattcctaggngtctgntgcgntana

SEQ ID NO: 613026 - DNA, 220 bp, Homo sapiens
  misc_feature (83)..(83): n is a, c, g, or t
  misc_feature (123)..(123): n is a, c, g, or t
  misc_feature (156)..(156): n is a, c, g, or t
  misc_feature (171)..(171): n is a, c, g, or t
  misc_feature (204)..(204): n is a, c, g, or t
acccccaggtatgaggagggggtggtcttagggttctgttcaggtctgccccgccccctcccagccatccccaggagaacttngaattcaggtgtgcacctgcaggctgaggggctctgtganagagtgctgctcaactagggagttcaggcgccnaagacccctgtgctnctgggataggcctgcttcacttagggagcactncctcaagacaggtaaa

SEQ ID NO: 613027 - DNA, 1034 bp, Homo sapiens
gatggcaagccgttacagccacaacgcaaagtcccggagatccgtgatgtaacaaggtattgatgcgaatctggtgcccactccctactatcgctgggggactggggctgtgacggatgccttggcagcctcgcgtcgggcttcgctaggggcatggtgcggtcagctggcggcacggcggtgcggctcggcgtggtgctggatgatgatccggggaagggaacgattgccgggtcgggcagtccttagttgctggccagccgggcacggggaagacggccatcgccatgggcagtggcgcaggccctgggccctgacacgccattcacaggccatcgccggcagtgaagatcttctccctggagatgagcaatgaccgaggcgctgactgcaggcgcttccggctggtccatcgggcgttcgcagtcaaggaggagacggagactcatcgaaggggaggtggtggagatccatatagatcgaccattaatgggtacggtctccaatggtgggcaaagtgacccttctaagagcacatagatggggaccatctacgaactgggcaccaagatgagaggagtgccgacctagggacgaggtccaggccgggaatgtgattaccatcgagacggcgacgggcaagatctccaagctgggccgatcgtttcggaaagcgtccgcgagttagacgactatgtgctcccagaagcaagtacgcggaagtggcccagaatggggagcttacagaaaacgccgggaagtgggagacacaccgtgttccctggacgaaaaatggaggtcattaaatttagccaacccaggggataaccagggggcccatcaacagggggacacaggggacaatatagtaagaaaccgtgggacaaataacgtccacggtgctagatgcggcgaggaagcaacgggaagaaaccccgagagtaggaacaacgacaggcacacagaggggagaaaagaaacctgtacacaaggaaccgaaaatagataggctgtgataaacaacaacacgctag

SEQ ID NO: 613028 - DNA, 312 bp, Homo sapiens
attttagtcttgaaaaattgcttgcagctgggtctctcacggccctgacggcagaatctccacctgagtgttcggggcgtactgctggcgcgagctgaagcgcctcggccacctgcggggctgctgccgctccttctcatacgattgtcgccccttccagctctagatcttgctccagagcccgttgtccagcacaaagcagtcatcagatatcagcagtacaaggggccaaggagctggagtcaggcacttaggtcaggttcatctgtccagtggcatcagagaccttccccaccgagagagcgtcggaga

SEQ ID NO: 613029 - DNA, 977 bp, Homo sapiens
taacttagaggcaatggaaaactaaaagttgactgtactaaaaatgtatacttgtagccaggaaggtgacctcaacaattaaaagtataattattcggcgggcatggtggctcacacctgtaattccagcacttgggaggccaaggcaggcggatcacgaggtcaggagttcaaaaccagcctgtccaatatagtgaaaccccgtaccctactaaaaaatacaaaaattagctgggtatgtggcatgtgccagctactcaggagactgaggcaggagaatcatgtgaacctgggaggcggaggcatgcagtgagcccagattgcatcaatgacaaccagcctgggtgacagaggtgagactctgtctcagaacaaaaaaacaaaaagaaaaatcagacgcagcagaaacttaaaactacgcatcacaacaccgacccaaaaagggcgcagtgctacaacacataaagaggcagaagacaaggacgagcagaccgtaaaacacaaagaacaaacaaatcaagaaacgaacaacaaaatgcaagagccgcacacgatagaccacgactaacaagacagaaacaagacactcagcaggtggacaaaacaacgaaaaaggcccaaacacggagagacgaacacacaccaatgacagaacaaacacaacacccacacacagaaaagaccgaacacaaccaaaaaaaaaaagaccagacaaacagcagatgcatccacgacacagaagaaagccaaacagagggagaaaggatgcaccgaaactagcaaagaaaacaaataaaacaaaaggcacagaaaacacaaatacaagacacagcaagaaaataaggaacgacacaaacaaagaagcaacaccacaacgaagcagcaaaaaccaaacgagccaggagcacagaaacaaacaaccagaccagcaaaaagaaggtaacacaaattaaagacagaggcgcaacaaaaggaaa

SEQ ID NO: 613030 - DNA, 280 bp, Homo sapiens
agtagagaaaacatcgtgaaaagcataccatcaactatgttttaatattgagattaccataaatgcctcatagactcccataccaccatacacaagcccatacatgtccacagtctccatacagccaccaaatggattatcctaagatgcaattctagatcatggctctatcctgatttaaaggctccagtgactccaaaccccttccatgacaagtctagctcctccacacttcctaccagtatccttagaattcagccctgcctacctatgaagggaa

SEQ ID NO: 613031 - DNA, 791 bp, Homo sapiens
  misc_feature (4)..(4): n is a, c, g, or t
  misc_feature (16)..(16): n is a, c, g, or t
  misc_feature (18)..(20): n is a, c, g, or t
  misc_feature (29)..(29): n is a, c, g, or t
  misc_feature (33)..(33): n is a, c, g, or t
  misc_feature (35)..(35): n is a, c, g, or t
  misc_feature (37)..(37): n is a, c, g, or t
  misc_feature (42)..(42): n is a, c, g, or t
  misc_feature (44)..(44): n is a, c, g, or t
  misc_feature (49)..(49): n is a, c, g, or t
  misc_feature (53)..(53): n is a, c, g, or t
  misc_feature (61)..(61): n is a, c, g, or t
  misc_feature (69)..(70): n is a, c, g, or t
  misc_feature (75)..(75): n is a, c, g, or t
  misc_feature (81)..(81): n is a, c, g, or t
  misc_feature (113)..(113): n is a, c, g, or t
  misc_feature (136)..(136): n is a, c, g, or t
  misc_feature (177)..(177): n is a, c, g, or t
  misc_feature (182)..(182): n is a, c, g, or t
  misc_feature (189)..(189): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (212)..(212): n is a, c, g, or t
  misc_feature (216)..(216): n is a, c, g, or t
  misc_feature (242)..(242): n is a, c, g, or t
  misc_feature (244)..(244): n is a, c, g, or t
  misc_feature (246)..(246): n is a, c, g, or t
  misc_feature (251)..(251): n is a, c, g, or t
  misc_feature (273)..(273): n is a, c, g, or t
  misc_feature (281)..(281): n is a, c, g, or t
  misc_feature (292)..(292): n is a, c, g, or t
  misc_feature (299)..(299): n is a, c, g, or t
  misc_feature (324)..(324): n is a, c, g, or t
  misc_feature (328)..(328): n is a, c, g, or t
  misc_feature (331)..(331): n is a, c, g, or t
  misc_feature (334)..(334): n is a, c, g, or t
  misc_feature (338)..(338): n is a, c, g, or t
  misc_feature (348)..(348): n is a, c, g, or t
  misc_feature (351)..(351): n is a, c, g, or t
  misc_feature (360)..(360): n is a, c, g, or t
  misc_feature (363)..(363): n is a, c, g, or t
  misc_feature (378)..(378): n is a, c, g, or t
  misc_feature (382)..(382): n is a, c, g, or t
  misc_feature (389)..(389): n is a, c, g, or t
  misc_feature (398)..(398): n is a, c, g, or t
  misc_feature (452)..(452): n is a, c, g, or t
  misc_feature (456)..(456): n is a, c, g, or t
  misc_feature (460)..(460): n is a, c, g, or t
  misc_feature (492)..(494): n is a, c, g, or t
  misc_feature (496)..(496): n is a, c, g, or t
  misc_feature (524)..(524): n is a, c, g, or t
  misc_feature (526)..(526): n is a, c, g, or t
  misc_feature (529)..(529): n is a, c, g, or t
  misc_feature (531)..(531): n is a, c, g, or t
  misc_feature (539)..(539): n is a, c, g, or t
  misc_feature (544)..(544): n is a, c, g, or t
  misc_feature (580)..(580): n is a, c, g, or t
  misc_feature (586)..(586): n is a, c, g, or t
  misc_feature (597)..(597): n is a, c, g, or t
  misc_feature (637)..(637): n is a, c, g, or t
  misc_feature (687)..(687): n is a, c, g, or t
  misc_feature (756)..(756): n is a, c, g, or t
taangggtgcactttnannnaactggtcncaantnantgaanangaaancccnggctgccnccacccanncccanggaaancaaaaaccttcaaaaaactcaagttggggganaaaaaagggggaagggggggcangaaggcccaacaatcaaaaaaaaaaaaaaaaaaaaaatatnaaggngaaaaanaaaaaaantttgcantanaaaantaanacgaaaacaaagcaaacacccccccngngnggacntgggagaggactgggccaatcnccttaaanaaaagtggggnggctttnaggatggcaagggacttcctgtaanaacncanctnaaanttggaaagantanaaaaaaaanaanaaagtgcaaacaaantccncggccanattgtgaantttgggggaagcccgccccaaccgactgctgtaaccttcaccgttccaattttnaaancctnaatcaagccaaaaaaaaaaaaaaaaccaaaannntntttaaaaaacaaataaagccatgccaancncancntgttttcngcgcnagtaagggtttgtcaagaaagggtgtaacgcaactnagtcanagtccgcctanaagcatttgcgggggacgatggaggggccggactcgtcanactcctgcttgctgatccacatctgctggaaggtggacagcgaggccagngatggagccgccgatccacacggagtacttgcgctcaggaggagcaatgatcttgatcttcattgtgcngggtgccagggcagtaatctccttctgcatcctgt

SEQ ID NO: 613032 - DNA, 553 bp, Homo sapiens
atagtactaatagtaaattaaatcaatggtgaagaggctgtcaactcacctcaatgataaactccctgaaagtaagagcccccaggttctgtagtctatacaaattttaaatggaaacaggtctcactcagccgcccaagttgaaatgcggtgatgaatctcttgtcactggagcatgtgcctcctgagctccagcaatccttctgcctcaaacctcctgaataagctagggataccaggtttgacccactactcccagcccatttaagtattaaattagtgaatatatatatagatcttttaaaatgcttgctttataacctggatttattgaaaacatataacttcaaatattgaaaaacacacaatcacccattatccaaccagctaaagagacctgttatagcattagggttacaatgttacaagaccttgtataatgcacatgtgtgcatatgtgttagtgtatgaatacatttgttttaaacagagtgatcaccccaaatgcttgagtaatctaattaaaccacttattgctataacagatttttcc

SEQ ID NO: 613033 - DNA, 192 bp, Homo sapiens
caggacgttatattgataattgttgtgatgaaattgacggaccctaagatttatgagaatcctgctaaatggtaggagaagatggttaatgtctacggaggctccacgggtgggagtagttccctgtctaaaggagggtatactgttcaacctgttcctgctccgtgcctccactatagcagatgcgagcag

SEQ ID NO: 613034 - DNA, 546 bp, Homo sapiens
gccccctgtgagccttggcctcccatgaccaggacaccctggtccagcttctggccagaagcccgtcatgcgctaacaggcccggctccccttcagctgagagacctgtcccgaccgacccgtcttgttctgccactgacctgattccgtgaggtcccaagtaaaaaaaaaagattgacacaaataatagtgtgaacgaaagtgacgccgtaggggcattacgtggcgcgcccagacaaacctggaatccccgcgtagacactcggcgtggctcgcgagaaacaatggcattcaacaatttctcctccaacagacctcataacagcgcattccacttgaccgtccacgcgcgggcgtttccgccaatcggctatctgcgccgtgcgctcgcggaacacacgcaagagcacacgtgccctcccaccccagtgccccccccccacaccaccgcccagagatgcctcccgcggaaccgcgcagacccaccaacccacggcgccttttactaccccagcctgtgccacccccccacgtgactcactggcc

SEQ ID NO: 613035 - DNA, 221 bp, Homo sapiens
cccgcgtatgggatcaggatttagagggaacgagggctcagagaggtccacagatttgcgtgtattatggaggtgttatgttatagtcctcttacagatgtttttatttttttggcgggtgggggccaagggggatagtcatccattctaccccaatccccagtttcccagtgggttggttgcagaaaaggaggaataggcggctctaggagttatggggg

SEQ ID NO: 613036 - DNA, 303 bp, Homo sapiens
cggatggagggaggggtgaagagcgagagcagttatttatgggtcgggatcaccacttttccatgaagagggagacttggtattttggtcaatcattaagaagacaagagtatgttgaacttgaactcggggggagatagacatgggtaatggcctctaagaaacatggccccaggcagctttcagtccgctttactcgatcgaatggtcagcacagcccttatgcgacggccttgagagaggcttcagggggtgccgtccgtctggtgaccccggagaaggtcagccccattgctgaagaca

SEQ ID NO: 613037 - DNA, 318 bp, Homo sapiens
tagtagaaactatcctgctgacaaccatgcagaggaattaaccactataagtcagagccttcctctccatctatgaatacacagctagtcccctggcagcacacaggagggtattaaggacctttgtgaggctaggtacactgtccacacctctttggggcagttacgataacttatttaccatcataattcagtctcttcttattctacagtgtgcacttaatgcctctcgcctatggataataagttgtacagtgaaggatgtcagctgccagaatattaagaagggtctccctttatgtcagtacaactgtaagg

SEQ ID NO: 613038 - DNA, 227 bp, Homo sapiens
aattgagctcactgcacatcaggtatgtgtctcaaggaagtcacacaaaatgggggtcatatatgtcagtaggccagtatgtgcagaaccagtagatgactgattcacatttatttccaaatgtaatgcacactccattgcattcagcccgctctcccagtcatcacagtcaggttaattgatatcctgaaggaagaatcggccacctcagtggtactgcagcttca

SEQ ID NO: 613039 - DNA, 760 bp, Homo sapiens
gtaacttgttcaagttgagtgattgaataaattaatgaatgtctgacagctagtgtggtcttggtcacaatcagctcttctggttccctagctggaaccctgagccctccagaactgattcactgctaataaatatcaattactctacagataaaggaagtggatttggactgagggtgcctggaggactctgagaaagggctctgacaaatgaacttccccaaagcaaaccctctttcccgtctgtgttaaagttggtgaagataaagatggttttctagatagtggctctggggacacactgaagactcaaagattaaaatgtcaccatgtttcagcctgtttcagcttctactcagctatgacactgcttttatttaccactgcactgttttcttcattgggctgtgagggtgggcatggggacctgttattcatttctgttcctgctggtgcctggcatgtaatgggcacatgttttttgggtgaatgaatggataactgaagggacggaagggggagggagtgtgtgttacctctctttgctccctctaagacctccccacccgtccatccttgctttgccagacccttggctaagaaaatgccagccaacactgtgttctcaagtgactctcagttcttagaaacaaaatgatggaatttcagtattggaaaaatgcttagacatgacctcatccctacccaagctggttcatgaatcatccccataaaattcctggcatgccaattaaaacca

SEQ ID NO: 613040 - DNA, 91 bp, Homo sapiens
catggatttgctggtgcagtacaactaggcttaatagggaggctgctgttggtgttaagaagcagaagaagcctctggtgggaaaaaaaaa

SEQ ID NO: 613041 - DNA, 288 bp, Homo sapiens
ctggggtgaatgtggtgccagccacgagagatgtgaactcgttcctacaaacagctgggtaacgtactcctgcacaggcagacaccagatcaatgcatgataactgttgattcaggttgatatcccagatacacagagtggctcgggaggtcattgctctgataaggctcttgccggagtggatcagcttgtgcatggcaggacagaatcacccatcaggtaaccacatacatcctcaacagtgtcaacacgtaagaatccaggcactaaagaatgttgtggaatgta

SEQ ID NO: 613042 - DNA, 160 bp, Homo sapiens
ctaactccaggtactggtatgccaactgacaaaaagaaagtgtgggccatactccaggtgatagtaagaagcaatccagaattgccgtagcaagatgcttcaactcttgtgctgagtgttgggggaggctcgaaggggtctgcttgccagtcttggtcat

SEQ ID NO: 613043 - DNA, 767 bp, Homo sapiens
  misc_feature (451)..(451): n is a, c, g, or t
  misc_feature (532)..(532): n is a, c, g, or t
  misc_feature (746)..(746): n is a, c, g, or t
  misc_feature (767)..(767): n is a, c, g, or t
ccaccacggccggctaattttgtatttttggtagagatgaggtttctccatgttggtcaggctggccttgaactcctgacctcaggtgatccacctgcctcagcctcccaaagtgctgcgattacaggcgtgagccactgtactcggcctgctgtaggctttatatacactgtgcacttaggctacataaacttataaaaaactttcttcaataataaattaactttagcttcctgtaacttttttaccttataaacgttttaattttttaaactgtataacccttttatcataacacttaccttaaaacacaaatacattgtacaactgtacacaaatattttatatttttataagcttttttctatttccacaatttttaattttttaatttctttttttacttcttaagttcttttgttaaaaactaagacacagacacattagcctncatctacactgtcttccaccttcacagcttgtcccactgcaaggccttcaggggcaataacaggcatggagttgccatctnctatgagagcaacaccttcttgtgcaataccttctggaggacctgcctgagggctgtcacagtcaactttttctttaagtagaaggagtacactctaaaatagaccatattggatgtgctatacccttatatgactgacagcacagtaggtttgttacaccagattgacacataccctgagtaagcattgacctgtacgtaagatggctacgtngcactgggcccttagatggtn

SEQ ID NO: 613044 - DNA, 184 bp, Homo sapiens
ggttatatgcgagagattaatctctcaccaaataggcaaaatctggagaatcataaatagcacatctaaggaccaatgggaagggggaggcaaagtctttcgactaacgtccctcacaggagagattccaaggcttccatcagataaacaaaggaagctgatttttctacggaggctgcatgtg

SEQ ID NO: 613045 - DNA, 185 bp, Homo sapiens
aatctttctgggtttgggaagtcagagtaaagacttaggggagtattaaagccagagaccccccttcttttcctttcctgcctcgatctaggcagtcagcaaatttgagaggagtagatttaagctaagctgcttaatgtcttccggggctgtgtttggaagcagcaaggaacagtcactcagct

SEQ ID NO: 613046 - DNA, 598 bp, Homo sapiens
caactcggtgttgcccactgggcgtacagattttgctcgtactcgtgcgcctcggtgcggaatgctctggaacattgttgaaaagccgatatggatgagaatcgacgaaattcgatagaggtcgaggagctgaagaagtacagatgaaggcaaggataatggtccattgctttccaatagaaagcgattggatagcaggagtaaggcaagcagggagaaggtcgaaatggaggcgtgcgccgtggaaatattggagctggtatattccatcaagcatttgccctcgtaatgaagttctcgtcgatctgttgtaactttgtcagatgcaaacgaggtttggatccaaggttaaaatttgagttggttgttgggcccccgtttctcacattcaatatgaatttagtgtgacaaaggtgaaagtgctccgcgggggcatatttggagaagtctggatattataatgcttgggttgtgcaggggtaaagtaataaggaacgttgcattgttgtggtcgaaaagggagagaattgtgggttggaaaatgttggttgtggggacgaatgtagcattctagagtaaaaacaagcgtgggagcaag

SEQ ID NO: 613047 - DNA, 221 bp, Homo sapiens
  misc_feature (153)..(153): n is a, c, g, or t
tgggtcttaaactcttggacctcgtgacccactggccttggcctcccaaagtgctggggataacaggcgtgagtcactggtgccgggcccatacttttaaatataagggggatgctctaggtcacattgtggcattctcttcctggaaacccncccaagctcttaaattttattttaaaggtaggcccaacaaagggttcacgtctggatggctggtggag

SEQ ID NO: 613048 - DNA, 157 bp, Homo sapiens
ggcgactctgagtatcccttcatggtatgtttagataattctgttgatccattcatccaatacagtgaacacttgggtccttacaactttgggctgttgggtgtctgacactgtgctcctagtgctcaatctcgtttattccctcctaatcaagtgt

SEQ ID NO: 613049 - DNA, 678 bp, Homo sapiens
agcggggccggtgtttcgcagcccagagcatttgcagctggctcactccagatctcctgggactttgactcgccgtactcggagcgctcctgctgagggtcgccggcagtatgtcgctacggtgcgccttctaccacggagcctgatccgtgcctgcccgcacgcgccggatgggatccacgcagagtgctctacatagtctccagattgaactattgaatttgctgagagattttagggaaaaggacaaatcaacaggttcccattccatggatcccttaggtgcaccttccccagtatgctggatgtggagtacagctaccaaagctggggtgactcagtgccagagagtgaacttgaaaagttcctctgattagctacagcgtgaaagtatttcaggcaagacagctgttgtcgatcagctgttttctgttatacataaggaccgtcagtggaagaagtggttcttgggcagaggagatgtggccattactgaactgtacagacattggtgaataccagcaattgaacagtctcacagataagaatcctgtgtcagaaaggtatcttcatgcgttgcatgggcctgattggaaggaaagatctccagaaaccttacaagggtgccgaacaggtgaagcaacaattgagaacaaggagggcaactctagctgcccg

SEQ ID NO: 613050 - DNA, 300 bp, Homo sapiens
tgatccaaaaccccctcctttccctaggatgctgccccgtaccggctttttgcccacctgggccattatcgaagaatcacacaaacacaatagcctcatcatcccccacatcatagcccacatcaccctccttcacctctacttctcacctacgcctaatctactccacctcaatcacactactccccatatctaacaatgtacacctaaacagacagtttgaacatacaaaagccaacccattcctccccacactcatcacccttcacacgctactcctacctatctccccttttatac

SEQ ID NO: 613051 - DNA, 400 bp, Homo sapiens
cccggaaattcggccattttggccggaattttccccagcaccatttaacctgttgttggcttaaccaccagggtttcttagcccagcaaatttgcctcataaattaatggatcacccaatgggtaattttaaatccagccagaagcttccatttggggtccacagggcaatgtttagatgttggcccagcttcccatggccggtgcctggtaattggtttccttttggttaagccacatcccttgagggtttggttaatgctaatggctccggtaatttaattaactggactttgccaggcctaattcccaatgcatgggccagtcattttcaaatccacactgtagttaacagagaaaggcagtggttaccagattttaaggggaaagttcaaagtttt

SEQ ID NO: 613052 - DNA, 143 bp, Homo sapiens
acacccccggtttgttctcctcacacagtgcgcccttctttggtggcccaattgaaaggcgggccaccacatttgtcctttgatctcgtagagggtactgcacaccctttggagatcgccggtcgatggtgtgaaactaccgg

SEQ ID NO: 613053 - DNA, 207 bp, Homo sapiens
agctggtacctcggtctactgtcttgttgagcttgactctagtcgcacggtgaagagacatgagaggtgtaggatacagtagggagaggagtttgaggagagaggcagggccagatacaaggagcctgggagcttgtattaatacaacaggagcatgcgatgcggatgttgttggacaggattccgagacaagggtagatgccgacg

SEQ ID NO: 613054 - DNA, 565 bp, Homo sapiens
ccgtttatttgtccccgtctgcgattccgcgcttctctgtgggcttaacattctggttccgccgcccccaggcccttcttagggttgattccccccgggatggcagtcaagccaatggttactccacccctagttgtcctcttccccccccgctctccctcgttaggggccctcgccccccgattcaccgcggttgtttctccccagtggggccgccctcttttgcataaggacttccccttaccgcattagccgctatgacaattccccaccctcacttgttccgccccgtctacgcccctccttaaccacttcattccttatcgctgagccgccgttgattgagtactcccccctcacttctcaccccttatcctcccccaattgttttccacccctctctcaactaacatgcccatgttggcacaaacccgaccccccccctttcctctccccccacctctctttcttgcccctctcccacgcgtgcctcatctcactcactcttattcctccctcttttaatattataatatttctctccacaacaaataacaaaacaaca

SEQ ID NO: 613055 - DNA, 178 bp, Homo sapiens
gtactgtagtggatcaataggccgcctttctgcggcggtataataaatgtaatccataagttaatgctttcaaccgccgcagggcgcaatggggcgcccgccgcgtgatacactggccgctgaatgagcgagagggcagcagtgatggaagcggtacgcgcagcgatagaaaaacagg

SEQ ID NO: 613056 - DNA, 286 bp, Homo sapiens
tgaacaactgattttgataaagatacaaaggcatctttttcagtagagcaaagatgggtcttttagaaaaatgttggctgaaacaattggatatacaaaaccaaaaacagaatctcaattcatacctcactatgtatcatatctaaatatgcatttcaaatgaggccaggcacgtcggctcatgccagtaatccccgcatcttcggagcccgaggcacgcgactcacttgcgcccaggactctgcgaccagcctaggcaacctcgacagcccctctctctgcccac

SEQ ID NO: 613057 - DNA, 180 bp, Homo sapiens
tagatacaattagctgggtgtctgtggcacacacttgttatttccaactacttctgaggccgaggtgggaggagcacttgagcccgggaggcagaggttgcaagactgggaaagaggcagtcttgctcttatgtgactactaaaacagcagaatgctagcctggtgctgccggtgaaact

SEQ ID NO: 613058 - DNA, 766 bp, Homo sapiens
  misc_feature (54)..(54): n is a, c, g, or t
  misc_feature (57)..(58): n is a, c, g, or t
  misc_feature (67)..(67): n is a, c, g, or t
  misc_feature (75)..(75): n is a, c, g, or t
  misc_feature (78)..(80): n is a, c, g, or t
  misc_feature (83)..(83): n is a, c, g, or t
  misc_feature (95)..(95): n is a, c, g, or t
  misc_feature (99)..(99): n is a, c, g, or t
  misc_feature (104)..(104): n is a, c, g, or t
  misc_feature (106)..(106): n is a, c, g, or t
  misc_feature (110)..(110): n is a, c, g, or t
  misc_feature (234)..(234): n is a, c, g, or t
  misc_feature (255)..(255): n is a, c, g, or t
  misc_feature (272)..(272): n is a, c, g, or t
  misc_feature (315)..(315): n is a, c, g, or t
  misc_feature (666)..(666): n is a, c, g, or t
  misc_feature (671)..(671): n is a, c, g, or t
  misc_feature (673)..(673): n is a, c, g, or t
  misc_feature (678)..(678): n is a, c, g, or t
tcttggaacccaccacacagtataagtattgcacatcaattgccaaaagcaatnagnnacaatattnaagccccnttnnnatnaaatgaagaatngagncctgncngaanaccccctccccttctaattactaacttgttctcatggagtggctattcagcattggcagtaaccacattctggtcaaattaaccaaactggcttttttctttttctagtgaagttaaacaaacnttgggataccgacaccagacnacttgagcaccagtttntttaatcttttaatccagtgtagctatgtgctgctgctgctcnagagctggatcccataccaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccnagctncnatgcngtattgacttgaccgagcctctacttctgtctccaaatggctcccaatgatttctgtactgccaaataaagcccaattctggaaacta

SEQ ID NO: 613059 - DNA, 530 bp, Homo sapiens
accgccagcgattaggttcaatcgattctcctgctcagccttagagcagctgggattataggcatgcgcaccacacacggctaatttgtatttttagtagagatggggtttctccatgttggtcaggctggtctcgaactcccgacctcatgtgatccgcccgcctcggcctcccaaagtgccgggattacaggtgtgagccaccgcatccagcctttttttcttttattacaacagtccttatgctgaattcacttatcttgaaatggtgaacaaccacagctgtggacctcaaactatgtacaaactgagcaatttttcttgtaatgttctaacttttctctgcctcttaggggaacttccagcaacactagtggcactagtgggtcccatagtattactcaaggtttactgtattgcactaaacacaatgaaaactatacaagaaccatgagagatcaatttttactgtgatacacaattagctggagagataaacactcacatggtgatgactagcgtcacacaac

SEQ ID NO: 613060 - DNA, 995 bp, Homo sapiens
  misc_feature (47)..(47): n is a, c, g, or t
  misc_feature (103)..(104): n is a, c, g, or t
  misc_feature (148)..(148): n is a, c, g, or t
  misc_feature (463)..(463): n is a, c, g, or t
  misc_feature (484)..(484): n is a, c, g, or t
  misc_feature (501)..(501): n is a, c, g, or t
  misc_feature (544)..(544): n is a, c, g, or t
  misc_feature (895)..(895): n is a, c, g, or t
  misc_feature (900)..(900): n is a, c, g, or t
  misc_feature (902)..(902): n is a, c, g, or t
  misc_feature (907)..(907): n is a, c, g, or t
ttgaacagaaattgttagcatcagtgacctcctgtaccaaaagactnggaacagaaagccagatctttattccccgcacatatgatgccaccactcattttgnnacaacgtgtgatgacattaaaaacatctataagaggatgacagnatcagatttgacttgaggaaatgaagcgcaagaagaatgacatctatgggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccctccccttctaattactaacttgttctcatggagtggctattcagcattggcagtaaccacattctggtcaaattaaccaaactggcttttttctttttctagtgaagttaaacaaacnttgggataccgacaccagacnacttgagcaccagtttntttaatcttttaatccagtgtagctatgtgctgctgctgctcnagagctggatcccataccaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccnagctncnatgcngtattgacttgaccgagcctctacttctgtctccaaatggctcccaatgatttctgtactgccaaataaagcccaattctggaaacta

SEQ ID NO: 613061 - DNA, 307 bp, Homo sapiens
gtttggcatgatttgtatttgaagaatctgtattgactactgtttatcacttgggtttcccctagatactcataaatgactgccttaataattgtcctcacagcttaccagatattgaaattaaatttatgagtttaattccctgagttccctggggacttttttttttttttaaagaaaaatggaacacagcagtttcatgactcacaacaactcttccataataaccaatgtgataaaaacattttttcagggaaacaaatttcagttttagccttccaaatgactattacgaaaattaacaact

SEQ ID NO: 613062 - DNA, 471 bp, Homo sapiens
  misc_feature (27)..(27): n is a, c, g, or t
  misc_feature (76)..(76): n is a, c, g, or t
  misc_feature (109)..(110): n is a, c, g, or t
  misc_feature (116)..(116): n is a, c, g, or t
  misc_feature (123)..(123): n is a, c, g, or t
  misc_feature (151)..(151): n is a, c, g, or t
  misc_feature (288)..(288): n is a, c, g, or t
  misc_feature (358)..(358): n is a, c, g, or t
  misc_feature (451)..(451): n is a, c, g, or t
gacgggacgataagcgatatcgaattngcggccgcgtcgactacgggtgcgagaagccgcagaagggcatattaanattgtatactcagacctgttttaagaaaaaccnncaaggnagtaaanccaaagcagcagcccggcgccaggcctnaaaccaggcctgggcctgcctggcctaaacccagtagttaaaaatcaactcataacttagaaaccgatgttattcatagattccagacattgtatagaagaacattgtgaaactccctgccctgttctgtttctctntgaccaccagtacatgcagcccctgtcacgtaacccctgcttgctcaaatcaattacgaccctttcatgnataatctttagtgttgtgagtccttaaaagggacagaaattgtgcactcagagagctcggattttaaggcagtagtttgccgatgctcccagntgaataaagcccttccttgc

SEQ ID NO: 613063 - DNA, 313 bp, Homo sapiens
tcagaggattacgattttgacgcgttctcctaggggaagtgggagaacaccacatcaagggaacacccagtgggacaaaataatttaaacagtagtccttgaatcccagatcttccctctgacatagcctacccaaatgagaaagaaccagaaaaacaattctggtaatatgacaaaacaaggttatttaacacccccaaaatataccagctcaccagcaatggatgcaaatcaagatgaagtctatgaattgccaggaaaagaagtcagaagattgattattaagctaattaaggagaacgcgtcaaaatcg

SEQ ID NO: 613064 - DNA, 153 bp, Homo sapiens
tctacgagcgccagatcgaccagcgtaagaagagctggagcacaagtttgacgtactggacgaaaaccagagcaagctcagcgaggacctcatggagttccggcgggacgcatccatgttaaatgacgagctgtcccatgttcagccgcgcgt

SEQ ID NO: 613065 - DNA, 239 bp, Homo sapiens
cccacccgcacacttaacaccaaccagccccggcttcatataccatctcacttgttgaccaggctggtcttgaactcttggcacccaagcgatccttttgcctggaatcccaaagggtgagatttactgaagaatatttcattgtaattactttctatactttataggtcaagagctctgatttaaagacaaaatttatctgaatataccttttcaaacaaagtttcatgttctaaatc

SEQ ID NO: 613066 - DNA, 136 bp, Homo sapiens
gtgcaggtatccaagctctccttccagcgctccaggcccagctgaggcaccacgtccaggagcaccaccagagggcctccctcgatcagccagcgcccgaaatacaccttgcagcccttgctgttcatgaaatccg

SEQ ID NO: 613067 - DNA, 277 bp, Homo sapiens
  misc_feature (41)..(41): n is a, c, g, or t
  misc_feature (51)..(51): n is a, c, g, or t
  misc_feature (97)..(97): n is a, c, g, or t
  misc_feature (166)..(166): n is a, c, g, or t
  misc_feature (216)..(216): n is a, c, g, or t
aagggcgcgccactgaactaaagtacttatgccggagccanaactactgtnaacgtattaagacttcaaacaaaccttatttaactttacagcctanaaataaacagtacaagcaatacaccgtagttgatagctgctaaaccgaatccgaaagaagatggctttngtgaaggtatttatagtggtaacagtgatggggctgaaccacagaaaatngagctatataaactaaccaataagaaagttctggaatggttagcgtaatagtttatgctgt

SEQ ID NO: 613068 - DNA, 213 bp, Homo sapiens
tgtctcactggtgcaaaacaaaaatcataatggtgaggcatttccggctaaatttacaaggaaggtgatacataaattatatagatcacaagttttcttttatactatttaaaacccaattatatggataaattatgtccagggggacaacaggggtttcttaatgggagtggcggagttccaacttagtgcaaaatcatagcttctgggttt

SEQ ID NO: 613069 - DNA, 259 bp, Homo sapiens
attttttccatttttaccttatttaacttaaaaggttccgccccgccaaaggaaccatccgccgggttaaccggccattccccgggttgggggaaatttttcccattttttccttttgccaaaggattggaacccaaattttccacggaccccaaccaatttgccaggaaaaaaccaaccgttccctccaaaatttggcttagggccttgaccggccattttccaaaggaggttttccaattttttaccaacctttgga

SEQ ID NO: 613070 - DNA, 847 bp, Homo sapiens
  misc_feature (258)..(258): n is a, c, g, or t
  misc_feature (305)..(305): n is a, c, g, or t
  misc_feature (362)..(362): n is a, c, g, or t
  misc_feature (393)..(393): n is a, c, g, or t
  misc_feature (400)..(400): n is a, c, g, or t
  misc_feature (411)..(411): n is a, c, g, or t
  misc_feature (419)..(419): n is a, c, g, or t
  misc_feature (425)..(425): n is a, c, g, or t
  misc_feature (469)..(469): n is a, c, g, or t
tcaagaaagtcagcccagatggaaggtgttcaggaaaggtgggctgccttttcccctgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagtttttngttttttttttttaatcaaaaaacaatttttttaaaaaaaaagcttngaaaatggatggttggggtattaaaaagaaaaaaaaaatttaaaaaaaaaaagaccntaagggccaggtgagtgggagtctcagggcnggggggnagtttcccttnagcaaagnagccanactttgaacgggtgtttcctttcccggggcgcagggtgcagggngtctccggatctggtgtgacctgggtccaggagtcctattggtcccgggggagggaggttccggtggcccggggttccgggggtcatggtgactttctcctccatgtgtctggcgcaggcactcatttctgggggctgtcggccagagggaatgtccgggagctgccaaggcgcggagggaggactcgggtgggtaatccccgggatgaacggtggctcccattcgaccttcccctcctcgtgcctggcctgctcctccaacgccccgctgttaagggagcgccaaagaggagccatttttcgccagaccttggtttcccccaccggctggggcatggttgtgtcccgtgccccggtgggcctcccggtggttccata

SEQ ID NO: 613071 - DNA, 150 bp, Homo sapiens
aaactgctcccaaggatgagaaactgaaaacctcttatactgctgctagggatgtacaatggtgatgtcacttcggaaaacagcctggcagctcctcaaaaaaggttaaacatagattaccatatgacctagcaattcctcatccttggg

SEQ ID NO: 613072 - DNA, 1154 bp, Homo sapiens
aacgccatgaacgcaggcacagtacttcctattctacaccacatagtaggctcccttccccatactcatcgcactaatttacactcacaacacccgtaggctcacgtaaacattctactactcactctcacatgcccaagaactatcaaagctccgtgagccaacaacgttaatcatgactagcttacccacatagcttttatagtaacgatacctctttacagactccactatatgacatcccataaagcccatgtcgaagaccacccatcgctgggtcaatagtacttgacacgagtactcttaacaactaggcggctatggtataatacgccatcacactcattctcaaccaccactgaacaaaaacacatagacctaccccattcctatgatactatcacctatgaggcactaatgataacaagctccatctgcctacgacaaaccaagagctaaaatcgatcatatgaataactctacaatcaggacacaataagcacatcagacagtaaccaagcacaatacatacaatccaaaaccccatgaacgctatcacacggcagcagcaaatactcgataaatcggcaccaccaggcactctaccttccctccatatacatagtaactagacctagacaaaacctcaaaagcgtcacgacaccgcaactcaaaaggcacagacattcatcacatccctcttcatacacaggaagctccaaagtcataaaatacccacgctaaatacgccttaattgatagaactttctaacacacagggcaatacagactaacacctcggcactaaaccacccaccctactacgccgataatgaagcagacacctactggacaaagtaaaccacacgtaccatacagaatcacaaatcaacacacaataagtacacagcaaacacacactactactgtcccgcaggcgatatgctaccacccaacacatatcgctgccaacaacaacacaagggaactacatgacacacccacaaattatcacaaataaaacggctcaagactcaagcaacaacaccttaggtatcaaacagacatcaacatgtgcacctaaccaacacaaaaaaatataccacgtaccccctacagaatgaatctacacactacgacacaacaaacaaagt

SEQ ID NO: 613073 - DNA, 622 bp, Homo sapiens
  misc_feature (248)..(248): n is a, c, g, or t
gagtttttaaataagggaaaaacctcttccccccaagggaaaaaaaaaaacccgaggtttttttaagggggtgctcttcaaccaagcaaacattgattggaaaatttttgtggtgtgtgccccaacgcccctttttaacaaggcaatttaaaagttgggggcctcactccccccagttttgggatagcccatgttttttttggctggggtttttcccattccctttaaccaagctaaatgcaaaaccntttcccaggttttttttttttttttttcagacaaagtctcgttttgttcccaagcttgcagtgcagtgcacgatcttggctcgctgcaagctccacttcttgggttgaccccattctcctccccagtcctccgaagaacttgggtttcctgttgctcccccccccacccagtaatttttttggtccttgacaaaagccggggtttcaccatgtaagccagaatgttctcgttctcctgacttggtaatccccccgcatggacctcccaaagtgttgggttacatgttgtaagcctccacgcgtgccggcttatgcattctttttccatggccattttttagggtttaataaggtaatcttgcccctggtgccga

SEQ ID NO: 613074 - DNA, 792 bp, Homo sapiens
acaggctactctcctcggccccctccatcgggctgaggaagcacagcagcatcttcaaacatgtacaaaatcgattggctttaaacacccttcacataccctccccccaaattatccccaattatccccacacatagaagaaagtcaaaacagttaacactaaccccgcttccgcccccccacaggcaacccctcttacaaacgtaagttggcgttcattagaaacaccccacaaaagctcagaaagtggcgtgttaacaagaaacaaccaccacaaagaacaaactcaattgggctaacgacaaaagaacgtatttaacaacacgaccatggcgctgacgaacacacattgggcacaaactaacaggaacatctggccaatcccccaagcccccatcattcacatcttactcccctgggacaatcacctgagctacaaactgtggccttggaactatatatcccctgaaacacacgacaacacagtccaacgacaggaacccccaagagaattccacatgggggggacacagcatcgcatagacaccacgaacaatcatcccagccaccctaacggggggaacatccaagcgaaacacagggacaatccggaaaaacataccaaacaacacacaagaggcggcgaccatacaatcaccattaacccatgcacaaaacaactaaccaaagaccgacaagagggaccacagaaagacccaaagaaagacggaaagaaccatgcaaccacaaaaaccaaggaaaagaacggaatgcgacgaccaaacacccaaa

SEQ ID NO: 613075 - DNA, 1012 bp, Homo sapiens
  misc_feature (114)..(114): n is a, c, g, or t
  misc_feature (146)..(146): n is a, c, g, or t
  misc_feature (168)..(168): n is a, c, g, or t
  misc_feature (187)..(187): n is a, c, g, or t
  misc_feature (223)..(223): n is a, c, g, or t
  misc_feature (270)..(270): n is a, c, g, or t
  misc_feature (272)..(275): n is a, c, g, or t
  misc_feature (280)..(280): n is a, c, g, or t
  misc_feature (610)..(610): n is a, c, g, or t
  misc_feature (1009)..(1009): n is a, c, g, or t
caagcccgcgtccccagcagcgcggatcccgggccagccgcccaggcagcaaagtcaggcgatcggcttcgccagcagccgatgagtctcatcctgtggattgcccagcgccangggatcaggatccggagaggtgtccaggaggngcagaccctcagaccaggtagnctgtgcactcggtgacccntgacgccatcccaagggaagctccgccatcccgcgnccagtgcctgagctgcaactgcaaactgcgcgtcctggcacgagcancnnnnggggncggtgggggaaggagcgagtgactctccaggcgtcttccgctacgtgacaccagccaggcagcccccagggccagagcgtcagcgccgaagccaggctcatccgggaagccactccggtggccgcggggtgcccatgccagcaccagatctctcttcggaaggaggagcggggcgggctacacggccaggcgggccctccccttaaggcggggtggccgcgcgcctgcgattttccgtccgtggtcctggggcagcccgggccagcccaggagaacccgcgagcccagcggcgcctgcacctgcggcctccgggagccgggcggcccccncggtgcaggcgcgcgcctaacggctttgcgaggctcactaggtccgagaggtcggaggccgccagtgtcgctgctgaagggtggaccaggcgggatcgcggattctgggctagatcgcagacttgaattcgacaccaaattttggaacttaaaaagaagattcttaaaacttacaatccaggttgttcaggctgagaaggaagagaggttggtcttgctgtctctgggttgcagaggcagaagaaaatctgcatataaatgaactcctgcagctcaaacccttgctgttcaagggtgaactgtattacctgttaatttgtgtcactaaggaagtatctttagaaccgggaactcaacaatccctttctcgtagaataaataaatggcagtaagaactgnaaa

SEQ ID NO: 613076 - DNA, 425 bp, Homo sapiens
acttcatacaagagaaactgacagtttaccatacatttttggaatttaaagagttgttgtggtgtgctttctttttgtgcaaattatggaatagatgaaagtgacagagtgatgacaccacctaaatggaagcataatgtagacggttattgcagatgccttaccacacagctctgccagcgcacatgcttcctgcaaacctcctgcaatttaaacccttgggctccttcaactaatgacgctaatttgccaatggagcaatggctttcttcgctaaacactcacctacaaaggagtatgtattagccgacaatgtatgtgctcagtaaaaactggcaatataacatgcacattttaaatataaagaccactttcatcactacattaaatcatagggattgatttaataaatcacagtgtaaata

SEQ ID NO: 613077 - DNA, 377 bp, Homo sapiens
  misc_feature (374)..(374): n is a, c, g, or t
cgaaaagctctcacctaaaactgtccgttttacatccgtatccacctgtgtagatcggttctttactgaaggttcttagaaggaaacttggaagtgggagaattcgacaccaaattttggaacttaaaaagaagattcttaaaacttacaatccaggttgttcaggctgagaaggaagagaggttggtcttgctgtctctgggttgcagaggcagaagaaaatctgcatataaatgaactcctgcagctcaaacccttgctgttcaagggtgaactgtattacctgttaatttgtgtcactaaggaagtatctttagaaccgggaactcaacaatccctttctcgtagaataaataaatggcagtaagaactgnaaa

SEQ ID NO: 613078 - DNA, 548 bp, Homo sapiens
  misc_feature (35)..(35): n is a, c, g, or t
  misc_feature (65)..(65): n is a, c, g, or t
  misc_feature (198)..(198): n is a, c, g, or t
ccttccccggtttcttttctttttctgagacaggntcttgttcagttgccccggctgaagtgcantggcaagatcatggctcatgcaacctcaactttctggcctcaagtaatccctcccacctcaacctcctaagttgggagggactacaggctgcaccacctgctggctatttttttattttttgtagaggcaggnttcccctatgttgtccaggctggtctcaaactcctgggatcaaacagtccttctgcctcagccccccaaagtcctgggattacaggcatgagccatgtgccaggcccaatgttttattaaaaatgcaatgatgctattcatatcatttgtcaactagcttttcatgcttaaaaatatatattgtggccacctgtccttgctggcaagatagttctggatcacacttgttaaacactgtgatattctagtttatggatggtctagaatacttttttttttttgagacagactctagctctgttacccaggttcgcaccactgcactccagcctgggtgacagagagactcc

SEQ ID NO: 613079 - DNA, 400 bp, Homo sapiens
  misc_feature (192)..(192): n is a, c, g, or t
ggagtctacggacgaaagaagcacgactcactatatgcgtggtgtgtgagaaggcggcagtttcagctgacgaactgcgagtctgaagtcctgcacacaggccttcgcagacgctggatggaatgtcctatagggaccttcgtccattcttgaattggacgggtccactgagcccattgaggcagctgtggncaggttcttctcagccagctgtgttccccgtgcagattaaggacagttcccccacctgtgtcggctgtgtgcggggacaggggaaaacaaatgtgccttctcctcccaggaaccgtacttcaactactctggtgccttccagtgtctgagagacggggctggagacgtggcttttatcagagagagcacagtgtttgaggacctgtca

SEQ ID NO: 613080 - DNA, 211 bp, Homo sapiens
atgtgagagggagttttctgtcacaggttgcagtgagccaagatcaggccactgcactccagcctcggggtcaagagcgaaactctgtctcaaacaaaaagaaagagaggaaggagggaaggagggaaggaaggaaggaaagagagaaagaaaagaaagagcagaaatgaaagaggcaagaaagaagtgctatgtggcgagtcgagtcagg

SEQ ID NO: 613081 - DNA, 96 bp, Homo sapiens
tctgaggctgctcctgctgcccccgctgccgcgccccctgcggagaaggcgcctgccaaaaagaaggccgccaagaagcccgccggggtgcgccgt

SEQ ID NO: 613082 - DNA, 1016 bp, Homo sapiens
  misc_feature (857)..(857): n is a, c, g, or t
  misc_feature (862)..(862): n is a, c, g, or t
gatgtaacaggcttaccctaactgatcaatcaacctcgtgacactgtgctctgtaaccttgtgataatgtaccttatgacattcttcccctgcccgcaataaacggctcctaactgtaactttccggtgcttacctctaactgataaaactagctccaacccaccaccctcgactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgaaatccaacaccggtcacggactcttcttggggagacagccttccttcagtgttcggtcaatgcccgggacgcccgccttggccatttgccagccacacaacccaggacctccaatggggacgcccactgaggatcctagtggtgctcttttcctgtgtctctttctttccccccagtctttccttgttctatcatgggcaatttcccgccttccatccctctttcttctgtctggcttgtgtcctcagaaacctcaaactcttcaccttgcaccaaatctaaaggctaaacgtctaattttttctgtaacacgtcctggccccagtataaattagaaaatggggctcagtggccagaaaacagcacttccaattctctattggtggggacttagacaactctatgggcacatggcactgggctgngaccnactcagcggtttacatcacacttctcagcgtgttcaaggagcatccccatttttttctgtgtacccccttcagggggggcatgtgtggacaccatttccacacaaaggtttcgaataacacatctcccccactaggccacacacgaaggagaca

SEQ ID NO: 613083 - DNA, 958 bp, Homo sapiens
  misc_feature (765)..(765): n is a, c, g, or t
gatgtaacaggcttaccctaactgatcaatcaacctcgtgacactgtgctctgtaaccttgtgataatgtaccttatgacattcttcccctgcccgcaataaacggctcctaactgtaactttccggtgcttacctctaactgataaaactagctccaacccaccaccctcgactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgcataaaaagacaggaatgttaggtcctctgagcaggcggcgccatggtcaagccattcgtgacccctgtgactcacacgtacacatccagaaggtctcctggagccaagaaagtctgggacgacaggaaaaccaacaaaaagaacgaaaaacggctagttccctggtcttagctgatcagccaaccttggtgacatttctatcatggtaaccaggctgtaccctaactgatcaatcaacctcatgacactgtgctctgtaaccttatgataaatgtaccttatggacattctttccccttgccctcaataaaacagctccgaactctaactttnccactggttaccctaaagtataaactagctcaacccaaccactttcctttcggatacagccaccgcaccagtgattaaacaacttgtggtcaacataataaacaaaaaaacaaatctgatggcgcagcactcggagaatttaaactcggtgggcgcggccaagaatgtacaggccaacgtcacataacggttg

SEQ ID NO: 613084 - DNA, 1053 bp, Homo sapiens
gatgtaacaggcttaccctaactgatcaatcaacctcgtgacactgtgctctgtaaccttgtgataatgtaccttatgacattcttcccctgcccgcaataaacggctcctaactgtaactttccggtgcttacctctaactgataaaactagctccaacccaccaccctcgactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggctagacataaaatctgccaagctgccaatttcctgttacctactccagagacccagtgatatgaagacaccctagctggactgtcagttctcgttaagaacctaacccctcaaagctctacaagcctctgtggacaggatcctacctggtcatctatagtaccccaacagtggtcagtctacagaatcctccccactggattcatcgctccaggataaaactatgcccatctgacgcacagccatagctactccacctcctcctggaagtcacaagtactctctcctacttcccttaaacttacccggattcctgaaaacagagcaaataaccctgtaatacccttgttatttacagtagacctttacaacagtcagccgagtatttaaactctgtctacgttatgcccctaatacaccattcctcagctaattctagaatgccgtgcttttggttctatcactgcagttcacgcattttcctccagaagcattggtagtagatacctccatggagtcaccctccagtgggttacccttaagtctctcatagaagtggcatagaagaccttttgtggaaagtactctccaatttccatctgatgagtcataaaataaaacc

SEQ ID NO: 613085 - DNA, 937 bp, Homo sapiens
aagcgggacacactatcacaccaaaacacccaaaccaacctaacccccaccaaaacccataccgcataagcaccacaaactaccccacagaaagacaaagaacaccaaagaaaacacaaccaagcaatataggcctactaaataatcaagcatctaggatggactccaacatatagctatacaagccccggacccctgaccgggtctcagaagcagatatccagaaagcaagcaacataagtatagataaaatgcaattgggcatttgccaggccccaaatagaaataataccaactacaccagaccaaggaatacttgtagggcccagcagaacataaacaaagaaacacaaaaatgactaacagcaataaggtaccatttgacaacataccccaacaacataacagaaaagacaggaaacaacaaaccaaaaaacattatgtggagaatcagaggtacccagaccctaccaaagtcccagtcctgttggaaaaacaggaagatgggatatacaataaaatatcattcctagatcatctaacttaataacatttctagattatccatttttatttctttttatatcttctttttatcctttattcatatattatatcctgttttatttctatttattatgttattatttttcctgtatcgataatattattttttattatttataacttttttttgttttttattatcttttctctttaaacaatttttttctgtattttatttttatttttttttttttttattttatacttattctttctatttttttcttatattattattttttatattttgatttttggttgtttatatttttattatttttttgttattctttttttttctctttttattttttttttttttttttattttttttctctttttttttctttttttttttttcttattttg

SEQ ID NO: 613086 - DNA, 326 bp, Homo sapiens
acacacattattctctatcctactccacatgtccgcgcccatacatatcatggttagggaaatggcgagaatcgattccccttaaactgcacgtcagcaggtgtatcttatacagtaaactagagacaaaattcatacacaatagtacttaacaatgatcttctttacttggtaaactcacaagggaaacaccttcgcacactgcatttaggtgaaagtatcatgtcactacaatgtcagcaaaacactagaactcacacaactcatcgcaacacagtcgaaacaattcctataatatatttcattcctgggtacaccactcacca

SEQ ID NO: 613087 - DNA, 154 bp, Homo sapiens
aggactttattttgttggacagctccttccatctcttttatcaggttggggggtcacagttctggtaccaaagcccaaatcccattatgcagaggttggggtcttcttagtgaggggaggaagagccagtggtaagatgcttactcgtacacag

SEQ ID NO: 613088 - DNA, 420 bp, Homo sapiens
gggtttgagacgagggatctcaatgtgtcgcccgggctggagtgtactggcgcgtgtcacggctcgctgcggactctgcctcccgggctcgggtgatcctcccgcctcagcctcccattacaggggtgcaacatcatacctgaatagctaatttaaaaaaaaatttgtagaagtggagggtctcacgtatgtagtccaggctggtcttgaactcctgggctgaagtgatcctcccactgcgtggggttagaggcatgggccaccgtgcgtagcactcatggctattcttaataaagacgaacatactggtccgggagcgccgaggcgggcgtatcacgaggtctggcgagatcgagaccatcctggctaacacacgtgaaaccccatgtctactataaaaactagaacacaaagcgggca

SEQ ID NO: 613089 - DNA, 245 bp, Homo sapiens
atccccgcgagttcactgggtagtgtggtgctgaataaattacgagtagggtggtggggtggggtgggtaatgggattcagataagccagaagcatgttgatttttagtttgaatagtaaacattattcagcttccacacgctgctggggaatgtggaatgttctagctcttacatgttaactgagaccagagaagtgcatcatagcctatacgtgcagccctgtctacagaatccttcattatt

SEQ ID NO: 613090 - DNA, 164 bp, Homo sapiens
gagacctggacttgttacattgttctaatcaatggcactactcacacttaccaactcaggacccggctgcgcagtccctcatgatcatgaacaagatgaagaactttaagcgccgttactacctgtcaagtgacccgcatgagaccattgaagaatccttggct

SEQ ID NO: 613091 - DNA, 983 bp, Homo sapiens
  misc_feature (267)..(267): n is a, c, g, or t
  misc_feature (281)..(281): n is a, c, g, or t
  misc_feature (287)..(287): n is a, c, g, or t
  misc_feature (290)..(290): n is a, c, g, or t
  misc_feature (412)..(412): n is a, c, g, or t
  misc_feature (416)..(416): n is a, c, g, or t
  misc_feature (421)..(421): n is a, c, g, or t
  misc_feature (453)..(453): n is a, c, g, or t
  misc_feature (469)..(469): n is a, c, g, or t
  misc_feature (483)..(483): n is a, c, g, or t
  misc_feature (488)..(488): n is a, c, g, or t
  misc_feature (505)..(505): n is a, c, g, or t
  misc_feature (544)..(544): n is a, c, g, or t
  misc_feature (547)..(547): n is a, c, g, or t
  misc_feature (579)..(579): n is a, c, g, or t
  misc_feature (597)..(598): n is a, c, g, or t
  misc_feature (613)..(613): n is a, c, g, or t
  misc_feature (648)..(648): n is a, c, g, or t
  misc_feature (662)..(662): n is a, c, g, or t
  misc_feature (676)..(676): n is a, c, g, or t
  misc_feature (700)..(700): n is a, c, g, or t
  misc_feature (703)..(703): n is a, c, g, or t
  misc_feature (716)..(716): n is a, c, g, or t
  misc_feature (737)..(737): n is a, c, g, or t
  misc_feature (744)..(744): n is a, c, g, or t
  misc_feature (753)..(753): n is a, c, g, or t
  misc_feature (759)..(759): n is a, c, g, or t
  misc_feature (776)..(776): n is a, c, g, or t
  misc_feature (778)..(778): n is a, c, g, or t
  misc_feature (802)..(802): n is a, c, g, or t
  misc_feature (813)..(813): n is a, c, g, or t
  misc_feature (815)..(815): n is a, c, g, or t
  misc_feature (817)..(817): n is a, c, g, or t
  misc_feature (819)..(819): n is a, c, g, or t
  misc_feature (821)..(821): n is a, c, g, or t
  misc_feature (828)..(828): n is a, c, g, or t
  misc_feature (840)..(840): n is a, c, g, or t
  misc_feature (845)..(845): n is a, c, g, or t
  misc_feature (861)..(861): n is a, c, g, or t
  misc_feature (973)..(973): n is a, c, g, or t
gtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcnaacctctgctgtcnctttangcnaacaaactattccctccgcacaactaacctgccctgcctctccatctcgcaccaaggatgcgtcaaaagcacaaaaggctccccggacccggagggggccagaagacatgcagcctcctggntccncatgnttccattcctccggttagactcggaaactttngaccccgttttccaanttttcttataagtngcatngctttgggaaaaaaaanatttaaaggaagcctcttgtttttggaaagggcgtgtcntgntgaattgaacagtgaaaatgttgtaagtgccnatatggggaccacagaannggaaattccttgcanaatgcctcgatgcctgggtgtggggccatgggganatggcatggaaaangatctgttatgccngggcagcccaggggtgaagggcancantgtgggtgaacanccgcaacttgggagtaatgtnccgtgtnagaaaaaangaccangttccttaaaccagccnanaatggggagtgctgtctcccacantttccagggcncngnanantttgtantggtttgttttnttgtntgtatgtgtttaatantgaagtggatcatgagatgtaaagaaaacaataatggcaatgacttatattcaaatctgtatttgtttctttatcaatgtaatctgctgagggccttttgtctaaaatcaantatgtttaag

SEQ ID NO: 613092 - DNA, 107 bp, Homo sapiens
gttctaaaggatgcgtagggatgggagggcgatgaggactaggatgatttcgggcacgatagttcagacggtttctatttgctgagcgtacataaccgagcgtggca

SEQ ID NO: 613093 - DNA, 216 bp, Homo sapiens
cgagtattgggaggtcacgcacggctgcgcacgtgtcgacggaacttgtacagggacggcatgcacctacagtggtgaatacacgtcgaccaggctccatcttaacgatcttgggaggtcagcacggttctcatgtgtcgaaggaacttgtccaggaaggcatgcagcgcacgtggtgacatacacgtcgaccttggtggcactgcatgcatgctc

SEQ ID NO: 613094 - DNA, 274 bp, Homo sapiens
atacagcaaaagcagtactaaacaggaaagtttacagttataagcacctacatccaaaaaagaaatatttatgcaaaatcctcaacaaaatactagcaaaccaaaatcaacgacacgttaaaaaattattcatcctgaacaagtgggatttatcccaggcatgcaagaatagctcaacatacacaaatcaatgtgatagagcatatcaacacaatgaagaacaaaatccatatgatgatttcaactgacgcagaaaattcagtattccttcatg

SEQ ID NO: 613095 - DNA, 703 bp, Homo sapiens
ttgtggcaagacacccagagaatctctctgcaccatgtattccagctggaggtggcgtcagcaattctcggactgcttcctccatcttttcagtgcctcattcagtgatgtcaagttaaaaccagaaacgatgggtgttcaccaggttctggttcttatgaagggacatggatggagctgtgaaacacttcatgctccagtcaaactaatgcaggcaacagaaaaccaagaaccacatattctcacttcataagtgggcagctacacatgtgagaaaacatggacacatgtgggtggaacataatacatcaccggggcctgtggctgaatgctaggccagggtgaggcgcagagcatcgggaagaacagctcaatggatgctgggcttattacctaggtgatgggttgattctgtgcagcacagtcacgcgtggcatcatgtttaccatatgtcgagcaaattctgctactagtcctgcacctgtacccctgaacttagaagtcgaggacgaaatagaatatagattgtgcatagtagtaatttttagcgattacactgttagggtcaatacatttcatacggtttctagcgtatggctcatcttaccctacaaggacatatcgggacatagtctgggggcaaaagagcctgacctttgtgctgtcatgttgacaagtcttgtgaggaaagcggcctggaaag

SEQ ID NO: 613096 - DNA, 608 bp, Homo sapiens
  misc_feature (5)..(5): n is a, c, g, or t
  misc_feature (90)..(90): n is a, c, g, or t
  misc_feature (159)..(159): n is a, c, g, or t
  misc_feature (183)..(183): n is a, c, g, or t
  misc_feature (187)..(187): n is a, c, g, or t
  misc_feature (192)..(192): n is a, c, g, or t
  misc_feature (196)..(196): n is a, c, g, or t
  misc_feature (211)..(211): n is a, c, g, or t
  misc_feature (241)..(241): n is a, c, g, or t
  misc_feature (249)..(249): n is a, c, g, or t
  misc_feature (260)..(260): n is a, c, g, or t
  misc_feature (318)..(318): n is a, c, g, or t
  misc_feature (375)..(375): n is a, c, g, or t
  misc_feature (394)..(394): n is a, c, g, or t
  misc_feature (597)..(597): n is a, c, g, or t
caggntacccccagcccgcttcttccctgcttagcccaaaggaggagacagtagaggtgatgggggcagctgggagggaggggccaaggnagttatgcttttgggtaagaagttgaggctgaggctgggggcacagggaggagctgcccaggtgcagtnaccattgctcagtgacaaaacctnaaancttgnacanagctgaaggtaccanaagggatgataagagtaaaggaaggcaaancgggaagngcatagcaagnaaaagagagctgggggaagggccggagctcagggctagccctctccgctctaactgangacctgccgaggtcgtccgtagcctgtcatgccggcctgggaggcccctttttcgcngcccatctgaaggccaatnaaatgcttcccctcctgcagccggctctctgtaaatcccctctaatgcccctgcgctttcttcataaaccagttgggatctccacggtagtacccatcaatcttggtcactgccaagccgcccaaagccatcagggtcctctgcactgctgcgatgtctttaccttcaaagaggtcaacagtctggaacatgttagttttgangaccccatagt

SEQ ID NO: 613097 - DNA, 419 bp, Homo sapiens
  misc_feature (100)..(100): n is a, c, g, or t
  misc_feature (366)..(366): n is a, c, g, or t
tgtaccagaagtcagcctgtggtctgccaccaatgcgccattcttggtgcacgcgttcgccgccgctcatcagaaagtgatacgctgcctccgagttaancttcgcggtgcgccattgtcttctgggcctggacaagatagaaccagccttcctcagccttgccctctttatgaagatctcgggccatggagagcaggatgccaaccctgtgcagctcgtctggggttagatggaccccccatccgctaacgcgagccccatctgtggtttggtacagggagttccccgaagaacgtccccaaatggttttgcctgatctggaattatggatggtaagaacgatcggacatcttccatgactacgncctatgcgatttctggccatggtcatgtcctcagtcttaactgtccagtcgtg

SEQ ID NO: 613098 - DNA, 144 bp, Homo sapiens
gcccgacatcatcgagtatggtatcataagcatctgcgaatgaagcatcaaaaggatgatgaactgaatcgcagggatcagactgtgcttggttaatattgccatgtgaaaggggcgaaatgtccatatggcagtaatcaaaat

SEQ ID NO: 613099 - DNA, 692 bp, Homo sapiens
cgaaaaattctaggctatatacaactacgcgaaggccccaacgtgtaggcccctacgggctactacaacccttcgctgacgccggtagagaactcttcaccaaagagcccctaaaaacccgccacatcgtaccatcacgcctctacatcaccggcaccggacacttaggctctcacacatcgatcttctactatgaaacacccccgagccacatacatcaaaggccacagggtcaacacatcaaaactaggacagtagctaatattatatctagaccacactctggaactaagacagaaggacggtcaaaagcaatactgactcaagggctgaggcacttgagagaacaatagaaagaagaatgaaaaaagatggcaaaagcataagaaaaggaaggcgggacagacctgagtcatcgatcctgaacaggtcaaccagaaccacaatacagaaccctcacctagagaagcaacaagacgcaactacagcagagccccagtgcaagatgcgaacgtcccagacacccttgcatcaccaaacgacgccgaccatacgaaacgacagggacatacccagacaaagcacaaacagacgaccgccatggcgaccaacacataagagcaatagatcccacagaaactagaccgagacaaccggcagcaacgccgaaccaacccacgcgggaaggaaga

SEQ ID NO: 613100 - DNA, 673 bp, Homo sapiens
agcggagggtcgggaagggggtgagcgggggtcctgggagggtcaaggggtccaaaggggaaggtggtacgggcgccgagctgaagggacaggatggacagagatcgacaacagccttacagctcactggctaactggactgtgctgagaccatggagagaagtctggagatggcgctcaggacccctgaatctgtgtacctccttctctcacctctgggcaggagcaggagggaccatagaagcttacggaggagggtatatggcactgcccagaatccttgacctgggaatgatagatggctggagacacgaactctaaaagcgcttcggcaagtaactgtgtggagactgttcccagcgttcgagggttcgcaacgtgcggcatgattgcgccacacatcccactgttcaagcatgcggccacctgttcgaacatccattgtcgaatgaattggctcccgacctgggctctcagacattcccctggtccaaggccccagggcatcaagatgtctcaggagagtgcggctagacacccgaggagagactcaaagtgaccatgtgcggaacgggatgttgtgcaggtgacaggcaggagctcaggggcggagaggcgaggtcctgggggctggagggggtcgacttggcctgatgccaagaggctgagggtg

SEQ ID NO: 613101 - DNA, 1459 bp, Homo sapiens
  misc_feature (522)..(522): n is a, c, g, or t
  misc_feature (788)..(788): n is a, c, g, or t
ggactcccgctgtgggaagcaatctcctctcctcttcggctccgaccatctcctcgggaggcgggaagcatgtagacatgcgatgagtgcactctaccattctcatcgggttggcggcgcagcgtcgtggatgctctcgacggatttggggcatagttgccgtcgtcggtgtgcagccatcctacctgggcccttggaaacgaatcggtcattcttctaggccgcgcgaatggccatgatgcttgaagaggactatgaccatggatggaggagattattacctttaatgaactttcttaagtgagcactggggagctagggtaaggcgatgtgacccacaggcggctaggtgataagtaagcactttggaaacccgatcagctacagtctcgatcgaaacgttgcggcgaactggcggcgactcgtaaaccgccgcagcttctatccaatatgccttgaaggcaaatttcagtcacaagggcataaatgacaaagaattgctttcgccaattatatctagtncgcccaaggaggtgacagctacgaaacaagttttgggcaaatggaccgattcagattcgaccatcgagattgtttcgtagcctgataggtatcgagcatattgcctagaggccagatgcaccgatagcaactggaggtcctccccaagggtgatatcctttcgcgcgtgtttccgactaggggccatatctaaggctgaggggaggaaactgtagaggtgtcctcgggcgactttgcgaacaccattaccggcgttgggcatccanttgggggaagaaccaggtgcttgctgcgagagtttggacctcttacttgtggcacacgagagaggatcgcatagggccataggggacggtttccttccttaaatttgatatcgccgcggaccggcgcctccccaaaggggtttattatcgccagcaaggggccttaggtaaggattattagaagggcccctcattaacaaaagcttcccccagtttccccgtgcaaccacaaaagcccacaaggcagaaaacccattgggtatgggcaacgtacctggcaatttagttggtccatttacacgtggggtaatggaatcaatacttgactgtggcccaatttcctatagttagaagcgaatttctctcgggtgcaggttacagtgagaacacccccttcccggtatggaattggggatagcagatttcccataagacctttaattaacctttagagtccccttggacacagtatagggaggtgtgcaaactcacatggcggtgtccgaacaacattgtggttggcgttccccttgccgcaaagtccataaggttggggctatttctccccctttgaaggaaatgtttgtggcacttggcgaatgaccccccttggaagaattggtttttgataccctttgagccgggaacattttcccaggagatgcgaaccg

SEQ ID NO: 613102 - DNA, 177 bp, Homo sapiens
ttatattcgtaaatattctgtttaatttgtctggcttacgttccaccatacagtgacggctagcagtaaaatctgatttagaaacagataaaacaacacctcaggccacaacacaggctgtgaagacacacacacacacacacacacacacacacacacacacacacacacacaccc

SEQ ID NO: 613103 - DNA, 373 bp, Homo sapiens
tacaactatccaccatttggcaaaagactcgaattgccacgagggcgctgcctcgagaatgcgtggtatctgccctgatacactagactacttgactatacagctgtccagacaaggaatcctaccatatcctcagtcatctggctcctgcatccaataaccattacacaatacactgccggtttaaatgggcagattcaatacctcaactcgtatcatgacattttaaccaccgtcttaaataggcctccagtctatcttataggctataaagccaaagccaggcagaaaagttcttctcacagcacaacctgctttaccaggttttagtatagctgttcatttgcttgtttggtttttctgtcacccaggc

SEQ ID NO: 613104 - DNA, 220 bp, Homo sapiens
cacgagggcgactcggcagccggagctttgccacgatgagtggggcccattacgcgtcaaaacctcaccaccagggagtagtttcaccaattcctgggagccaaagggaacgagaagacttgccgggaaaccgacttaggaaaccctgctggcaataagctggctaaacctgaagataaacggttacgactggatgatggacagacggcggacgggcaga

SEQ ID NO: 613105 - DNA, 342 bp, Homo sapiens
tatactggatttgtgtattccaccactctggaagactaagggtggtatgtacaactggaaatgctgatccatcttattgattgattgatggagtttatgctctattcacacaggctggagtgcagtggcgccatctcagctcactgcaacccctgccttccagtttcacgtgatactcctgcctcagcctctcgaagtgctgggattacaggtgtgggccaatatgcccagcctcagccattatcttcctgtacctggaatttgtgatataaagaacaatgtacagccaatcaatagcttatattactttaacataaattcttttattattattcatgagac

SEQ ID NO: 613106 - DNA, 103 bp, Homo sapiens
tccgtagaatcagaagcagtgacaggtgtgcttaagatgactctgcaatcacaccaatgtgtgaagtgacaggcgggcgtacatattctgtgtgtgctccaag

SEQ ID NO: 613107 - DNA, 227 bp, Homo sapiens
tataaatgtgtgcgtgctcactctctgattttaaggtcacgataaaatagaaacaatcgtcttccttaatgctgtgactgggcgaggttgggatggtttagggatctggatgttacgacagccaccgctgtcctccaaacactaggaaatgtggtgctctggctgctgctgtgtgtgcggaggaccaagcaaattaacattgagccagggcactttgaagggactgg

SEQ ID NO: 613108 - DNA, 430 bp, Homo sapiens
aacctccacctcccgagttcaagcgattctcatgccttagcctcctgtgtagctggaattacaggcacacaccaccacacctggctaatttttgtatttttagtagaggcgaagttttaccatgtcagccacgctggtctccaactcctgacctcaaatgatctgcccgccttggtctcccaaagtgctgggattactcgtgtgagccaccacacccggccaaaggtgtttttttgttttgttttgttttgttttgttttttttccagcaaacttgtttagaggaagacttagtccaaggaataactccatcctctctttgcctcgaatgttacaaactctttgcttaactttttttttttttttgagatggagtctcactctgtcacccaggctggagtgcagtggcgcaatctcagctcactgcaacc

SEQ ID NO: 613109 - DNA, 395 bp, Homo sapiens
gggctggtagagaccggatagccagtgtagcccagtgctggtctcaaacctactgggctcaaacaatcctcctgcctatagcctcccaaaatactgagattacaggtttgagccactgcgcccggcccaactttgtttttttttttttaaaagagataaggcctcactgtgtagcacagccgggtcttaaactctggggcccaatgtgatcctcgcacctcagtgtctcaggtggctggcacttacgggtgcttgccaataatgggctcatattggctttatccaaaaattcatataaggggatttatacggtggtgtcgggatggtacaaattcgcataatacgttgggcgactcatacatgtggtatacatgtagtaggtccctttccatggc

SEQ ID NO: 613110 - DNA, 313 bp, Homo sapiens
tttagagataggatatcggtggggcgtgatggcttatgcctgtaattccagcactttgggaggccgaggctggcagatcgtttgagctcatgtgtttgagaccagcccgggcaacacggcaaaactccatctctactaaaaaaagaaaatacaaaaattagctgggcacgatgacgtccacctgtagtcccagctactcgggaggccgaggcgggaggatgactcgagcccgagaggttgcagtgagccgaaattgcatcaccgcactccagtctgggcgacagagtcagacctcgtctcaaaaaaagaagag

SEQ ID NO: 613111 - DNA, 1719 bp, Homo sapiens
gcaggggctcagcaccgagagacgacgctaggcctcggcgtcggcggattggccgcgcctgagctaggtgagttggtctgacaacaccagatggacttgatgactggtggtccggtgccacgctctatctggcaaccgaggtccgtctgatggtggacactgggcgaggtcacgccgtgagcgcgaggcacggccctcaccgagtgacccgccatcttcactcacttctcagtgcgtcgccgtgccgcgcacaggacatcgacatcgtaggggcacgttgcagtgtgcatgagagcgacatggtgtgtcacgcacatgagcctcctgatactgagtgtgccgccgtgagtgtatggccaggacgcacgaaccgggaaagaacctgccgaggatgccatgacaggcgcccccgaacccaatagggccatcatgcgggtacgcacacatagtgtgcactgcggaaacccatcgcgaaaacagtggaggcgacagcgggaggcacctgggggatggcgcgagactacacggagggcaccacacaggagcgacgacctaacccccgtgccgaaggaccaagcggcgagacggactgaggcaatctccacggacaaggggaaaggaccagcaaccgaccagaatagacgaggtacataggacggggcgggagagcagaacgaccttcaggaaagcaaacaccacatccggtcacccgcgctaaggagaacacaccgtgtgccgcgcccacaagcgaattggcacgccccccaacggcaaaacctagagaggtgtgattacgaaagaaccgggggtcaacgacccatgcagcccatcgggagggatcaccaagatgcacacaacggcgcatatggacatacaactccccaaggccgacgacggcgtcgcccaaacaggggacaccccgaatgaggatatacagcccagacggtcactgtcggcacccaggaataaacatcccaacacttatgcggacacgaaccgtgcccaagttggcatatagcgagaagaaccccaccagcacgtaaacacgcgccacatacgtgcggaggacacgaaccaaccgcgacacgcgattcgattgtgcgggcaccacacagtggtcaccgtaaatccggcaatgtaggcaagtgaacccatgtggccacacggacgaaaaccgacagaccaacgatagaggggcagcggaggcagatagccacaattggagccgacaaccaacaggaccgcaccaagatgcgcaaagggggacacacactgtgatgaccgacctgatcagccagcaaagatgcccctatgcggatcagcactagcgtgcatagaccatgaaatcgatcagataaagtggataaacacaacacgggaaaaccatccacgcacagtacgacagatagcaccgacacgaacaacaaccaagtcgtatgagagtgccaatcgataataagtacagagatgagagatatatgcgacacataggacacgaacggagagcgacgatacagtcgagacacgacacgaaagagacgagacggcaccaacaaaacagacacgcgattgatacagagtggtgaaaagcggaagaattaagagaagagcgagcagcgagaatcaagagccaaggtgaagattgacaacaccacgaagaagacaccaccaggttggacgaccctataaagagacagaccaccaagaacggagcaaatg

SEQ ID NO: 613112 - DNA, 424 bp, Homo sapiens
aaatggctgctttaggaacgtctgtcttttacagttgtagataagggatgaaaaaagtcccggtctcccgttgcgctcccaggcttattaggaagaggaaattccctcctaataaattttggtcagaccggttgtctgctctcaaaccctgtcccctgataagatgtcatcaatgacaatgtgtgcctgaaacttcattagcaattttaatttcaccccgtcctgtgatcttgccctgcctccatttgccttgtgatattttattaccttgtgaagcatgtgatctctctgacccccaccctattcatacactccctccccttttgaaaatcactaataaaaacttgctggttttgtggcttagggggcatcacggaacctgccaacatgtgatgtcttccctggacaccaagctttaaaattt

SEQ ID NO: 613113 - DNA, 339 bp, Homo sapiens
ccatctctactaaaaattcaaaattagctgggattacagacatgtggcaccactcccggctaattttgtatttttagtggagatggggtttctccatgttggtcaggctggttttgaactcccgacctcgggtgatccgcccgcctcggcctcccgaagcgttgggattacaggcatgagccactgcgcctggccttgatgtcttaataaaaaaataacaccagtaagatttgatgattatgttgtgatagagttggctttctgagtcccattgatggcagtgaaggctatatttcagtcaaaaacatccattatatcccacctctttacagcctgggg

SEQ ID NO: 613114 - DNA, 979 bp, Homo sapiens
ggatcggagacgtcctgcgtgtcgggacgtggctgatgaactgccggggcggtgctgaactgttaagctgaaagagaaggagacgcaggcttggggaggagtccaggagcccagcactaggtgacaacatccgggaattcttgctgagcgctcagatactttcgaatcttcatcgccctgtggaacatcttcatgatgttctgcgatgatgtgtgctgttcagggctcttgaatcccagcaggatgtaagcgcaggaactctactttcccgggatgccgagtctccattcctccattcctgatgactgtcacgaatgtttgtggaccagaaatagccgagcaatcttcccagaagagtccagaagctctgtggtgggtggataagagtgttcgccaaggtgtgcatggtttcccagccacgtccctgttgttcaaggatagtgtcacttttgggtctctgataagttgaagagtgctgtctactgaagagggtttcaggagcgtttatgtagaggggctgtgatgaaattgattccccatagataaagagaataatcatttctatccagagatctgagcagaaggatgggttgttaggtttaacacatgccggttgaggacattcagtgtgacttgcgtgagtctgacagactctggggccggcaggggcctgttaacaaagtgttttcaggatcccagacaagggtctggtggcaatcaggcagtgcgaataaccctagggttaaggaagggccaactgtaacagagagcagcttcgtttgaccgtaaatgttgcagagtgttgagtagtctgcgagtgttcccagagcattgaggtggggggaataggagtgactgatggccctgtacttagattgtgacttgtaaaatgataaagaagagaaaaaagtacagagaaaaaggggtaaaaggaggaaatgaagatagaagaagaagaaaggatggacaacaagaagcc

SEQ ID NO: 613115 - DNA, 417 bp, Homo sapiens
  misc_feature (17)..(17): n is a, c, g, or t
  misc_feature (31)..(31): n is a, c, g, or t
  misc_feature (71)..(71): n is a, c, g, or t
  misc_feature (87)..(87): n is a, c, g, or t
  misc_feature (263)..(263): n is a, c, g, or t
cagcacacacagcagcncacacacagcacancagcagcagcagcagcagcacagtagtaactaacgcctancactaacgctggcgancacagcatctttaccagcagttcttaacctgtgggtataaacccctcagggtatctactgaccctttcaagggctcaccgaagaccatccgaaaacacagatatttatattacagttcagagcagtatcaaaattatagttgtgaaataacaaccagggctggagagatggctcanaggttaacagcagtgacggctcttccacaggtcctgagttcaaatcccagcaaccacatggtgactcacaaccatctgtaatgggatctgatgccctcttctggtgtgtctgaaaacagctactgtgtcttcacatacattatataaataagta

SEQ ID NO: 613116 - DNA, 1213 bp, Homo sapiens
  misc_feature (716)..(716): n is a, c, g, or t
  misc_feature (718)..(719): n is a, c, g, or t
  misc_feature (722)..(723): n is a, c, g, or t
  misc_feature (725)..(727): n is a, c, g, or t
  misc_feature (731)..(732): n is a, c, g, or t
  misc_feature (734)..(734): n is a, c, g, or t
tgcttaacatgttgagattaaatggagaaagacttaagcttttacttttgtgattgacacttgcttcaataatgtaaccttgttctgtgtttttatcatttattaacaaatttcttttttcttaagggaagcctccaaaatcaaagaaaagtgagttacaatccataatgaatatttgccttaccagcctactggaacacattcatcaagaacttaagaggaagaaagttttctgccttcctccttcctagtgctctcagctatcaactttgaaataagtttaaacaacacctactgaaaacaaaaaccacttagtataaaaatatcccccaccagaattgggtcccccatatcatttctacaaaacagttctggagtggatcaaagtctcatcagatcagcttgccccttcttgtttgggcaggttctaggagaagctgctgtaatacaaaaactgaaagatgaaatcgtaaagctagataatgataatgatatttagtggggaaggctacagtatgttttcccataggcatttaaacactcactttttccaacgctttatactttgtccctatagcctttgtaattttaactttgatgacagtttaacttaggataacctgaatatgggtattactgttagtcatttgtatttttatcatttaacattttaaatgaatgtttaatttgctgggttgagtaatgccaagggaatnannctnnannnaaanngntgtgaggttagtaaaagattaaagttacaatttatgatacgagaacttcttactataggaaagtaggtaaatgaccctaaaaggttttctcagaaggtaaaagttttacatcagtctgaagacatataactctaacatttcagtttagttactgaaatgactttttctggtgtcattgagatactggctgtttgttccaagccattttaggctgagaatgactcttaaggtcttctaatgcatttcagagggttctagaaacaacaaactgaacatgatatgaaataacaacatagaatggccccgcatatactctggctacagctccttatcattgaaacaatacaatgtttgtcttttggcacaagcaaacagaagaccagcatgaactcgaacaacacaaaccaacacacacgcgcgtaaaacaagaaactagggggcgggagagcaggcagggagaaggggaggttgtcaagacg

SEQ ID NO: 613117 - DNA, 208 bp, Homo sapiens
ctcggcatgtacgggtaccgtgtctagggaccttctcaatggctagtctctcaggtcttcctgcagcttgacgtctctttcaatgaggctccacttgtgcaacgaggacaatggacatcctttggtggaaagcactgttctcatttacggtgaatatcttgttcatgtccctaaaggcctgtatgacagatggcccggtacatgacca

SEQ ID NO: 613118 - DNA, 977 bp, Homo sapiens
atgaaacttcggctcactccttggatgcctgcctgatacctccaaatcaccacaggactatgcctacccatgcactactcaccagacgcctcaaccgccttttcatcaatcgcccacatcactcgaaaacgtaaataatggctgaatcatccgctagccttcacgccaatggcgcctcaatattctttatctgcctcttcctacacatcgggcgaggcctatatatacggatcatatctctactcaaaaacctggaaacatcggcattatcctcctgcttgcaactagtagcaacagccttaccataggctatgtcctcccgtaagagccacatatcattctgagtgggccacagataattacaaaacttactatccggcatcccatacattggggcagagctaattcattgaatctgaggaggctactcagtagacagtcccaccctcacacgattcttatacctttcacttcatcgttgcccttcattattgcatccctagcagcactccacctcctattctttgcacagaaacggagatcaaacaaaccccctagagaatcatcctccacataaccgataaaatcaccttccacaccttactacacaatcaaagacgccctcgagttacttctctatccttctctccttaatgacattaacactattctcagcagacctcctagggcgaaccccaagagaagttataaccctaaggctaacccttaaacaaccccttccctaaatagcccgaaagatatagtacttattcgcgctacaaaatgctctgatccggccctaagaataagacagggtcctgaccctatacaaaacatcagtctaagagatcccatctcagataccaacaaaggtaaattggcgtaacacaagattggactacggagacccttcacgaaggagaccggaacttgacgaagatagataataatagaacacctggaaaggaaaaaaaaag

SEQ ID NO: 613119 - DNA, 943 bp, Homo sapiens
acctgagaaccctgaagggcagacaggaggggacggggcgctgcggttcctcggccgggagggaaccctgtgtgtgtctcgggctgtgtatgcgtgtgtatgtagcggggagcgaaggatcgctctcaagcagcggcccaagagtcagcgcctcctcctgagaaacacccgcgggcggagaagaaagcgagtgggtatgttgatggggggcggccaaacttcctgtcccgctctggagctgcttccggcgggagccggaagacgccgtgtgtggacgggattcggggctgactgacggacggacggctgcccgagactggaaggttaaattgattaccaacctagttcagcatcttacaggaaaagtgtaatgctttttaaagggatatgaatataacaggaaggtgtcattgactgaattagacttgaacctgtccctgatcagctacaggatttcagaagctgaatcaatgttatcagatgagttagaatccaaaccagagctcctggttcagtttgttcagaatacctccatccccctgggacaagggctagtagaatcagaagctaaagacaattacttgcttatccctccttccagtgaccgaggcctcagaatgccagcgactaatgttaccagatgaaactccccaaatcatggctaaattcttcccaaggagggtgccctttcttcagctggtttgagggagcctcaggtgtaatgtgggcccaaggcggaaaaagaacagggggccccatgtgcaaaaagtctcccgaggtctgggacaccgaagtgcctctaccgggggaaaattacgcgcaggaatggcctctatctttggggaccaaagaaaagggggggccccccgcacacgggggtgtgcgcaagaaacagcggcgcgccctctcgcggccaccagagaccggtccggtgaggccaaaa

SEQ ID NO: 613120 - DNA, 443 bp, Homo sapiens
cacagcagataggcactatgattggcatttagattgattccatgtctttgctattgtgaatagtactgcaatatatatgcatgtgcatgtgtgtgtctttttaagagactaatttatatttctttgggtatataccaagttatgaggttgctgggtcaaatggtaattctgcttttagttctgtagttctgtgaggaattgttacactgcttttttttgactgagtcttgctctgtcacccaggctggagtgcagtggcatgatcttggcctacttcaacctctgccttccaggttcaagcgattctcctgcctcagcctcctgaatagctgggattacaggtgcctgccaccacacctgggtaatttttgtattttagtagagacggggtttcaccatgttggtcaggctggtcttgaactcccgacctcaggtgatccacc

SEQ ID NO: 613121 - DNA, 151 bp, Homo sapiens
gcagcaaggtggcatttgaagctggtttgaagatcaacaggtgggtaacattaatccatatgggtgagtgggggagtgcaggtggagcggtgaggccgtggccagacgtgtgaactcacagatgcaccttttaggactacagtagggatga

SEQ ID NO: 613122 - DNA, 427 bp, Homo sapiens
  misc_feature (11)..(11): n is a, c, g, or t
  misc_feature (36)..(36): n is a, c, g, or t
  misc_feature (91)..(91): n is a, c, g, or t
  misc_feature (140)..(140): n is a, c, g, or t
  misc_feature (157)..(157): n is a, c, g, or t
  misc_feature (261)..(261): n is a, c, g, or t
  misc_feature (280)..(280): n is a, c, g, or t
  misc_feature (283)..(283): n is a, c, g, or t
  misc_feature (422)..(425): n is a, c, g, or t
  misc_feature (427)..(427): n is a, c, g, or t
attaacctcantgagcagggggtgaatttgaagtanaaatgggggcaggttggcccctaagccgttccccagcttgactttccccctttanccctagtgatttggggggccccaaggtttattttccctttcgccgttanttcgcccactaatgtgnccctggtgtcttctctcctcagcctgtttctcatccctggaaactgaggttgtctggcgcagggcgatagcgcagtggggtggggttgggaggaaacccttatnctgtgcgatggccctccgntgntctattattaaaactctgggaaactgctattcttaatttatttttaaagaccctgagaagcaaatctttaatttttttttttttgtgagatcgcaccattgcactccagcctgggtaacaagagtgagattccatctannnntn

SEQ ID NO: 613123 - DNA, 377 bp, Homo sapiens
  misc_feature (4)..(4): n is a, c, g, or t
  misc_feature (9)..(9): n is a, c, g, or t
  misc_feature (22)..(22): n is a, c, g, or t
  misc_feature (32)..(32): n is a, c, g, or t
  misc_feature (42)..(42): n is a, c, g, or t
  misc_feature (49)..(49): n is a, c, g, or t
  misc_feature (64)..(64): n is a, c, g, or t
  misc_feature (70)..(71): n is a, c, g, or t
  misc_feature (87)..(87): n is a, c, g, or t
  misc_feature (117)..(117): n is a, c, g, or t
  misc_feature (122)..(123): n is a, c, g, or t
  misc_feature (128)..(128): n is a, c, g, or t
  misc_feature (131)..(131): n is a, c, g, or t
  misc_feature (142)..(142): n is a, c, g, or t
  misc_feature (162)..(162): n is a, c, g, or t
  misc_feature (167)..(167): n is a, c, g, or t
  misc_feature (170)..(170): n is a, c, g, or t
  misc_feature (180)..(181): n is a, c, g, or t
  misc_feature (188)..(188): n is a, c, g, or t
  misc_feature (212)..(212): n is a, c, g, or t
  misc_feature (241)..(241): n is a, c, g, or t
  misc_feature (243)..(243): n is a, c, g, or t
  misc_feature (258)..(258): n is a, c, g, or t
  misc_feature (265)..(265): n is a, c, g, or t
  misc_feature (280)..(280): n is a, c, g, or t
  misc_feature (285)..(286): n is a, c, g, or t
  misc_feature (293)..(293): n is a, c, g, or t
  misc_feature (304)..(304): n is a, c, g, or t
  misc_feature (307)..(307): n is a, c, g, or t
  misc_feature (363)..(363): n is a, c, g, or t
tcanttaanttttttaatgggnctaaaaattntgtgaaaaanttttggncaagttgtttccatnaaaaannaatgattttaaaaaanaaaaaattaaaaatgccaaaagcaaaaaanaaaannaaagnggnccaaaaaaaantctcctttccttctgaaggntttangangcattgttannattaaanagttttttaataaaaaaattaaangggcaattgaaaaaaaaagttctgagaangntcttccaccaatgantaagagnggggggggagggatnagggnnaaaattnatttagccttntgngctttctggggagaattggggaccttgccagccccagcagcctttttgtccactgntttgatgaaaccca

SEQ ID NO: 613124 - DNA, 479 bp, Homo sapiens
cggtcctataagtttagcccctgttaggttctagcacaacaggttgatattagttccacagtatggctcggcattgaaaccactaagatcgcacgcatgctctgatgagacgtgttcaatctgcattcactagtgtacgcatcagcaaacacttgacaaagacatgcccgttgccatatcaacggggtaaaggttccagtattgtttcctcagacagcaccttgtaagttggcaagcatagtaacagcctgcttagccggtatacatgcatgccaaggcattaggcttgggttcacacatcgtgtaaagcaagcggcagaatccttccgacccacgtttctctcacatatctttccaatcaataggtctacgtataggaagtttccgaaaacttcgtgtcatggtctgcacatatatgttcgtgtgacagagtgctccccatgagggtttagatgtatactctatgtcgaacaatcgct

SEQ ID NO: 613125 - DNA, 848 bp, Homo sapiens
cgtggtggctcacgcctgtaatcccagcactttgggaggccgaggcggcgcagatcacgaggtcaggagatcaagaccatcctggctaacatggtgaaaccccgtctctactaaaaacacaaaaaattagccgggcgtggtggcaggcgcctgtagtcccagccgctctggaggctgaggcaggagaatggcgtgaacccaggaggcgtagcttgcagtgagccaagattgcaccactgcactccagcctgggcaacacagcgagactgctaaaaaaaaaataaaagagaaaatcattgaggagaaacgctatctgcctaccgggtctcaaaatgcagaatgacggtgcccgtatgccgagagaaacaaaaacaaccaaaacacagagcaacaacaagttgtggcggcgagcctcgagccccaccacccgacacatgacacacaacaaacaatagaggggacgccgcggcgacaccaacagaaagagaagataaaagaaggagaacaaaagggaggacaaccacggaaaaaccaccggccagacaagcagacaagaagaggacatacaccacccatcccaaaactgcaccgaagcacactcagaggcgacgcagaagcagaaaacagatccccaaacacgaagcaacgacggcgcggcggcaagaacaaacaaagacgaacaaccaacagaaaaaagcacaaaaacacgacccaccccacacgaacgccaaaacacaacgacgcaacagccggcgaccgcacgaaacacacacaacacacacccagacagcaacatacaaacaaacagacacgacccagcagggcaaaaaagaagaaagagggaaaac

SEQ ID NO: 613126 - DNA, 748 bp, Homo sapiens
gcagtggtttgcccccagcgcgcgaggctggtgagtctggcagcacctgttggtagccggagggctggtttccatggttgcgcgattatgaaccatgcagctgtgtgcatgctcgatgggccagggtgtgtgcgtcctatggtggctacgagcagtctaggaactgcaaggcctgagcctggggccagacaccctggtctcccggccatggtcaacgaacctccaagtacctgcgcttactgtgggcctcgaggtaggtgggctcaatgtcttgtgtaggacgtgcccgctggctggtgctgcagttatggggtgctcttctgttaccagtcctcctttcagcgtctggggttgtcttgtcttccatctatggactccattctactattcctatatttccgaccagtctagccgaccattcagcccgtgtgcgatttctactacaggaccgactgtgattcctccagtcatctcactctgactccgtttccctgttgccaattgtctcgactgagctaaagggtggacagttgatcgggtgctgatggtatggacaggccgtatcgtgttagcttaggagcttgaagctgccagagtgccctgtgaatcaagatttgggcatgttccttggtcaaccatttcctggtacaccagaaggtggccagaatcatcttccactttcttcgcgttcgggtgatgctgcattaccgggtcagagctgctcagatgctggacacagttggttctt

SEQ ID NO: 613127 - DNA, 154 bp, Homo sapiens
tcatcgagctcggtccctaattatgcacaattacctgggggtggtggtgcgctcctgtaatcccagccactaggaaggctgaggaaggagaatggcgtgaacctggcaggcggaggttgcagtgaaccgaggttgcagtaagccgagatctcaa

SEQ ID NO: 613128 - DNA, 122 bp, Homo sapiens
ccgaggacacagccgtctattactgtaccacagacttggggggggcctattgtactcgtggtgtgtgttattacgagacttttaaatactggggccagggagtcctggtcaccgtctcccca

SEQ ID NO: 613129 - DNA, 145 bp, Homo sapiens
gctcggtaccggtctgctgatgtcaacattctgacactgcagcaatctcctgggattgtccctcgagtcccatatcaactcaggcgagtgcttcattcccgtcctactggcgctcgtgcccgtgcgctgaggcattgctcgtagt

SEQ ID NO: 613130 - DNA, 193 bp, Homo sapiens
  misc_feature (4)..(4): n is a, c, g, or t
gacntgggagaggtggtgggccaggcaagacaagaaaagggattagggttggaagtttgacttccaatttgttctgtgtctagtcctttagatgatacatttgttctatctgttttctttttattggcaatgctttaaaaccttgtatctgtcctgcagagttacagtctttctctcaggaagctacagcggg

SEQ ID NO: 613131 - DNA, 258 bp, Homo sapiens
ggtggcaacacgttggtcttcccaatagtgaacaccatcaccatgtgacccagaatttccttccttttccagactgagtaatactccagcggggtgtactgccactttgtttgtctatgagccatcaacagacacagcctgtttccacatttggtcactgctaacaacgctgttatagacgtgggaatacgcacatccgcttgagtctgtgttcagctatttcggatacataggcagggcggaatcctgtgttaaaat

SEQ ID NO: 613132 - DNA, 316 bp, Homo sapiens
agctctttgcctgtgtgtgcgataccagttgcctccctgcttgaataggcctctcctaggctaggccggtgttcagaggcatgccggtctgggctggggacgggcgtcttctgaaatgggagttaccaggttttaaaattctgctattgtttaatttaccatttaaggtcttttctataatatctaagtaactagtcagtttttcttacagtgctcatagcatttgtatttaaatggtatttccagtgaaattggtttaacattgccatttaaaattggcctttaacagcttcccaacacggctaccgggataacg

SEQ ID NO: 613133 - DNA, 102 bp, Homo sapiens
cagccggtaccagcttctctttgtagatagctaataaaatcacttaattcacggcaccttcatatttctttggatttagcttcgtgttggcttccagatggt

SEQ ID NO: 613134 - DNA, 408 bp, Homo sapiens
  misc_feature (137)..(137): n is a, c, g, or t
  misc_feature (140)..(140): n is a, c, g, or t
  misc_feature (185)..(185): n is a, c, g, or t
  misc_feature (237)..(237): n is a, c, g, or t
  misc_feature (255)..(255): n is a, c, g, or t
  misc_feature (276)..(276): n is a, c, g, or t
  misc_feature (302)..(302): n is a, c, g, or t
  misc_feature (308)..(308): n is a, c, g, or t
  misc_feature (326)..(327): n is a, c, g, or t
  misc_feature (343)..(343): n is a, c, g, or t
  misc_feature (349)..(349): n is a, c, g, or t
  misc_feature (356)..(356): n is a, c, g, or t
ggcacgagcatcttatctaacagggtggccctcccctagctacagattccagccactctcggtcatgaaaacaagggtaactaatattagcaacaagcgggatggaacgaacgaagtgaaatgggctttttcacgtnttnctccttggataccactcggccagctataaatctatccctataacncggcttcatggggattttattaattcaatagcagcttaatctaaaatcgganggtcctaatgataatgangtttctagagccaagccacanggctctttctcaatctggtctcttangggtcncaaagtctctaaggagannactaaattaacaagtnagccangcatcgngtaaggatgtcgggccggcacgagcatcgtgagagagaagcacatttggatg

SEQ ID NO: 613135 - DNA, 593 bp, Homo sapiens
  misc_feature (2)..(2): n is a, c, g, or t
  misc_feature (477)..(477): n is a, c, g, or t
antcacaaaagggacaaaaccagggcagttttcgccggtatcgcttgtagcgttggagctgatcgccaacacaaaaaaagacccacgcttgctactggcgtacttagggttggccaggcatacgaccatgagggatttggacggccgtggccctaacatgctgactggtgccggtgcggagaaggtcagggtgctgacaggctgtggaacgcctatggccacaggcatagttaacgccttagccggcatggggctgatcaagaagccagcggcagggctaccacccaatcaggcccgatgggcgatgcagcaccaaggaactgtgaatattcctcatgcgctgatagacggtgggataggaaatgcggacggcattggtcgcttattgaaagacggggccactgatgaggttgtcgtctgcgctgttatgttgctgattaactgttacgcagtgcacgatctagaaatgttcggcgngattgatcaccagcagatatggcgacattggaaccatatggtcagctctgaggctgaaggggtccgggtgacggctgagccaatcaacgacacagcccaagcaaaatttatcagca

SEQ ID NO: 613136 - DNA, 198 bp, Homo sapiens
tctcacattggatgattgtcataaggtttttagcatgttcctccttttttccccccctttttcataacaagaactcagtaggaggtggttccaggtagatgttcctcagcatttcataaaagtgtttattaatcaacaactctcaccatgatgtgaagagtttccaaatctttcaaaataaaaagtaatgacttagaa

SEQ ID NO: 613137 - DNA, 121 bp, Homo sapiens
gagttgtggtgaattggagtcccagtcagttgttgggtgttaacccaactgttcaagggctgcaatcagttgtccgtggtcacccctgtattaagcttttggcgccaatgggaccattctg

SEQ ID NO: 613138 - DNA, 220 bp, Homo sapiens
  misc_feature (197)..(197): n is a, c, g, or t
cgcctgcctcagcctcccaaagtgctgggattacaggcatgagcaccacgcccggccaggcatggggcattttagctggtattgttccatccaccaaagggggctgcagcagaccctggaggggcagagtctacgacctgagaggcacagagcagccagccgctgggtgtgggctgcccaagataatggggaaggtngccagaggggcttgccctgcccc

SEQ ID NO: 613139 - DNA, 523 bp, Homo sapiens
ccgaggattaccacctgctcatcactcgcgctgatgtcctatcccctcatgtggctgacatggactgctggcctgtgcgccctgtgtttggccaccgttgtgcccttaggggtccggcgcttgaggtttacaactggtatgactgagtgtatcctgcggtggctggcgtgctgtgcatggggcctgctcacagacagcatggagcagggaagggctgtctgtgcccatgctcagcatgccttgaggggaggaggtgatggccatgggttcctgatgtcggtgcaggagctgaaggtaagtggagtgctgacaagaatatgcccgactccccaggacaagacagaactttgtaacaaacagtaccaattgataaaggccgagagtaaaagctataatataccagttaatgacttagtgaacattcccaggtatagaagcctctgtggccttaaatgtggctcagtgaaagagagacccagaatagccaggacagtatgaagcacttcacgcacagcactcagaa

SEQ ID NO: 613140 - DNA, 257 bp, Homo sapiens
agacacaggctcaatattgttggtagtgaggaaacataagcactaaacactatgctgtcgcaacagattgccttgtgctgtctctgggcagaataaggactggtgacttgagcggggtggtccgcagtgtacattatattccagtgggaaactgcttccaagtttaagcattagctccccctaactggagaaaacatattttgcttttctgagaccactatcataatacagacacttgctctagatggcaccatgtg

SEQ ID NO: 613141 - DNA, 441 bp, Homo sapiens
cttggctcaccgcaagctctgcctcccgggttcacaccattctcctgcctcagcctcctgagtaactgagactacaggcgtccgccaccacgcccagctaattttttgtatttttagcagagatggggtttcactgtgttagccaggatgttctcaatctcctgacctcgtgatctgcccgccttggcctcccaaagtgctgggattacaggcgtgagccaccgcaccacacccagcccacattgcttgatttttgaatgttgaaccagtatggcatacttgggatatatcccacttggtcaaagtgtaatttttatacattgttggatttgatttgttaatattttgttgataatttgcctctatattcatgagaggtattggtctgtagttttcttgtaatatctttgtctaatttgggtacccttctgtcgtcttctc

SEQ ID NO: 613142 - DNA, 80 bp, Homo sapiens
cttgcccctacttttcaacaattttctatgttagtcgtgaagaactaaggtgggagcagtactacaagttgagtaatggt

SEQ ID NO: 613143 - DNA, 101 bp, Homo sapiens
tcgcaagctggtatcactgcaactccacctcccaaagtgctgggattacaggcatgagccactgtgccgggtctgttactttttaaaaaaaagggcggccg

SEQ ID NO: 613144 - DNA, 101 bp, Homo sapiens
ccgcgcggatatgctggagttaaaagggaagttgtatctccttcatcaagactacttgccagtgggtccatactgcaggaagatgaagcatacacactgct

SEQ ID NO: 613145 - DNA, 438 bp, Homo sapiens
ggatcggagagcggtatccatcgcgatacaccctggccgagatacctgtgatggctgtgacccacagcaggtcagagctcactttcaccttgataagaaaggtgaatgtgagtaaggtccaacactaagaagaacaagattctggaaataagaaagataatttgtaaacatgtgagtcccctatggttaacagaatacagactatgaagatgaatagacacctagagcgtccaaaatataaaaatagcagctggaaaatgtagtgagaagataggcaagtgaaggaactttccaaaaagatgatgcttctgcatctattcattctgaaattactgacagcaacaaaggtcagaagacgttgaagaagatgggttggaaaaaaggagatggactgaggaagatgatgggagaatgaaaactccaatttagtgtacagtt

SEQ ID NO: 613146 - DNA, 237 bp, Homo sapiens
  misc_feature (117)..(117): n is a, c, g, or t
gtaagcttatgctgtagatgagttacagactgatgggttcatttgttttgtttttgagatggagtttgctctgtcgcccaggctggagtgtgatggcaggatctcggctcaccgcanactccggctcctgggtttaagcaattctcctgcctcagcctcccgagtcgctgggattacaggagtgcgccacaatgcctggctaattttgtatttttagtagagaaggggtttctccat

SEQ ID NO: 613147 - DNA, 297 bp, Homo sapiens
cttttttaattgtttttataatatttaatttgaaaaaggagccccttctctctctactctttcatagactgaagtttgaatatgaaataggccttacccctcctgttgcctcccccgtcaaaattttaggttggaaatttggttttattctttcagggaattgcttatttgacccgatcccttcctaaagctttaaaaaaagtgattcaaatgtgtgttttcccccccgttttataacaaatggattgatggccgtcaaatagccccggaataaattcctgtttcaatggtttttta

SEQ ID NO: 613148 - DNA, 786 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccaggtgagcaccgctgcacttcctctccatctgatctctaacaccagttaaaaccaagcttccatactttttggtctgtaaagccgcaccctgtctcgagcttaaggatatgtgtgtgtatgtgcgtgtacagacacacaaacctgccatataaagtggtagtttgctgcaaataaagactgaaaggaactctggaaaaaaaaaaaaaaaaaaaaaccccggggactcaatgcgggggcgcggaaaaaagcggagggtaactggacgtggggccttgggccaataggcgtgtcacctggaccaaggttttctggtacaacggggcagatccggcgggccccctataggggagcggataaatcccgataagccaggtacctggatgaggacgccgcgacacgggacaccaacacaacgacaagcacacacacaccacacagcacgc

SEQ ID NO: 613149 - DNA, 147 bp, Homo sapiens
  misc_feature (98)..(98): n is a, c, g, or t
gtgtgaggcaggagaatcgcttgaacctgggagaccgaggttgcagtgagctgaaaccgtgccattgcactccagcttaggcaacaagagtgaaactntgtctcaatcaatccatcaatcaatcaataaaatagaggtcatgctgac

SEQ ID NO: 613150 - DNA, 908 bp, Homo sapiens
aaaagtattgtagcattgcttggcatccatgaaaaatgtatttcagtgggctttaaaatttccatttgcagaatttggtctctcaggctgtttgggagctcttttattcacattagttctccttgtacacctattttattggtgtttaatagtaaaggtttaacatctgtagacttttccaggttattatgtaattcttatggagggtgagaattgggctgtcacccattgggaagtaaaagctgaggaaaggcataaaccaaaaaatctttcggcaaacctgtgctttgggaggcccgaactaattatgggctgatatgactttcgagtatataatagtcgtcgaatactccccgtaatgtggtgtggcgggggcttgcattattatcagcgcttcgcgttattccgcatagtgcccttggttgtataggggattgggctaattttaaatccttatttgtacgttctgatagagaagaagtatcggaacatgatatttgcttatttgaacctggtgtgggtgatacgtgaaggataagacagtggggaaggatgtctaatccaagggcggaggggggggggaccctcggtggcatcacatatactgggggtgaacggacggataggctccataaagcagagagtccacaatttaaaattctctccagaacggctctgggggaacggaactgtttccaactgcggagacacggacggaagggccccggaggataactgggggagggagcagcacccggtattaccaaacctgctggctaccacggtgggctggcaagcgggaaacctgcgagaacacttcaggacggaaggaaacacggcatataacctggagaggccccacttctggcaacaaaataaagtggacatccaaacctcgtagcaagagt

SEQ ID NO: 613151 - DNA, 3808 bp, Homo sapiens
agcgggtctctcgggcctgggcggcgcagacgaggcctgaggcggcggcgcgaggcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 613152 - DNA, 471 bp, Homo sapiens
  misc_feature (39)..(39): n is a, c, g, or t
agctaattgggaagctgaggtgagaggatcacttgagcncaagaagtcgatcaaggctgcagtgagccatgttcataccactgctctccagcataggccacggagcgagaccctgtctcaaaaaccaagaagccacacacattctagttttcagattctaacactagatattcaaatagagaaaggggattaggccaggagcggtggctcacacctgtaatcccagcactctgggaggaggcggcaggtggatcgcttgtgcccaggagttcacgaccagcctgggcaacatggtgaaaccctgtttgtataaaaaatacaaaaattagccggatatggtggtgtgcgtctgtagtcccagctacttgcggggctgaggcaggaggatcacttgagctggggagatcagcagccatgttcacgctattgcactccagcctgggcaacaaagtgagaccctgtccccaaaaa

SEQ ID NO: 613153 - DNA, 105 bp, Homo sapiens
aatcagtaatatatctcaagtcaaactaaggcaattttgcttaattatccaactaatcctacaggcgtgaccctatccaaatcagaagttaaagcgattgcggaa

SEQ ID NO: 613154 - DNA, 2183 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgtaagtatggcttcgttttcctgtgggcgtcggtcgtggagttggtcccacacgctgtcatgttgggtactagcagtagagaatgaacggcccgtgtgacatggtggtcctcactgatgacgacgggctgttggagctgctgcttaagccctcaccacagaagctcatagccaccagatcgcatttgctttgattgttgactgtctcgtgtgtaattgagtttcccagtttctacagactgccattgctatgcacggctgagatggacagagtttgcttgtgaatccgccacactcactgcctgtcaccacacctgcaggcgacgactgtaagggcaagaggcacctcgacgcgcacacagccgcccactcgcagtcgccacggctgcccggtcgggcagggaccctctggcacatctgggcatgtgcaggttgtctctcgccccgtctccgtctcatctcgccctgtcaccatgctatttgtgtcttgtgtggtttgtgcttggaattcaagtgctttaaagtcttgctgtaaaaactgacaggaatagtattaactttggtttaaaacagggtgaatctctctcgaaaagctcccttgtaaatattttttggaagcggagtctcactctgttgcccaggctggagtgcagtggtgcaatcttggctcactgcagcctccacctccagagttcaagcaattctcctgccacagcctcctgagtagctgggactacaggcgcacaccaccacacccagataatttttttgtatttttagtagagacagggtttcactgtgttggccaggacggtctcgatttcctgacctagtgatctgcctgcctcggcctcccaaagtgctgttggcatcttaaaaaaaaagttagtttcaaaaataattgtctcacctgctaatgaataaacataaagccattgatttttcttttaaattctcataagccatatttctttgcatgtcaaccatgttgtaattacatagttgcaggaattcacaagcaggtgttaagtcactgtgaggagacagccacccacagtgagaactggaacaaaacttactttgggaggctgaggcgggtggatcacttgaggccgggagttcaagaccagcctggccaatgtagcaaaaccctgtctcttaaatta

SEQ ID NO: 613155 - DNA, 1028 bp, Homo sapiens
acgggagggagaccttgtctcaaaaaaaaaacaaaagagcaaaaacagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcaaaaaaaaaaa

SEQ ID NO: 613156 - DNA, 590 bp, Homo sapiens
ggaacccgtctggagctatcctgcccgccatcgatcctagtctctcgtcgcccgttgccatccctagcgcgatccgtttaccattgaccaggacggagggtccgacgatcccctcccgttacccatccagaatccaattggcccaccccatgggtactggaacctacgaagtaccccgacttcggcggacataattttcgaacatccgtacgatacttctcccccattattcctaggaacccggcgacctgcaaactccttgacgcttgacccactcgagtagtatactcccgagttgaagcccccactttcgtataaataattacactcacccagacgttcttgcaccttactgaggctgtccccaccacttaggcttaaaaaacagaatgccattcccggacgtctataagcccaaccaacctttcaccgctacaccgaccgcggggtatactacggtcccatgctttgaaatctgtggagccaacccccgtttcatgcccctcgtcctagaattaattcccctaaaaatctttgaaatagggcccctatttaccctatagcaccccctttaccccctttagagccca

SEQ ID NO: 613157 - DNA, 378 bp, Homo sapiens
cggcacgagggtgagttttgagggtgacctgagttgagttgcgtgtaggcagctcaggttgactgagacaggaatgcgctcgatttcctgcccgttaaaacactctgcatttctttcccgccctctgcagtatggtttgaagtggtgaacatggatttttctcggcttcacatgtacagtcctccccagtgtgtgccggagaacacgggctacacgtatgcgctcaggtgagtgtgcacctgcacgtggggtcctggccttgcaatgcccactcgctgtcgcggtggcgtggaccttaacaggaactccatagtactaccgactacatgctgtattttgaaggtgaaaaaaaataataaactgtatcttatggcttta

SEQ ID NO: 613158 - DNA, 1403 bp, Homo sapiens
  misc_feature (719)..(719): n is a, c, g, or t
ccccggggcagacctcttcgttttctgcggggtatgtgctgctctctgcgctgaggtgatacactgcccggccgcctgtgggcgccccttgtggttccggcccctagtgttctttccacctctctgggctctgtgcccctgttcctcactcaggggcttccgctcaagcctcctcgggcacccactttgggcgggctcgcgtcctcccctgggtctcggtggttggctgccgggggggaccctttggcgtccttatcctacccctcctcctagtgtccaactatttgtttgggggtttatgtttggcctttacgaggtcccttcgacgcccgtttattcttcgggggtttccccgggcgtctcgggtcggctgggggggtcatcacctggggcgtggccccccggggccacccccttttggaggttctctcgatgggcggccccaccaatggggtcccccaccgcccgtcctctgtgccctctcggctttgttgtgcttttgctgcgggtagaatgtggaaaggggtgtttaagggcgcgttccagaggggacccccatgcacagactcattctctccgtggagctttgatatcaaagcgacttctgtggcactttgcgccccttggattttgtttgccccatacacgatgcgaacacacgccccgtgtttttccacccacaatgcgccccgtgggggcccccccggtctctctccgantgtccccccagtctctcctctctgcgcgctcggtcccctttgagtatgcccccccgagtattctctctgtgaggatctctctctccctgcggtcttgtggtggtgtatatgccccctcgcggattttgcgatattgcgcaagtctaggcgctcctctcttctggcgggctctgctccctggtctctcccgctacactcccagtgctcttatctccctgggggccctgtgccggcgcgcgtctcttctccgccgggagtgctcccttatgcgtggttcccgccatgcgtcttccaacgcgcctctttgcggtgcctcttgttaacttcgcccggcgcccttcccctgtctgtatctatagccacgctttcacacccacacccctggcattccttcttttttatacttcgccacagccccttccccgcctggcttcccttcccgcttctcccaaaccccaacctgctttcccgcgaacggggccacaggtgcacgccacaggaagccaaggcctgctgcttcaccacagccgttcccctccacagccggccccttgaaagtgtccctaaatttgttagtagccatgagacgtctggcttctgagccacccttggtattcttggtcacggcttttgagtgggaggcctcgtatccgttaaacgtgttataaaaatttcccatcaccc

SEQ ID NO: 613159 - DNA, 746 bp, Homo sapiens
  misc_feature (653)..(653): n is a, c, g, or t
tcgtacacatggttggttgtactaatttccatcccacaacagtgcgtgagggttccctttctccacatcctcgccagcatttgttactgcctgtcgtttaagatagaagccattgcaactggggggagaagagatctaattgtagtttttacttgcatttctctgaatatcagtgatgtcgagcacttttcttggaaacattttaataaatcctgaagtggtgcagtactattgcttccaaaatggtggaactgggcactgagaccgacctgaacttggctttaaggtggcagcatcttgagtactcgctgttctgaaacttacgaaaccaaaacggcgctgatgagtctgtttgggatcccgctgtggtacttctcgcagtccccgcgcgtggtcatccaggtgagtggccgccggtggccggagctgctcctcttcagcatggactcggttagtgttcacgggtcgtaggtccacagctccgtggaacttcgtaagatgaacacgtctgtggaactggtaccacaagaagtggcagcgttcccacaccgaggagtcccccgtgtccccgtgtagcctccacgctacacatctgttggcttgggtttagcgtcacacagatgggaccgtgtggcacatgctggtcctgtcangcttcctccctccctctgttgggtgtccagccatggtgtgtgagtggagtgttctgtcgggcggggttccggagagatgcatgtgtctcaggt

SEQ ID NO: 613160 - DNA, 139 bp, Homo sapiens
gcctggaccgccaagcactctttcttccatggatggagtgcggcttgggactgttggggagcatgaactcctgtggtgtggactgtgtcaagcgaatacctgattccacagctatgtggtggtcgtgctgccagtcacg

SEQ ID NO: 613161 - DNA, 1268 bp, Homo sapiens
  misc_feature (951)..(951): n is a, c, g, or t
  misc_feature (960)..(960): n is a, c, g, or t
  misc_feature (973)..(973): n is a, c, g, or t
  misc_feature (977)..(977): n is a, c, g, or t
  misc_feature (979)..(979): n is a, c, g, or t
  misc_feature (1007)..(1007): n is a, c, g, or t
  misc_feature (1053)..(1053): n is a, c, g, or t
  misc_feature (1059)..(1059): n is a, c, g, or t
  misc_feature (1081)..(1081): n is a, c, g, or t
  misc_feature (1107)..(1107): n is a, c, g, or t
  misc_feature (1143)..(1143): n is a, c, g, or t
  misc_feature (1158)..(1159): n is a, c, g, or t
  misc_feature (1175)..(1175): n is a, c, g, or t
  misc_feature (1187)..(1187): n is a, c, g, or t
  misc_feature (1190)..(1190): n is a, c, g, or t
  misc_feature (1227)..(1227): n is a, c, g, or t
  misc_feature (1231)..(1231): n is a, c, g, or t
  misc_feature (1247)..(1247): n is a, c, g, or t
  misc_feature (1258)..(1258): n is a, c, g, or t
cctgggaccgtgctgtcacagattctcatgtgctgggattacgaggcttgagcaactgcacccaacccagaactattttaagcaggccaatctttgtattgtttgggccacacacacgattcagccagagggtgggggccctttcacgtctcttctcgtggcccgggccctgtcagcggcattcacctgtgtggtaggagccatcggctgtgggaactctgtggaagtggctagccttgcacatcctctgatcatgttgacttcatcagggtgcgagaagcacttgagcttggcgtcggtgagttccctaagcctcttttgcgtgtgttgcagctcatgccagttactatgggagaatgaatgtgagagaggttctcagagaggatggccacctcagtgtaaatggggaagcgctgtgtaagtatggcttcgttttcctgtgggcgtcggtcgtggagttggtcccacacgctgtcatgttgggtactagcagtagagaatgaacggcccgtgtgacatggtggtcctcactgatgacgacgggctgttggagctgctgcttaagccctcaccacagaagctcatagccaccagatcgcatttgctttgattgttgactgtctcgtgtgtaattgagtttcccagtttctacagactgccattgctatgcacggctgagatggacagagtttgcttgtgaatccgccacactcactgcctgtcaccacacctgcaggcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagagaangcagctctngagtgtactagtngctngngatagatagtacaatatgtactatgatntctctctgatgtgatctctacaagtgcttcgaacatctgcaatatnaatctnctcatccactctcctatactancagtctctctacgcgcaggcattctntcgtctgcctgtgactggcaacatctagacacagcngagatacccagacgnntaaccacgctccgctnaacagcactcangtnacaatagcttctgctgatatgctgacacagtgctctnctgnagtcacacaagtaaanccaaactacantactaaaact

SEQ ID NO: 613162 - DNA, 323 bp, Homo sapiens
  misc_feature (49)..(49): n is a, c, g, or t
  misc_feature (67)..(68): n is a, c, g, or t
  misc_feature (80)..(80): n is a, c, g, or t
  misc_feature (85)..(85): n is a, c, g, or t
  misc_feature (87)..(87): n is a, c, g, or t
  misc_feature (94)..(94): n is a, c, g, or t
  misc_feature (157)..(157): n is a, c, g, or t
  misc_feature (240)..(240): n is a, c, g, or t
  misc_feature (243)..(243): n is a, c, g, or t
  misc_feature (266)..(266): n is a, c, g, or t
  misc_feature (275)..(275): n is a, c, g, or t
atctgggacccacctgccccacccagaagtggcccagtcctgggggccngggcgaccgggggggtgnngtggggggggcnccgtncntcctcgngtgctggggggttggagcacaccacccccttctgctgccctcctctgggctccaggaaggagngcagctgaaatctcgggcctgtggcttctccacaccactgccccccaggttggagggggcgctaagagatgggagaaggggtnggnggcagagaaaagatgttgatcangaaagatgngaaccaggggtgagggctgaaggagaatcaaagataaaataccagttt

SEQ ID NO: 613163 - DNA, 4397 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 613164 - DNA, 255 bp, Homo sapiens
  misc_feature (2)..(2): n is a, c, g, or t
  misc_feature (56)..(56): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (81)..(81): n is a, c, g, or t
  misc_feature (123)..(123): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (166)..(167): n is a, c, g, or t
  misc_feature (170)..(170): n is a, c, g, or t
  misc_feature (202)..(202): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (228)..(228): n is a, c, g, or t
  misc_feature (236)..(237): n is a, c, g, or t
  misc_feature (242)..(242): n is a, c, g, or t
cntttttttagattttgtgcagttaatacttaacatctgatttcattttcttaatncatttaaatattantncnacctccncttaaaataaactacgcctccttaggtaaacactactaagancttgatactattcnctcncnccttactatacgtacttcactcnnccnaccccactacttaccaccaaaaaccgtactangaaaccgnccttaacgnacntttccnccctcccnngggcntaaactgcactac

SEQ ID NO: 613165 - DNA, 4716 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgtaagtatggcttcgttttcctgtgggcgtcggtcgtggagttggtcccacacgctgtcatgttgggtactagcagtagagaatgaacggcccgtgtgacatggtggtcctcactgatgacgacgggctgttggagctgctgcttaagccctcaccacagaagctcatagccaccagatcgcatttgctttgattgttgactgtctcgtgtgtaattgagtttcccagtttctacagactgccattgctatgcacggctgagatggacagagtttgcttgtgaatccgccacactcactgcctgtcaccacacctgcaggcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 613166 - DNA, 160 bp, Homo sapiens
agtactgggccgcgtcacagcttctcaaattgctgggattacaggcatgagcactctgcctggccacaatcatattttattctctttttaaaaattggttttattttattttattttttaacagaatctcactatgttgcccaggttggtctcgaactcc

SEQ ID NO: 613167 - DNA, 400 bp, Homo sapiens
acagatagtttcttttgtgagaaactgtaatattctcacaaaaataaaagtacagactggttactgagacttcagattggaaagtcaggagagattttcaatcttcgtttcttcccactaaatgtactaaaatagaaactgttgttgtttttaactaaaatcagagcagactggaattacggaaaagaatattatgaatggttctatatatatatatatatatatatatatatatatgtagacagaacttaacatttatgtttttttgttatttttaaagtccttgctgagagcttttaggagggagtactctctaatgaataatactaataaaaataataacaataatagatccttactatgccagacctattctaagacttttgcatttagttctcac

SEQ ID NO: 613168 - DNA, 4538 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactaggtaagtcaaatctggctgagttgcctccgatggctaagcggtacacacatatgtgtaacttagtggaaaaaaatgagcgtgtaagtccatgtttgagaagcgtggtgtacctgtgtgtgtgtggtggctcttctcttttagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 613169 - DNA, 317 bp, Homo sapiens
gtttttaaccccccccccccggggggggggcccctttttttaaaaagggggagggggggggcttttttgggggtccttttccccccaaaaaaaaggggatgaaagggggggggggggggccccccccggggggggggtttaaccctttgaattttggggggggggtcccccccctttgggggcccccccccttttttccccccggggggggggccgggggggggttggggcccccccccccccccggttaaaccccctttttttccccctttttgggggggcccttttttaaatacccgggggggttttttttttta

SEQ ID NO: 613170 - DNA, 125 bp, Homo sapiens
catctgtgtgctgtgtgtgctgtgcgttagtgtgtgtgcagtgctcgtgtgtgtgctgtgttcatgcgtgtgctgtgtgtagtgagtatgtaactgcggggatgcataaagtatgagtgctaaat

SEQ ID NO: 613171 - DNA, 373 bp, Homo sapiens
  misc_feature (98)..(98): n is a, c, g, or t
  misc_feature (333)..(333): n is a, c, g, or t
  misc_feature (341)..(341): n is a, c, g, or t
  misc_feature (371)..(371): n is a, c, g, or t
aggcaacccccagcacatcaccattctcaatcacctgattcagatacatgccaccggcacgtgaaaggcgagtccgcatcagctttgtatcatcacgntttccggcatgttcgccatccggcacgatgatcactctctggagattgaatttatcgcgaatttgcaaagcagcgtcgatagagccaaagacattcacatccaggttgatatgaaccagtccattttcccgggctgtttgcaggtatttgacaaccgtgacgcgggacacccccatgatagctgcaacttcagtctggcttttgccttcctgatagtacagccatgttgcatgangtacgggntcatcattgaacaggctgctgtttgttganct

SEQ ID NO: 613172 - DNA, 117 bp, Homo sapiens
agcggctgaggagggcgggcgcccgcaagccgcagtgtctcagctgcctccgcgcgccaagtcaaaccccgacacccgcggcgggccggtgagctcactagctgacccggcaggtca

SEQ ID NO: 613173 - DNA, 179 bp, Homo sapiens
ggggccctttttccccatttaaggggggaatttccccccccccccgaacccatttttgggttttttttttccaaaaaaaaccggcccgggttttccccaaggaaaagggcccgggtttttaaaacccaaaaaaaagggcaaggccggccccccccaaaaaaaaatttttaggccgggga

SEQ ID NO: 613174 - DNA, 170 bp, Homo sapiens
acatgagcagttttcttatacaggtacactcacgtcacggggagttgcttgtagattatttagtcactcaggtatcaggcctagtacccattagttatttttcctgatcctctccctcctcctgccctccaccctctcgcaggccccaggtcgacgcggccgcgaattta

SEQ ID NO: 613175 - DNA, 147 bp, Homo sapiens
cctcctgacagcacagaggaggggaagagggcggggctgtcgggaatgtgttcctcgttgaacttgactgagacttcgtagtcacctggctcctggaccacatagccacaccacaggagccaccctgtgctgtccacctcctctgtg

SEQ ID NO: 613176 - DNA, 113 bp, Homo sapiens
  misc_feature (19)..(19): n is a, c, g, or t
ccggctgactacggggagngcgggaggtctcaggaggtgggcgagagctgtcgcacatcagatggagacattgtaggtatagcttgtgctagagtggggtgggtcctgggggc

SEQ ID NO: 613177 - DNA, 593 bp, Homo sapiens
tgtggtggtggcgcgccctgtagtcccacctacttgggaggctgaggcaggagaataggtttgaacccgggaggcagagtctggcagtgagccgagattgcatccatctgcctcgtccagacctaggagacagagccgagactctgtcttcgaaaacgaggcaaacgaatacaaagcaaacagaaaacagggttaaccaaaagtatggaattgcaacttgcttttgttatatgctgcagtccatgtatcctgccctagatttggctgggctatggtggttcacgccgtgtgatcccggcacttagggaggctgaggcaggcggatcacgaggttagggagttcacctgaccagcctgagcaactatggtgaaacctcgtctctagtaaaaatacaaaaaatgagtcaggcttggtggcccactccgtgtaaatcccagctacatcaggaggctgaggagcatggactaatcccttggaacccgggaggcggaggttggtagtgagccgagatcggaccgacgggactccagccgtgggtgactgatgtaatgagactcctgtctcgacatttgtaaaacttctttgcacgttg

SEQ ID NO: 613178 - DNA, 297 bp, Homo sapiens
gcctcccagccgcggcccgggcaggagggcggcgggtgggccgcccagcagcagcacgtcggggactttgtgctgcccctcgtgcccgcatgccgccgtcctccgccacgccactatccgacagccgccgcgcatcactcgctcgccctcccgctatggggggcggggctcggtccattggtgggggctttgagctctccagactgtgcccttaccgccttccccgccacaccgtctctgtcttcccactgatcccccccatcccgggcagggcccagtgggattgagggggctggg

SEQ ID NO: 613179 - DNA, 270 bp, Homo sapiens
  misc_feature (87)..(87): n is a, c, g, or t
  misc_feature (93)..(93): n is a, c, g, or t
  misc_feature (102)..(102): n is a, c, g, or t
  misc_feature (174)..(174): n is a, c, g, or t
  misc_feature (192)..(192): n is a, c, g, or t
ggctctcgtgaactctccgtgaactacgctcccagagccggccagaaacctaacctggacagcaatgcaggaaacagcaaaaacatnggcaangtaggtatnacgtaccagaaagtgtacctggcatgattggcaatcttctccatcggctgcttttcaacataaagccagatnagtgtcaggagggtgatnaacggcagtgctgcaacaaatccaccgagcttatcgcttcgctttgcgcttctgacacgataatcaccagtctctcgg

SEQ ID NO: 613180 - DNA, 168 bp, Homo sapiens
  misc_feature (21)..(21): n is a, c, g, or t
cttcttaaccggccgtccttntctcatgtgagggcattaaaattattataaaatccgttcaggatactgttaataggttgttcaaagaagttggggtggtggtggggtggtagagatacgaaacgaacgggtctgagggaagtgggaaaggagacgataatggcgaat

SEQ ID NO: 613181 - DNA, 144 bp, Homo sapiens
gttagaggatcccccatagttattatgaagtacaagtagcaggttaccaggtaaggtgtcagacaatttagttccagtcactttggaatccatgttctataatctaaaatttattctctttccctaagcgggtacggagctcga

SEQ ID NO: 613182 - DNA, 393 bp, Homo sapiens
gtcaagtttaccctttgttggtgctgccgtgcaccccagtaaagcggggtcctctccgcatccgaattcctcttgtgtaattccgatcacaatcggccgcaatttttaaaaggctccccctgacagtgcacgtttttccaatcagaatacactgaatttagtcaaatcctcccggaaacctggaacgctccgcacatcttgacccttgtgggcctttttgaatagcatagggcaccacgcgcatattgccccatccgtttagctgtctcatgaatatcccacaccttatggttctgtgggtttaaagttaaaatgtgcgccctatatcaaaagtgggttctctaaatagagtcattatctacacaacaaagagagaatacagctccccttctt

SEQ ID NO: 613183 - DNA, 647 bp, Homo sapiens
caaccccccccaggttaaggtcggggggagctcgcgaatcccttccgggtcgtggaaggttgcccaggaaatacaacgagctgttaaagtcctcccaggggaagaggctcaaccctccccccttgtgggaccagctgaacgagcagtttaactgggtgtcccggctggccaacctcacgcaaggcgaagaccagtactatttgggggtccccacggtggcttcccacacttttgaatcggacgttccttccggggtcactgaggtggttgtgaagctttttgactttgatcccatccctgtgccggtccccgtagaagtctcccggaagacccctaaatttatggagaccggggcgaagaaaagcccggcaggaatcccccaaaaagccccgggaggagtgaaatgtggatgttgcttttgcccccacgggggcatttgagtccagctccccccaagatgaggtgcagccccccagaaagagctttgcacgtccccaagtaaccaggccccagcctccaggcccccaactccgcccagcctctccccgctttgggtcctgccctttaaccctcgactttgctggtcatgggaagaacagaattgctcccgcatgccactaattcaataaaactgttttgtgggctga

SEQ ID NO: 613184 - DNA, 394 bp, Homo sapiens
cccctgggcccggcctaaaacaatttactttttaattgaaagggaaaagaaagtattttttattactgaggggattttttgccccccccgtcgggaaatttttttttaattacaaaggcgggggaaaggaaatccaaagttatctatacccccattactttttttcccaaggttagccaatttaagattctttttttttttttttttgagacaaagtcttgttttgtcccccaggctggagggcaggggggtgtttttgactccccgcaagccccccctcctgggttcaccccatttttttgcctcacccccccgagtaggggggcccccagctgccccccccccccccctttttgtataatttaaaaaaaaaagggtggggcttttgttttta

SEQ ID NO: 613185 - DNA, 368 bp, Homo sapiens
tgtgcttaaagactatcgcgccaaccaagacttctgggtactcactgcatctaagctacccgaaagcgtgtttaaggacatgatgcacagcctttatgcaaatgccatactaaacctaggacaatggcgaaaggcatgcgacatctatgtaaaacaaggcgattgggaaagtatggagtgggccatgcgcaactatcgaaacctggccggcatcaaacgcatatataaggaagaccccaattcgcccaccctaacctacctgttgcattatttcgtgaacggcggatatggatgggagtacaattacgaaagctcgttaaaggccgaccgtcgacgcggccgcgaatttagtagtagtaggcggccgc

SEQ ID NO: 613186 - DNA, 417 bp, Homo sapiens
gcgaaatgtaaccctcatacattgctggtaggaatgtaaaaatgatgcagccacttgggaaactttggcagttcctcaaaaggttaaatgtagagttactatatgatccagcagttctactcttaggtgtatacacaagataaatggaaacatatgtccacacaaaatttgtacacaaatgttcataggtgcattattcatcatagcctaaaatggaagttactaaaatgtccatcaactgatgattggataagtaaaatgtgttatagccatacagtgaaatattatttggcaataaaaagtagtaaagtattggtacttgttacatcatggaagaaccttgaaaacattatgccatgtgaaagaagccagtcacaaaagagcatatagtgaaatatccagaataggaacacttag

SEQ ID NO: 613187 - DNA, 148 bp, Homo sapiens
ggacaggtttcctggccacttttggtggatagcagatggatcaatattagttaaacccatccaagattgaactgtgaaagagaggttccagggtatctccctcagctgccgagttactaacgtgatgtgttacccaggatgcagcagg

SEQ ID NO: 613188 - DNA, 184 bp, Homo sapiens
agcggatgataatctcaagaaccttcgagcgtcagctcactcccttccacctcagctccaccctcagcagatgataatattaagacacctggcttccaccctcagcggatgatctcaagaaaccttcctgagcgtcagctacacatccccttaccaaccgtcagatccaaccctcagaaagatg

SEQ ID NO: 613189 - DNA, 177 bp, Homo sapiens
ggcactgtggccctatggccatggctgtcgtgagcaccaagagaatgagttacagaaatatctgcaatacactgacacgcatctcctggacagtggacagtcgctgtgacacacacacacactttaaggctcacacaacctaacagccttaaatatctgaagaagcagaatcacgac

SEQ ID NO: 613190 - DNA, 424 bp, Homo sapiens
cagcaggcggatcacttgagtccgggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccaggttggatctccagcttgagatcctgtctcaataaaaaagacagacagaaacagataataaagatgctggccaagtgcctaagaatggatgaacaaactctgcgtgagggggctcaatagtgatacgtgagtgactgtgtgggacacttaggaagacattctagccgctcagatcttggacgggctactgtatgctacgacagcccactgttctttataat

SEQ ID NO: 613191 - DNA, 196 bp, Homo sapiens
aagtaaaaggctcaggtatgaacacaggtgccttcctcagcacagaacaagccttacaacattctctggggcccaggctagggggataggaacggggcagcacagacgtcttgcctgcctgactgacacatttgagcaatagctacaacagaacttgagggcttggctccattccagaagaacatcgtggatcctc

SEQ ID NO: 613192 - DNA, 350 bp, Homo sapiens
cctctgtgtgctgacatccccatcacaacattgctcattgtatttctttagatacctaattgtacatctttatacttctttggacatggaaagaatagttattgcgggtgcaaagacagatggctgaacattatggggaggcatattgattccttttccttttttgatcatggccattttattgcgttgtattcagtgtacatgaattttttttcctctactgctcttttttctttgctattgatatttctttatgtattgattttattatactgtaagtcttagggtacatgtgcaccatgcaggtttgctacatatgtatacatgtgccatgtggtgtgctgtacact

SEQ ID NO: 613193 - DNA, 411 bp, Homo sapiens
gaaaaactgtctctcttcactgatgatatgattctgtacccagagaaccctaaagagtctgtgaaaaaactactgggaccgataacttcagtaatgttttaaaatacaaaatcaatgtactaaaatcagtagcatctctatagaacaataacgttcaagctgaaacccaaatcaataatgcaatcctatttactatagccacaaaaagacaaaatacttaggaatacatttaagcaaggagataaaaggtctccacaaggagaattacgaaacactctaaaagaaatcataaatgacacaaacaaatggaaaactattccatgctcgtgaattaaagaatcaatatgattaaaatgcacatattgcccaaaccaatctacagattcaatgctattcctaccaaactaccat

SEQ ID NO: 613194 - DNA, 637 bp, Homo sapiens
tggtggccagggcgctcgggaccgggctggtgtcccccgcggcttgcaagcccaagaatcaccctggccagaagaagaagaaatatacaaagaggaatgagggaggattggggccaaagcccccgggggggcgcccggttggccccttgaaggggggccggtttgaagaattttggccggaattggtcccggaaggggtccaacttttcaaacttgttcccaatcttgggcccgggcttttgggggtgggtaaccggcaaccgggatccttggaacaaccccccccggttaaagggcaagttggggccaaacagggggttgccaaccttgggggctggaattgaaccaatgttgccttttaaggacccccgagggcccaaggacccggggccccgcgggggtggggccaaacaaagacttggcaaaaggggcgagaggagggaacgagcgggcgccgggccactcggggctgagctgggggcgagcgggggcaggcggctgatgttttataaatgtaaaataaaaaaaaaagaaatctaaaatctgggactttattttggcagagagaaaaagcgcctatttaagtatgcttggtgtttctcctactcctttttttctttttagtgtagaaatggaa

SEQ ID NO: 613195 - DNA, 176 bp, Homo sapiens
tatagatacgctgagttatccagctctctcacactgcctccatttggcatgccaggctgtgcccgtaaagtgttgaatcactgttatcctaatttacatagtgtttactaccgtggacactgtgatgaggggctggcaagagcagcctcgtgccttccgagaaggtgccaggagcc

SEQ ID NO: 613196 - DNA, 216 bp, Homo sapiens
cgctgcacagcgccaccgcaccgggagagaagagcaagaccaccacgccgccctcctgcagggtctggcgctgcgcgtgaaacctaaccacgggcccctgcgcgctcagttcacgacggctccacaggtctacggccaccgcagcggcagctgcacaggccagacgccaggccgcaccaggcgctcgaaacccgagtcatcggctgagtagaggag

SEQ ID NO: 613197 - DNA, 256 bp, Homo sapiens
taaaaaattgaaccttgttttttaattacctttttgccggttttttaaatagccttttacctggataaaattttttttgtcattttttcctggtaaaccttttggggtaaaaattggggatgggttttgtaagaaaattttaaagtttttctttttaaaagtggacctaacccattttttttgtttttgacaaatgtgtttttttgttttttgtttgccgggagctttttggtttattaacgtgggatttcccgga

SEQ ID NO: 613198 - DNA, 418 bp, Homo sapiens
tgggacagatacaggttggtagagctttgagctctgctagttgctagctgtgtaacctgaggcaagttaaccttcacaagctttattttctttatccattgtggccaataatattcaccacagaaggttgttcatttatttatataataaatttttattgaatatctgttttatgttagacacttttttgagcactgggaaacaataatgagccctcactgagcatggatattctggaattactgaagctgaagcaacatatggaaactccttatctcagtacctggctcattgcagctatttaaccaatagctgtcattttattagtccgagatataagaatgtgttgattacagtcctatgatctggagtcagatctggatttaagttcttatttagaacattagatccatagctt

SEQ ID NO: 613199 - DNA, 130 bp, Homo sapiens
taggagaatccacgccggagggctggtcgcgactacagtgcatattacagacaaactgaagagctgcgaagtcagattaaggatgctcaactgcaaaatgctcggtgtgtcctacgtcttgattgacact

SEQ ID NO: 613200 - DNA, 406 bp, Homo sapiens
atatttagattttcatattttgctgcaataaatatactcagcagatgtgtaggatacaggcctgaaagtggaattgatagtttcagtattccaaaatctagtatgttttagagttcatctcttatactcgtggataaactttgatctgattcttacatagttttccataatatgcatgggatgggtatgcacatttaaaattttaatatatatctacaagttgccagctaaataggctgtaccaattaaagcctcctccatcagtgtttccctgtatccttacccacactgtcatctttttttttttaaattgctttggagtaaattacttttttttttcttgaggcggagttttgctcttgttgccactgcactccggcctgggcaacagtgagagcctgtctca

SEQ ID NO: 613201 - DNA, 407 bp, Homo sapiens
  misc_feature (117)..(117): n is a, c, g, or t
  misc_feature (120)..(120): n is a, c, g, or t
  misc_feature (171)..(171): n is a, c, g, or t
  misc_feature (335)..(335): n is a, c, g, or t
  misc_feature (349)..(349): n is a, c, g, or t
ccaccaacattgacaacagcacgaccatccagaaactgttcaagcgcatcaccaaacagttcaaggccatgttccggcgcaaggccttcctgcactgggacacgggccagggcatgnacnaaatggagttcaccaaggccaaaagcaacatgaatgacctggtgaccgagnaccaacagaaccaggaagccacaaccgaggaggagggcgagttcaagaaggaggctaaggaggaggtggcctaaagccttcagtcactggggaaagcagggaaacagtgtgaactctttattcactcccagcctgtcctgtggcaagacccactgtgtgcaccngctgttttccctgnccacatccatgctgaacagacaccaccattaaagcattttcatagtgaaaaaaaaaaa

SEQ ID NO: 613202 - DNA, 313 bp, Homo sapiens
tgcatgagtaggtggcctgctcttatgtttgcgcgcttaggcttgcggcccggcctcttggttgacttgagtaggctgatggtttcgcatcctaactatgtatgggtgcataaggggtgtacggtgtgccttgttggtatagaagtgggcttagggcactttttccgtctttcgagactgaaagccttacttagtcactgtcgcccgtctcactaagagggatgcgcccatgggctagcgctttactagattcgtttgggtaggcttggctagtcacaatgagtctagtgccaggcatgtcccgatgggagcg

SEQ ID NO: 613203 - DNA, 1498 bp, Homo sapiens
gatttacaacaaaacccagcgggagaagtttgcctgggtccatgtgacatggctgatgaagactatgagttttagccagctctcaagcaggcagagcttctgtgcaagaggaacagtgctggtttgggaaagcatggataaactgagcctcacttgccctcgtgcctggcgggcacgacgagcgcacgcaacgcctcctctaacaacaccaaacactctctctgcgcacacacagataacaccctggcagactacttactcaccgcgcgcagacgcctgagccccacgcttgctccctactgcgcacacaccctctacctctcttccaccacacactactctctcacgcacctacttccaccccacctctcctacgcccctgcctccctgccactctcctgcctctctctgcacaccctcctcgctcttctcccactttctctcacccgccacgcgcgccccccgctgccgcactgcgcgcaaccctctctgctcccgccccgctctccctaccccccgcgcccacccaccttctccccctgctctctcacccctgcacacacctgctctctgcgccacctctccctctctctccgcccctcacctgctcactgcccccacacgcctccccgcaccttcactccctccgcgcctcgccgcttctctccctcccacgcttcagcgccgctctccttcgccaccctcacccccttctcccctcacttacctccctctacacctacgcacacacctacaccacctctccccctaaacaccactcccccatttcacaccatcccttcctcctcccaactcttctccacgcggcaaccctccctacacccccatcttcacacggcctaccgcaaacacacaacatacacaccccctacccctgacaacctccttgcttataccccacggccttcgctcctcccctccgtcccttacttctggctccacttgcccgcggcacttccacctcttctctccacttcctccaccgcctctctgccaccgctcacccccccgcttggcccccttctctgggcccaacgctggctccctccggcgctctttccacgcaccaaccccttgctctcccccccagcttccccccctcgccccttcgccttgcccgcccacccccctcattttctccccctgtccccctctgtcacgcctgcgttcccctctcctctccacccttgcctcgcacctttcctcccatcccccctactctctacccttccacttcccccacacccctacttgcaaactccccctttctttcactgtgacacccactcacgacccacatccccagcctaccaactctgcacgcgcgttctctgcccacaccgccacccgacaccccgcccccacatggcaccctccacaccgggcctaccgctatcaactaccaccctccccgcgcccctctcacacacacctcccccccacctccctctccccctagcccactccacccacctcc

SEQ ID NO: 613204 - DNA, 131 bp, Homo sapiens
agagaagaagatcgcgtgcccctgtagtggcttgccgctggtggtggtggttatgtcgggctaacaagcgcagcgtgcgctggggccgggaggcagggtggcgggggagccagaggggcggaggaggaacc

SEQ ID NO: 613205 - DNA, 695 bp, Homo sapiens
acaacagtgtgaatgtatttaatgccactgaattgtatgcttacaaatggttaaaaggataaatattgtggcatgtatattttactacatatagacacacagattgttggatgagctgaatgagcagaagacagggttccactactggacattgatgtgggcacatccctgtgatccagaggtcagcaagttgctactgcttccacagcctaagccctgtagtatcctcagttcccacagagctgctgactgagtgcaggctgctgtatccaggcaggtgcctctatggaatggcagagctgataaccagacactgtaaatgccgagtctggctgcacacactcatgagctgcaagagggaggcttccatctcacttttagcttccaaatctcatatcctggttctgcctggaatcagattttcacttaagaaccctgactgctagtcagtttcgtaaacgacgttcttaactttataggccctgtggactataaaggcgagaactgtctggtaagtgcctctggcccatcaccatagtgttccaaagcacttccgaacgctctttgtaccggcccccattaccgtggagggcataacttggcttccataacccacctctcgtcggttcggcgtgttcccatcactaccagtgcccttactgtctctcagcaccacaccgctcctttggttcccc

SEQ ID NO: 613206 - DNA, 1147 bp, Homo sapiens
ggcggcgacatgtattttttttgtttttgttaaataaacgaggtttttgtggtggtttggggggattggaatggacatggtttaattaaaagtggtctttaaaattctcatttaaaaggctaaaggacattatattaatttttctcttacccatggcgtttaactggatataggtatgaatttcaggcccttaaatttccttctaaatttgtgggaagatttttcctcagaatattctctacacccatgtggaacagcagaaacctttagcccagaattcttcagggaaacaacagaatatatgggctttttccaaaacctttggaaagcagttcctctaaaggggagcacgagaacacccacgggcatatcaaaacaactggcctggaaggagggaggtggcgcaccgcattcaggcacaccaggggttatatgggaccaaagcaaagggttgcaggtagaggaacccccatatttatcaagcactgggaatattcaccacgttggctgggtgaggaaaaaatttctacaaatgggagtaaaccgggcgaaaaataatcgaatgtgagtatatcccaacgggggacagaaaagagggcccgatgtttggattggaaagaaatcccagtgaggaaagagcttttagcagagttatgggcctgtgtaatccgaggtaagatatcgcaagagaaagaagtgggactacagaaacttttccaactggcacaaggcaagaagggccggtctggcaccagtgtcccagcccgtgtggctctcctacacgaggattaagacactcccccaaggtttacacacactagttcacagaacgagggatattcctaactcacagggtgaaaaaggcgcggatgtttaaaaaaccttccacgacacggtcgcacgaaccttcttggtatgacatgtggttaggaccccaggttgtacaaattgtggggaaagtccaaagccttcgcccatgtgttggcccacaacacatactagtacccggaaagggcacagaattgtccacggggtcgtggtcccaagaccattagttgacagcggccatttatagagcgacgcctgctaaactatcatcaatgagggtgacagacgagactttgcagcataggggtcacagtacaga

SEQ ID NO: 613207 - DNA, 469 bp, Homo sapiens
  misc_feature (41)..(41): n is a, c, g, or t
  misc_feature (46)..(46): n is a, c, g, or t
aaatcagccggtccttcagcaacgcaacgcccatcactgantaganctggtaagaaaatgtggcacatatacaccatggaatactatgcagccataaaaagggtgactttatgtcctttgcagggacatggatgaagctggaaaccacacttctcagcaaactatcacaagaacagaaaaccaagcaccgaatgttctcactcataagtgggagttgaacaatgagaacacatggacatagggaggggaacatcacacaccagggcctgcctgagggtagggggtatgggagggatagcattaggagaaatacctaacgtaggagacgggatgatggttgcagcaaaccaccatgccacgtgtatacctatgtaacaaaactgcacattctgcacatgtacctcagaacttaaagtataataataataaataaattacagtgaacacaaaggtttggcgttggctggaa

SEQ ID NO: 613208 - DNA, 398 bp, Homo sapiens
aaagatttttccctttttagaagaaatatttcttttaaacaaacataattcctatcaacctaaaataatcaaaagtcagaatgtagtttaaaagagaatttatttggcccaggcacggtggctcacacctataatgccagcactttgggaagccaaggcaggcagatcacttgaggtcaggagttcgagaccagcctgactaacatggtaaaaccccatctctgctattaataaaaatacataaaaattagctgggcatggtggcatgtgcctgtggtcctggctactcaggagctgagccatgaaaattgcttgaacccagaaggcggaggttgcaatgagccaagatcatgccactgcactccagcctcagtgacagagcaggactcctggttatt

SEQ ID NO: 613209 - DNA, 215 bp, Homo sapiens
aacatgtcgaggctagcggctggatgctcgatttcctctgcctctctctattgccaggcttaccgcgacggccgtccgagacttccgcaggaccgcaacagcgcaaaggtatactcatggactatccagtctaacagcttgccagttgagaacgatatacctatgtcagtttttgacaagaatggcagcaggaaaaacccttgatgcacagtttg

SEQ ID NO: 613210 - DNA, 296 bp, Homo sapiens
ggccagcttggctggtctcgacgtgaaaaacagaggctggtcaactgtaatcccatccactcagaaggctgatgacaggagaatctacctgaactctggagagaaatgttgcagcgagccgagacagtgccactggactccgggtgtgtacgacaaaacaaaagtctttccacactcagccagctgagtgagttgcgtaaatccgtctgcattattccacgacacgcttgtgccagagtgactggaggacaagctcgagctatactctcgtcttgtgtgatacccgtctgagtcac

SEQ ID NO: 613211 - DNA, 382 bp, Homo sapiens
aatccgtcaggttgttgaggaagatacctggtgggaggtgactggatcatggggacggtcccccttgtagatctcatgacagcgaatgagtctcaggagatctgatggtattataaatgtttgacagttcctcctacacacacacttgctctctttcgctggctgccaggtaagacggacctacttccccttccaccatgattctgtttcctgaggcctccccagccacgtggaactgtgagtcaattaagcctcctttataaattacccagtctcgggaagttttttggtttgtttgtttgtttttgagacagagtctcggtctgtcacccaggctgtagtgcagtggtacaatctcagctcactgcaacctccacctccc

SEQ ID NO: 613212 - DNA, 116 bp, Homo sapiens
ctgcaacaatttgggctctacagctgaattggcaaagtaaggtttacttcacaagcccctctttttcttctgatatgcggactcaatggaagcacactccccagcacatggggatc

SEQ ID NO: 613213 - DNA, 197 bp, Homo sapiens
cgtacatggctataccaccataccacgaattctcatggaggtagtgcttttcttatactgtaaaatggtgaaggtggggagtggtagtgagttttaaggtgtggtatggtggtatcagctcagctataccaccctataccacggaattctgatccctaacactccccaccttcaccattttacacgtcgtggtatag

SEQ ID NO: 613214 - DNA, 649 bp, Homo sapiens
tgaaacaaggtctgactctgtcgcccaaaactggagtgcagtgatacaatttcggctcactgcaacctctcgggctcaagtcatcctcccacctcggcctcccgagtagctgggactacggtggacgtcatcgtggccagctaatttttggtattttttttttttttttatgtaaaagatgggatgttttgcgcctgtgttcgcccgggctggtctcaaacacatgacgctcaaacagatctcgccagcctcggcctcccaaagtgctggaattacaggcatagagccatcacgcctgaccggattatcctatctctaaaaaaaaaaaaaaaaaaaaacatgcccagcgcacggggcgcctcccaccctggatgatcctcgaagcctttgggagaacgcggtaagggcgacggaaaacatcatgagagggcacaggagttaccaaaacacaccgccggccactatggtgtgaaacccccctcttttatatatagaaaattcgaaacaaaactagccggggacagtgtgcccgggcgcggaatacacagacagtggtaccccccacatgtgcacacccaaaagggggcgtacacgaggtcagagaatacaaacacgtcgggtacggagagcccccctctcaactcacagt

SEQ ID NO: 613215 - DNA, 240 bp, Homo sapiens
  misc_feature (44)..(44): n is a, c, g, or t
tgcagctccacacgactacgcttcatcccaggtagctgggcagnctctgcaggcttggtgtgctggctggactgaggggtcaggcgacagagctggctgtacaggaatgtcacgagcacagcaggtgatcttgaggcttgcgtcaccgtctttcctttgtttccagcatttggctgggatgtgaaggggagcactcctgtcccatgtccgggctcactggcacaacataacctgtctttg

SEQ ID NO: 613216 - DNA, 364 bp, Homo sapiens
tgagacggagtttcactcatgttgcccaggctggaatgcaatggcgcaatctctgctcactacaacctctttctcccggattcaagcgattcttgtgcctcagcctcctgaatagctgggattgcaggtatgcgccaccatgcccagctactttttgtatttttagtagagaccaggtttcaccatgatggtcaggctgatctcaaactcctgacctcaggtgatccacccgccttggcctcccaaagtgctgggattacaggcgtgagccaccgtgccaggcctagatccaaaatattatcacctaaacatatattcaatttttcaaaggttatgtcgacgcggccgcgaatttagttgtagt

SEQ ID NO: 613217 - DNA, 1448 bp, Homo sapiens
gctgtttttatgttttttctcttgttccttgtctcctcgtctctctactcttccttgttttttgcttgttgttcgtcttgttttatgtgcttccttcttcttgctgtctcgttcttctcttcttttctttgcttgtttttgttctccttggtggttaggtctggtttctttgtttcttcgtctctccttgttttgttctgccttctggttctgtttccctttttattcctcctttttgtttttctggctttctcctgttgtcttattctcttcttcctccgttttctggtttgtctccctctattgtttgtttttttcttttctctgcagtttataattccccttgggtacaacctgtgtttgtgttcgtttgctatgtaagttcttcttggggttttgcctttggggttttttcttcgttgtgtggctgcccccccttatttttgtttcaccgtatgtgtattttattgtatcgtttgttactcacttctcgttgcattattttttctccctccctgtgttctccctggttctttttgtggccttgttctctaccttctcggtgcgtcacatagttattgtttgttctggtgtctttctcgctcccccctcctgtctcctccttgtggaggtctcgtttttggtgtgttattgtgcttctttgtctgtcgcatattggtctttctgttggttcccccttgttgggattttctactttctcttttcctgttgttcctcaccccccgtttgtgcttgtgtccttttatgcctcggctcttctggtgattttttcgcctcaaatactttcgtatttcacgctgtatgtacctgtctcgttaactgtatcactgcggacacaccgtttctttatctcttgttgtttatgcccccacctgtctctctcctattgttctccctatctctcattattggaggacgctgttattgtgtgcgccttctattgatggtaggcttttcactttctccttgaattctccccctctatttttctccactggcgtattcacactctctatagagccacaaatcctatacccgcacaaaattccacttttcacactattacaataatgttcacttccggcgtataaattcgtaaacttttcttttcccccacacaccacactctttctcggccctatttcccgaaatttcccccaaccttatactcggagtatctcccgagtgcactaacacccacacactgtaaacactcctattcaattctttataggctcacattcacattgttttttacacgccgttaatattaataattttcactgagtttgagagagccttcgctttgaagcgataagtcctaatatgtatgaagaaccctccactaaccctggagagtgaactatattggatgccccccacccttccacacatttgaagaacccgtatacattaaatttagacca

SEQ ID NO: 613218 - DNA, 334 bp, Homo sapiens
aaatggaagcctgcgaagttaatcatgcaagacattgatgccactcacgtctttgtaatagcagaatatgattaacatcctcacaggagcgagcgggtgaattaatggaccaaaatgcttattcccttacccagaaatgaaaatactcaatatggaccattcaaggaattataagcagcaaatgtgaaagactagcacactcgatatatatagaagacagattagacgtagagggttgtttatagttgatttaggagcataccacgggaaagaccaaagagaacatttgttcagaaaaaaacatggaactgattttgttataccatagaattaa

SEQ ID NO: 613219 - DNA, 511 bp, Homo sapiens
aaggcgccgacaccacgccggctaatttttttgtattttttgatagagacggggtttcatcgtgctacccaggatggtctcgatattctgaccttatgatccgcctgcctcggcctcccaaagcgctgggattacaggcgtgagccatgtacccggcctcatctatttattgatattactatttagccacttcccagcagtgtgactgctgtaacaagaacaggactcaatttctaaaggtaataaaataacaaggccatcatagacagaacattgggaacactccttacagggaactggcttttcttttccagccaggtgccaggtagcattcctgaaatacccgccacctggtccccaaacagaggcacatcttcgctcatcccagccccgggcttggggggcagtggtattctggatggccatctccctgacccctccccgcaaccaactgaccttgtgatccacatgagctcggactcccaaagtgcccagcactttgggcttacag

SEQ ID NO: 613220 - DNA, 323 bp, Homo sapiens
  misc_feature (19)..(19): n is a, c, g, or t
  misc_feature (48)..(48): n is a, c, g, or t
  misc_feature (67)..(67): n is a, c, g, or t
  misc_feature (101)..(101): n is a, c, g, or t
  misc_feature (107)..(107): n is a, c, g, or t
  misc_feature (130)..(130): n is a, c, g, or t
  misc_feature (146)..(146): n is a, c, g, or t
  misc_feature (182)..(182): n is a, c, g, or t
ccccggctccgggggctcnggctgcccctaaggggccccctggcccangggccccaagacccccaancccataaatatcatccccctgtggtgaatcaggnaaaatncccataagactaattttaaaaantatagcctgtagacantcatgtagtgctgtttcccttcacaaggtgatttantctcatagaagtgttgccaattttgaatttcctgctgacttaattatacttgcctgaccaaggtcaaaaaaataaaattctttctcaacttctgctaggtcaggctaaactgatacattcagttcctttaataatagtctt

SEQ ID NO: 613221 - DNA, 271 bp, Homo sapiens
ccccctttttttttttgggggggggggttggtttgggcccggggttttaaccccccccggcccccctgggtgaatccccttttttttttaaaccccaaaaaaaaaccgggggggggggggcccccccttttttccccctggttgggggggttggggcggggaattccttttccctgggggggggggggttccgttgccccaaatttggcccccgcccttttgggcccccggggggggccccctttcccaaatttatttattttttttttta

SEQ ID NO: 613222 - DNA, 243 bp, Homo sapiens
aaatataggaatatgagtaggtaaagggtgtttgggcagtgtgtggatgtcagggagtagacaatgtttaagttacataatccctggatgtcatgggtgctttagagatttccccccaggagcatggtttctttggcggattaggactgaattattttattataaaaggtaggtaatcatgctatagagattttggagaatggaaaaaaaaattacctataatctcccccatccacaaccgga

SEQ ID NO: 613223 - DNA, 294 bp, Homo sapiens
atcaccatcacctccaccaccacttcctgggctgctggattgtctcgttctgttttgtttttttgagacggagtctcgctctgttgcccaggctggaatgcagtggtgcaatctcagctctctgcaagctccacctccagggttcaagtgactctcctgcctcagcctcctgagcagctgggattacaggcgcgtgccaccatgcccagctaatttttgtatttttagtagagatggggtttcaccatgttggccaggtcgacccggccgcgaatttagtagtagtagtcgacc

SEQ ID NO: 613224 - DNA, 759 bp, Homo sapiens
agcggggtagtcttgcaaccttgtggaattgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaagaaaaaaacatagacatggacatatacgcagagaaaaaaggttattggtcgcctggtggtatattgccaatggctcaataaaggctcggggggtccctggttctattaggaatacctgaattaagccaacacaatgatcttcggtttcaagtatgtggcggatcttatttttgtcaaaagcaaacattaaacagaaaggctcaagatcctggctggttatgacttatagggggggtaaccctaatagacggaaactggtgagcggtaatcacgacctcttttatcacttttctgggtgaaaccttgagaaccacactctgtgttgttaacagatctcatgagccttgtcctggtgtctatattacctgaggtattgccgcactctatcagtggcttgtttggtcccatttcccttttgcccgtcccaagttccttttctccccagtaacaaaaactgatggcagcatgggggaaatttgctgcctgcgctatatatgttttgccactttccggtgcccccgttggtgtgcttgtaccttggagcacgaaaactatttggctcctatccccggtaaaccc

SEQ ID NO: 613225 - DNA, 229 bp, Homo sapiens
cacgaggtggatgggtctccttcctcaaatcataagggaatagtcaactacctctggactctaaatgtggggaccccatcaacatgggaggtgttaaatcactcagaacatcatcctatcctttttctttcaaacctgcatgagggaacctactcttttcacctgaaagtgaccgatgcacacggtgagagtgacacataccggaccactgtggaggtgaaacctgatc

SEQ ID NO: 613226 - DNA, 206 bp, Homo sapiens
  misc_feature (51)..(51): n is a, c, g, or t
agtatcgccaacacacacacacaaacacacattatattctttttttcttgnttgagaaacagggtggctattttggcaagctgtctcaccctcctgacctcagggatctgcccacctcagcctgccaaagtgctgagattacaggtgtgagccactgcgcccagcctataagacatagctcttgacttagaggcactgatacaaat

SEQ ID NO: 613227 - DNA, 178 bp, Homo sapiens
acaacattataaatacacctctagttaaaaacctccagtgtctatctctcccataaagtcttaagtataaaatggtttacatttttcccatctcaataaaacatacagttgtattttggtaacagtactaatcaaattaaaaattacacctagtgatgttgcctttcggagaagaggg

SEQ ID NO: 613228 - DNA, 563 bp, Homo sapiens
aagagatatgcagaaacacgtaaagccagtgctgattgggtgagaagaaatattgaactgagtagttaaaacaagagtcatgttttagaacaccaatacatgtattcacttttaatacaagataaatgtatggagtgtaaaagaataaatctggtaaaaaaagcaagaggtgtagatgggtaaagtgatatgggggggtcgtcctgaaagatgagtatgagtggattaacagaatatggatgttgtatctgcctaaaagactgagtacagtgtcatgggagatctcgatcattgtcactcagacacggaaaatctcgacatcatagcacagcaagcaagtccgtcgccttaaaaatagctcgtgactccgctatcagtctacgcatcgtcactacacccacaaggacccgccacagaccaccataggggaaggcaagagacccccacgtgccctccaccaccgccgggaccgcacgagggacgcaaacggcacgcccacaggcaacccacgcgcacccacaggggaaatgaacacagagggcaccacacgagaacacaggccg

SEQ ID NO: 613229 - DNA, 228 bp, Homo sapiens
aactagatacagtgtttattgttcaacaaaaaacaaaatacaaaacaacaacaacaaaataaaaactgcctgcggagaatgctgagccttgtgtgtccccaagggaagaaagtgtcgttcccatacagccctttgcgcttgggcccctggggaacctagttgtctcatgtttcgaacccatgtggttgtgctgtctggccacatagtgggtaccccaatgtcgtgaca

SEQ ID NO: 613230 - DNA, 426 bp, Homo sapiens
  misc_feature (9)..(9): n is a, c, g, or t
  misc_feature (91)..(91): n is a, c, g, or t
  misc_feature (107)..(107): n is a, c, g, or t
  misc_feature (137)..(137): n is a, c, g, or t
  misc_feature (141)..(141): n is a, c, g, or t
  misc_feature (143)..(145): n is a, c, g, or t
  misc_feature (147)..(149): n is a, c, g, or t
  misc_feature (152)..(152): n is a, c, g, or t
  misc_feature (175)..(175): n is a, c, g, or t
  misc_feature (184)..(184): n is a, c, g, or t
  misc_feature (187)..(188): n is a, c, g, or t
  misc_feature (192)..(193): n is a, c, g, or t
  misc_feature (209)..(209): n is a, c, g, or t
  misc_feature (223)..(223): n is a, c, g, or t
  misc_feature (251)..(251): n is a, c, g, or t
  misc_feature (258)..(259): n is a, c, g, or t
  misc_feature (263)..(263): n is a, c, g, or t
  misc_feature (267)..(267): n is a, c, g, or t
  misc_feature (270)..(270): n is a, c, g, or t
  misc_feature (272)..(272): n is a, c, g, or t
  misc_feature (276)..(278): n is a, c, g, or t
  misc_feature (282)..(283): n is a, c, g, or t
  misc_feature (287)..(287): n is a, c, g, or t
  misc_feature (294)..(294): n is a, c, g, or t
  misc_feature (298)..(300): n is a, c, g, or t
  misc_feature (331)..(331): n is a, c, g, or t
  misc_feature (336)..(336): n is a, c, g, or t
  misc_feature (356)..(356): n is a, c, g, or t
  misc_feature (370)..(371): n is a, c, g, or t
  misc_feature (374)..(374): n is a, c, g, or t
aaaaaaaanaaaatatatccactccactctgtactaaaggaaaaaaaaagctttaccaagtacaagaaatcaactaacttgatcatctttntaaggcaatgattgancttttcatttcacagagcataatccatcantttncnnntnnngcnccctagattataaagccaaagangccaacccncanntcanncccccccccataaaanccgtcaccgtcccncccccccccccccaggcgccccccaccnaccacanncacnaccnccncnaaannncccnnaccncacccanttcnnngactccaattccacttgagagtctaggaganaaccngtgaatgcccactacatacngaagaggagagaannagngagcaattgcaccaaaccgcaatcaggatttggacccaatgcaaatgtgcac

SEQ ID NO: 613231 - DNA, 540 bp, Homo sapiens
cacagtgttgagatcatccacatcactgtcttcgacctccacaccttgtcccactggaaggtcctcagaggcagtaatgtgcatggagatgtcatctcctagggcaacaatgcctccttctggatacctgcgaaaggccctgcttgaggctgttttacagttaactagtttttgttttgttttgttttgttttataagtagaaggggctggtgctgtggcttatgactgtaatctcagcactttggagactgaggcaggaagatcactcgaacccaggagttcaataccagcctgggcaacttagtaagaccctgtctcaaacaaaattttaaaaattaacctggcctggtggtgcacacctgtggtctcagctacttgggaggctgaggaaagatcatttgagcccaggaggtcaaggctgcaataagtcttgttcacaccactgcactccagcctggacaacagagtgagactctgcctctaaaaaataaataagtaggagtacactctaagataacaattaaaagtgtagtatatta

SEQ ID NO: 613232 - DNA, 652 bp, Homo sapiens
  misc_feature (532)..(532): n is a, c, g, or t
  misc_feature (536)..(536): n is a, c, g, or t
  misc_feature (544)..(544): n is a, c, g, or t
ctgttttcttttcctctcttcctttttgagggagtggttacatgtctccatggcttccgataatcgcttctcatcaataaaagggattaacaccacagcttcccattcctgttgtttcccatttaggtcagttttaaaatcaggtgggtaatattctataattggtgagtcttcattggtcatcaaatgctggtagcatgcaggaagtaaatttttgctggctgctggaagtacagcaagaagctgttcaaatggcttaaaaggttttcctagttcaaaatggattttgagtgtactgatgttgtgtatatcagacaggaaaggtgcataatgataaggataataccagctccaggactgaactccatgatagtaatagtgcaaaatccactgtattgcctgaacataacatgcagcttgatcagccagaaagtcatcagatactacgtcaacccccatcttcgtcatgtaatatgttcttttatattgtctaaactcagtttcaaataggtcatcatcttcagtctcatcntctnaattatcnttagaagttatcatttcgccttcatttttgtctaaagcagtccaatacagagaattttcctggccctttaactttttcttttccttgtagttcctggcttcttcagct

SEQ ID NO: 613233 - DNA, 180 bp, Homo sapiens
gggatcctcttgagtctccctgaatcattgcgagcagcggccgagacaattgacagtcaccgttgtgactgtcaaacagccgctagcttcagcccacacctccacacccgcatctgcctccccaatggctgtcagttcggtaaagtcaccctctccttctactctgtatgggggatctcg

SEQ ID NO: 613234 - DNA, 720 bp, Homo sapiens
ggagcattgccggaaagtcaatcgagtatctagaacaacccacccgatgtcctggggcgctgggggccagcggatatgctagcgagcacgaacgtctctgcgctaggcggtgagggtggcctgctagagccgtgctcgaggaatacgatgagccatcagccagctcatgcaggtcatcggatcacagccggctcggaggagctgggatgggcatgggggcccggtgactggacctggcctggcagcttactgggagcagtgggcctccaggagcagctcctcctccagctcccggagccagtcggaagggtcaccccgtcatccaccagctcttccacccgtgccagcccagccccttctgctccagcagctggctcagcaacgtagcccgagcccggcgccgaagttccggggaatggagccaagcacagcgagccagcccgaccacaagccgcatccaagtgagcgacctccagagcatccgtggccacgatgaacggtacccagctcggggccagcaggctgtgccacgcaaagtgggaccgtggccagttgtgctgaccgccgggagataatggctcccatccatacggacaaacggcggatgtccaggagcgcctggttcccgtaatgtgccatctggggagtcgcttgccgcaagaccggggataaatccaaaataccttgaactcgcccagttccagcaaggcctgggcatgt

SEQ ID NO: 613235 - DNA, 406 bp, Homo sapiens
ctgttttcttttcctctcttcctttttgagggagtggttacatgtctccatggcttccgataatcgcttctcatcaataaaagggattaacaccacagcttcccattcctgttgtttcccatttaggtcagttttaaaatcaggtgggtaatattctataattggtgagtcttcattggtcatcaaatgctggtagcatgcaggaagtaaatttttgctggctgctggaagtacagcaagaagctgttcaaatggcttaaaaggttttcctagttcaaaatggattttgagtgtactgatgttgtgtatatcagacaggaaaggtgcataatgataaggataatacctataaaacacaactgagtttaaacagtggcatctttatgaattaggctgagacagcaaa

SEQ ID NO: 613236 - DNA, 928 bp, Homo sapiens
ggtccttcttacctttatgtcttgtagagcccggtgatggcttgcatgccgaaagtggtgcaaggttcatgaacatgctgtggcaatagtggtgcttgaccgtgtgctggtacgctatctccggaggcaaagctgactatcgtgacgaacattgatgatgtgcaacctcacgatcgccccttacagccatgctctggttggctgggatttgaccgtgtacctcccgccaaagctgcagagcttgcccagtgggcaaagaagcaagatcgaccaagcatgatcacacgataaatatcgttgtgtgaaagtgtctaacgtacaattcaacctagttgccgcacaaggtacgtctgtggtatagtcccctttggacaaaaactgtctgtcctattaaggatgtcttcatgagatcgctgctcgttaatgaggcaaggtcctcggatggggagggccaaatggtccaagtttgacagagagcatataaggactaggcaaatgaatcacggttggttcttccatgatagacctggcggtcatccagaattgcttatgtctgggagtctattatgaacatttcacaagggggaaaaccttcaaaaccacaggataaggtagagtacagttcgcggcagtgactcacgcgtcgcgcccaatacaccttggcaaaaccaataaattctgcgtggtctgtcgtgcgtccatgggaatattgggcccttattaccacgtgtcgtactatacgggaagtcaagctgcagaatgagaacaaccgcgtgatatgttgaggccataatggcggtgcgtgatggggctctccgaacgcagcgtataaaagaccgttcactcggttgtgcacaacgggttcagttctctctggatacaacgccgctgcaatttgagatataagcgagtgccatttacagagggc

SEQ ID NO: 613237 - DNA, 1478 bp, Homo sapiens
  misc_feature (343)..(343): n is a, c, g, or t
cggccgcccttttgggtttttttggcaacatacgttttaattactcaaggacaaccgggacgtcaccaatggcccagctatcagggggggcatagtagtggtgagactcacggctggaacacaaaatcactggtggaaggcctggtgctaacagcccgagggctacttttgggacaccgcaaaagagacactgtcgggtaacatgtagaaacctgtgactatgtgcgttcgtgaaagacatgtgttgaatacatgtgttctttattcctctgtgaaaatgtgtttccctttcctcgtgtgtctgtgccagtgcttccccaagatttttaggtagcctgtctcncagaggggacattcatcgaatgtggtctgtgggtatacacataggctcttgtagggccttaagtcttagaaaccttgtggggcttaggtgagccccttctgtgccaacaaaactcgaggtgccctgtggggccttgaaagggccgtgtaagcttatgtgtggggccctcccgaaaagccctgtgaacctgtgggctctggggagaaactgtcgggtcagtgtgtggccgcccccaaaggtgagagtgggccctgtgggctttgtggcaaaggggcccaaacacggaacctataataggggcccacagacctccggcagagggattccccccacaagatataaaaaaggtcctgtgtgcaagaacgagctgtgggtcccccggaaagcgttattctgtgcagcagtgtagaggagatgccgtatggaactccggaaacattttccgtggggaaggcggaaatctctacaagaaaaaggatttaccatgcggcgacaatcttccatgggcgccatgaaggggacctgttggaaccccagtttgagaagagcaccttttgaaaccagtggcgccatataacttttgcacaacactattttccccccacaagggggggtatatatccacacatctctctcgtggagcacaacagcgggggtgcctttatgggcttccttttgtttcaacaccccccgaaggtgtttgtggaaaggtttcgcgaaggtcgtacttagcacagttacatttggagagctccacattgtgagaaggtgtcttcggaaacctcttcccccaaaggaattaaagagagaatcccgtcccctgaaattacgaaggccttacccccaagcaatgctctgggggtgaccccacagggctgtgtggggcgcatacaccacggcccaaggagacagaagtgcttaacacaaaaactctctctggggcgcaagaacacgagcgggcctccacaccaagtgtatggccccccgagaagaggccatagacccaacagtggggccaccacgaggagaaactcgacgggctatgggcgccaccacagagggtgggggaaaataaaagggtgatgacaccccggggcccggcgcacgagttccaacttagacacagtataaaggc

SEQ ID NO: 613238 - DNA, 115 bp, Homo sapiens
agtctcaaactcctgagctcaataacctgcctgcctcagcttcccaaaatgctaggattacaggcatgagccatcgcgcggggcccttcgcatgttttcaatgtgcctctttgtg

SEQ ID NO: 613239 - DNA, 136 bp, Homo sapiens
gcactgggcgcgggatgtgataggggcgaccgtctgcgatgtatgtggcaaggtgttcagccaacgcagcaacttattgaggcaccagaagatccacacgggtgagcgaccattacgtgtgcagcgagtgcggccg

SEQ ID NO: 613240 - DNA, 358 bp, Homo sapiens
  misc_feature (105)..(105): n is a, c, g, or t
  misc_feature (124)..(124): n is a, c, g, or t
  misc_feature (135)..(135): n is a, c, g, or t
  misc_feature (167)..(167): n is a, c, g, or t
  misc_feature (261)..(261): n is a, c, g, or t
  misc_feature (288)..(288): n is a, c, g, or t
  misc_feature (343)..(343): n is a, c, g, or t
atggcacatgcagcgcaagtaggtctacaagacgctacttcccctatcatagaagagcttatcacctttcatgatcacgccctcataatcattttccttgtctgncttcctggtcctgtgatgncccttttcctnaacactcacaacctaactgaattactaacatnctcagaacggctcagggaaataggaaaccgttctggaactatcctgacccggccatacatcctagttcctacatcgccctacccatccctacgnatcctttacataacagacgaggtcaangatccctacccttaccatcttcaattggccaccatggtactgaaccttacgagtnacaccgactggaggg

SEQ ID NO: 613241 - DNA, 329 bp, Homo sapiens
ccaggatggagatccagatggcaggcaggtggaagccgcatattgggactctgcaacggatactagaaaatgaacaagacgggaagaagctgaggaatataaagaagcacggttagtactggagttcagtgaacgttagaacgcctgaagacttttctcgatactggggtggttttatgcatttacagtccgtggggtccagttttacaagtccagttattttgtgaccacgtgctattgtgttcacagtagtatgagaatgtgattgtattatatctaggttacatatacaatttctgttgtctatatttaatatcgtcaacataaat

SEQ ID NO: 613242 - DNA, 204 bp, Homo sapiens
cacacaggagttgtgggggaccgggtgtcgtgcactcctcgcgcccggtacacagttgcccggttgggcatgtgcttgggctgcacctgcgggcatctgcctggtcttccagctcaggaacacgacatttgacagaggcttagcgtgccggggcatcaaagaggaggtagtgatttggtcgaaggtgcctggtttagtgcggta

SEQ ID NO: 613243 - DNA, 278 bp, Homo sapiens
gcacccaggcgcacttctcccccttgttttctttttgtttgtttgttttttaaagacaggtctcgctctttgcccaggctggagtgcagtgccccgatcacagctcaccccgatcacagctcactgcagcctcgacctcccgggctcaggtgatcctcccacttcagccctccaagtagctgtgatcacaagtgcacgccacacactcggctaatattttttagttttttgatagagatgggggtctcaccatgttgtccaggctggtcttgaactcc

SEQ ID NO: 613244 - DNA, 551 bp, Homo sapiens
  misc_feature (495)..(495): n is a, c, g, or t
acttatattgacagactgaggtttgagtcccaggcgtggtcagtgtcgacagactgtaataaagaggacattactagtatccacttcatctcgttatgatgcgaaatcaagagacaatgtagttgccagttcctgacggcagaatgtacacatgttggcttcccatccctccccaaattacattacatatttagagtaccaaaaaggaataagtccactaccatgaaaaggtgagggtacgctcatcacttgatgatacatttatactcgatctgaaagtttgaaaacaaattcacatgacagacagaacagtgacagccacagccaaaaaatacattatggaggactaggatggaggctaagcttatctgcccatcagaacccttgggagaaaagaaggatgaggtctcagagaaacaaaggcagaagtaagaagaggggcagaaaatggggaaactagtgccttctccactctatgaacaccgagtatagatnaggagagtacagatactgaggcaaaaagattccaaggtttttctagaaatagcaca

SEQ ID NO: 613245 - DNA, 815 bp, Homo sapiens
  misc_feature (365)..(365): n is a, c, g, or t
ttcagcagattctcccttgcagccctcagaagcagccaaccctgccgacacccattgacaccttgatcttggattctcagcctccggaactttgagacaatacatttctgttatttaagccacctagcccgggtacattattacggcagccctattaagctgacgcaacaccataatactccagataaacacactggaaatcactgcttgaggaatcggaagcccagaggtcctattcttggctttgccactccaagccactccacatcccaggaatgcctgggatatttacatattttaatagagaaaagagaatgacacttgagtaagtcacttcctccttaagcctttgtttcctccttcanaaaagggcaagatcccctccaacatgaacagcttgtatttctgtggcccctagacaggaccaaggacaactgtccacgtcagccacaacctaacagtgttgtcactgtgaaaaatccccatgtcccaacattcaaacacgctgacatcccagtgtcccaccggacctggccacattagactgtagcttccaaaggacagggccagtggattccccactatcaggtccctaaatgatggctgacagggatcctgtcccaggctgtatcatggagcatccttagctctctcaactgcctatctagaggtctggaccctacatccaataaatgctcataaaacttaacattcaagtttacaaatacaaaggcatattttacacattaaaaacctatgcggccaaggttttgttttttttttttttttctcccaactcctaccctcatgaaccc

SEQ ID NO: 613246 - DNA, 120 bp, Homo sapiens
tgtgatagtatagactctagtggccatctcccagctctgcactcacttggagctgtcgctccctatggcaggtcacttaacctctgtgtctcctcttacctcctacatcaaacgaaggat

SEQ ID NO: 613247 - DNA, 793 bp, Homo sapiens
gccgcgcccgcatgagggagatcgtgcacatccagttgcgggccagttgcgggaaccagatcggcaccaagtttgggaagtgatcagcgatgagcacgggatcgacccggccggaggctacgtggggagcactcggcgctgcatggctgggagagaatcaacgtctactacaatgagtcatcctgtccagacggtgtgcatgggaacaactgggcgaaagggcactacacggagggcgcggagcttggtggacgcagtgctggacgtggtgcggaaggagtgcgaggctctgcgactgcctgcaagggctccagctcacgcgactcgctgggccggcggcacggggctcaggcttggtggccagcgctgctcactcagcaaagattccgtgaggagtccccgggcgccgcgtgtcatgaacaccttgaggcgtcatgcccttcgcccaggggttgtcgcaccagcgggtggtgggatgccttacagttgccacacttgtcgggtgcaccacgcttggttggcgaataacatgacgagacctattgcttcgactcgcgaggcgctctatgacgtctggttccgggactctgaagctgacaacgcccacttacggggacctcgaaccaccgtgggtgtcggccaccatgagtgggtgtcccagcgtcggatgcggcttccctgggccagcttcagtgctgaccttgcgcaagctggcggttgaactggtgctctttcccgcgccttggattttcatgcctggcttcgcgccgtcaccaaccggtgcgcccaggtc

SEQ ID NO: 613248 - DNA, 414 bp, Homo sapiens
ccctcctagaaagagcagagatcatggtacctctttgttctccttctttgatgcctgttcttaaaagtctgaaagtcaaactatcattttctaatccttttttgtatcagagagcaaaaatgaaataactaagaaacacaatataatcttactgattgattaaccatgtgcactaaaaaagtaatagggaccggttcataagaactgtcctactctgacttttcaagccagagttcaaagattctttagacaaaggctgaatgagtaggcacttcaactctaacctgtagaatcactaccagctgactatgatacagaaactgagagtagacacaacatgcgatctataacacggcagaaaaatccacaaaagctcatgaggagccaacaaatccagggatctgctgagcagta

SEQ ID NO: 613249 - DNA, 266 bp, Homo sapiens
  misc_feature (147)..(147): n is a, c, g, or t
atccctcatcacggtctcattcacattttctggtatttggtgtgtctagctatgaaccaggtagatccacagaagattcgagagtttgactttctgataaataactgacatgacatcgtccccttctactcactggcattgtgctgntgctgcagctgcattcagatgagggatgacaagccacagctacgaatgcagagcagagacagaatgaactgatctgtgatgacctcatcatgcctgtatcagccctggacagcttgttg

SEQ ID NO: 613250 - DNA, 108 bp, Homo sapiens
agcagctacaacatggtcatcccggaggacaatcagaccaaccgccttcaggaggctctgaacctcttcaagagcatctggatctaacatgtggcttgcgcaccatct

SEQ ID NO: 613251 - DNA, 729 bp, Homo sapiens
  misc_feature (81)..(82): n is a, c, g, or t
  misc_feature (91)..(91): n is a, c, g, or t
  misc_feature (94)..(95): n is a, c, g, or t
  misc_feature (101)..(101): n is a, c, g, or t
  misc_feature (106)..(107): n is a, c, g, or t
  misc_feature (112)..(114): n is a, c, g, or t
  misc_feature (116)..(116): n is a, c, g, or t
  misc_feature (118)..(119): n is a, c, g, or t
  misc_feature (123)..(123): n is a, c, g, or t
  misc_feature (136)..(137): n is a, c, g, or t
  misc_feature (140)..(143): n is a, c, g, or t
  misc_feature (146)..(147): n is a, c, g, or t
  misc_feature (149)..(149): n is a, c, g, or t
  misc_feature (151)..(151): n is a, c, g, or t
  misc_feature (154)..(154): n is a, c, g, or t
  misc_feature (159)..(160): n is a, c, g, or t
  misc_feature (165)..(165): n is a, c, g, or t
  misc_feature (167)..(167): n is a, c, g, or t
  misc_feature (169)..(169): n is a, c, g, or t
  misc_feature (177)..(177): n is a, c, g, or t
  misc_feature (179)..(179): n is a, c, g, or t
  misc_feature (189)..(189): n is a, c, g, or t
  misc_feature (191)..(191): n is a, c, g, or t
  misc_feature (194)..(194): n is a, c, g, or t
  misc_feature (197)..(197): n is a, c, g, or t
  misc_feature (217)..(217): n is a, c, g, or t
  misc_feature (219)..(219): n is a, c, g, or t
  misc_feature (262)..(262): n is a, c, g, or t
ttattgatattaaagtgtgggtttttatgaaatgcttcctcaatactgaaccttagttgacattaatacagtgcggggggnngagagaggnggnnagatgntgaannggcgnnngngnntagncgaaaccgaatcnncannnngcnnangnccnagaannagaangntnctgacacncncctccacacngnctnaangtcaactaagaacggaaatntncagtgtccaggcacggtggctcatgcctgtaatcccagcactntgcgatgccaaggcaggaggatccctggagcccaggagtgcaagaccagcttgggcagcagagcgagaccctgactctacaaagttagctgggcatggaggcgcacacctgttgtcccagctactcaggaagctgaggtggaggagtgctatagcccaagaagacgaggctgcagcgagctgtgggtagaatgtctgcactccagcctgggtgacagtgagaccctgtgtcaaaaaaaaaagaaatgatctgcctattcatacttgtcgcgaacacagagagcacgaacacaactgaaaaaaattcgcggcgcatagacgacgctacatcaacggccacaagagaatgtgacacaggctgcatgacacaatcatgccaggtagatgggcacgctttatccttgtgtacaagcctgagcatcggctaagacaagcactacccgctgacgcgtctggccacggcccctc

SEQ ID NO: 613252 - DNA, 380 bp, Homo sapiens
ggtttgaggtagcaccccgccatttctatgatcgagctctgccaaaattgataagccacagaagagacctaaacacaaacgcattgatgccatgtttggattcttcgtgaacgtgcacctaaactgtcaagactctaagaacaagagtagtgagacaaattaaatcttcctcttgcaacccagaggtctatataagtagtggcacatcagtactacgtgctgtgtttagagtgccgactaccatgccgaatgaccacgcgcacgatttgtccggaatacactcatctttcttggtgaaatataaactcgacgttgacataactttaaacaaaaataaagaaaaaaaaataagattgtgcggccgcacagccttattccct

SEQ ID NO: 613253 - DNA, 310 bp, Homo sapiens
  misc_feature (51)..(51): n is a, c, g, or t
  misc_feature (89)..(90): n is a, c, g, or t
aggtaggcggccaggcacggtgccctcacgccccagtgcctccaacccccncaatcccacactttgggaggccaaggcgggcagatcanngaggtcaggagttcaagaccagcctgtccaacatggtgaaaccctgtctctactaaaaaaaatagaaaaattagccaggcacggtggtgtgcacctgtaatcccagctactcaggaggctgaggcaggagaatcgcttgaacccaggaggcggaggttgcagtgagctgagactacgccattgcactccagcctgggcaacacagcaagactctgtctca

SEQ ID NO: 613254 - DNA, 1069 bp, Homo sapiens
acacgtgtttttgcatacgcgccataaatttagctgggacattcgggcgttgtgggctctatctgccctgtgtggaagtctcctcctagtggtttacgcacataacaccaacccctgtggtggcatcagccccaataggtggaagttagattcctgcgtctctccactatattacatctcaattcaagtggggtggagcccgtctggggtggtatacttgctcaaccaaataaacgggtttcactttctgggaagagaactttcgatactggccccaatatgctttttaaggttggctccagaactaaacaccggggaaggccatagcatccgggtgcaagcgatacaaaggcgtgcgcccatttctccaatgcctgatccaggttttctatcacgaagtcggccctttttatgctgaaaagacttatctgctggcaaacttgtcgattaggaggacatttaggccacgctctatagggtgtgtcaaaaaccctctcttccgttttgcacatttttattcggggaaatttctaggtacgcgaccatgcagcccattcttgctatttacgatattttgctttatgttttcccgctagttactgcttatcgtgggtcgtttaataagtggtggaaaaccccgagagctaaccgttacacacttccatgacatctcatagttgacctgttctattctttggtaaccagatcgaagtagctgccccagtgtatattctcgcgtttctcgcgcgtccatttgttggaaagaaggtgagattgcagtcgagcagtcccatcctagctcctcattacctacttctatccttttccaggtcctgacagtagtcaggtggaagagtccctgggtttatgtcccaaatcttagcagccttgcaattgttgggatgtggactggacgtgtgtataatagagagagagagaatatgtgtatgtgtgtgtgcgtctgcgagcgcacacacatgcacaagtgcgaaggagattgcgcttgctccatgttctgactaagggctatttgattgtgcactgtggggtctgtctgtacagtttactc

SEQ ID NO: 613255 - DNA, 196 bp, Homo sapiens
gacaagtatggtgtatcatagagcagtgagaagatgaacctgagatgaagcagtgtgactgtctgacagtcagccctggagcgaggggatggaataacccagatatatccactggctcctctccaagcttcagccatgccatggctggcacatcactgcctcgtagcagcttgggtcctgtgtttgggtccggact

SEQ ID NO: 613256 - DNA, 787 bp, Homo sapiens
ggcgtggcagtggaccacgatggtgttgtcacaagatgggtcgaagctggaatgattgaaggttgcgtgttccgcgggtgtggaggaggtaagttgcccctggggtgcgacggaatggctcttataagtggggtggtttgcccatagaagatgttgccccgttgggaatgcgtgccggtcgtcacatgggctgagaatccaggtttgttagataggtatgaggcggaacgggaagatggtgctttgccctcatgttgcgtggctgtagagccacgggggttttgttgtgcacgggttgttcagcggggtggcaaacgctactttgggtgtttcaggccgtggagggagtctttctacgtgggagtgtttctcccctgatgtccctttattttcgtggccgtgacataggaatttcttgttaatgatcttacgttcactttccactaggctgaaggtgtgcgaaggatatgggctgagcataccccacagtagcccgctggttttcacgccaacagaagaaagccttgatgtcttttcatatatcctgagttgtcagaaaatgggggaacttgtcacgaattttgagcaacagcgtaaacggtgtagtaatggtagcccacaaatggctgtttaactatcttgggaaaggaggtaattccccaatagattcccttttttttttttttgagacggagtttcacttttgttgcccccggctggaggttgcagtgaccgagattgggtcattgcactctagcctgggtgacaaggtgagactccgtttcca

SEQ ID NO: 613257 - DNA, 368 bp, Homo sapiens
caggcacaacgtagagagaacgcccgaacgaggatgctgccgaaccagcaggatccgaggcaagcgatcccctcccgtccgagctgagccaggctgtgcccccgccacatcacaatacttacaaaacaaaaccttttctgcttggcgggataacaaatcataaaaattcgacataataaattagaggtttataaaatgcgggtgggcgggtcagaggccgttgccactgccgtgctggaccagagccaccttgctcagctccaccacggccgagcgcggctcgttctgcatcttgggcacccgctgcactagctgatgtgcctcgcggtaggcgtggcgcagctcattctttcactgcactagctcag

SEQ ID NO: 613258 - DNA, 839 bp, Homo sapiens
  misc_feature (836)..(836): n is a, c, g, or t
ggagggtacgtggatcgcggtgcggagactgaggttagaaggcacaggtggcgagatgagccgggtaccagcgttcctgagcgcggcgaggtggaggaacacctccgaagtccagcctcctcatcccgcctctagagacggcctggccaaattctccagcggtcccgaagagggtgtcatgcagccgtgcgcaacgtgtgccgggtgaccaagcacaggggcttaccctgggggtcaatgcccgctacagtgctgcagaggatgcactgaccacaagtggtcaccttctacgaggacccgggggatcaacctcggtcgtcccttcccaccaggtactgtggctactcttgtgagcccagaatgcacccctgcttgggggtcatggatggaaatgtcataatgcaaagagaaacagttgcagttctgccatgtgccaccaagggtaagatgaattggttggttgtatcaattaaggtgagctgtcaaggtggggtctggtgtctcaatcttgaggagataagggagagggggacctatttgggttcctggtggacttagctggcatcccgatggccatatatcaaggatcaggcatgtttagcgccccattgtgggctttgcacgatttcacgggcctatggctatatcaattcccaagttgggaacgagaggagtactcccctccggcgatatggccaacatggtatgcggccaccaaagtggggaataaagcatccggcgccggtgcggcacacacgacacaagactacaccacaccgaaggacaacctcttcatgctggtggtgcggcctggcgctgtgctatgtcggctgggnttg

SEQ ID NO: 613259 - DNA, 282 bp, Homo sapiens
taattcccgccaccttgggaggccctggcgggccagatccaccaggtgaggagttcgagacccgcctggcccaacatagtgaaacccgtctcccacttaaaccaccacaaactagctgggcctggtggtgcaggcccgtagtccccagctactcgggaggctgaggcaggagaactgcttgaacccgggaggtagaggttgccatgggcccaaatcgccacccctgcactcccagcttaggccaaccagagtgagaccttctatctccaaaacaaaaaaaat

SEQ ID NO: 613260 - DNA, 657 bp, Homo sapiens
  misc_feature (14)..(14): n is a, c, g, or t
  misc_feature (66)..(67): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (113)..(113): n is a, c, g, or t
  misc_feature (116)..(118): n is a, c, g, or t
  misc_feature (122)..(122): n is a, c, g, or t
  misc_feature (146)..(146): n is a, c, g, or t
  misc_feature (154)..(154): n is a, c, g, or t
  misc_feature (156)..(156): n is a, c, g, or t
  misc_feature (166)..(166): n is a, c, g, or t
  misc_feature (183)..(183): n is a, c, g, or t
  misc_feature (194)..(194): n is a, c, g, or t
  misc_feature (200)..(200): n is a, c, g, or t
  misc_feature (206)..(206): n is a, c, g, or t
  misc_feature (212)..(212): n is a, c, g, or t
  misc_feature (249)..(249): n is a, c, g, or t
  misc_feature (268)..(268): n is a, c, g, or t
  misc_feature (306)..(306): n is a, c, g, or t
  misc_feature (311)..(311): n is a, c, g, or t
  misc_feature (313)..(313): n is a, c, g, or t
  misc_feature (377)..(377): n is a, c, g, or t
  misc_feature (419)..(419): n is a, c, g, or t
cccagccccacccnggcccttcttggcattcttcctcttcacgcggcccgggcggccacccccgtnnaggagcgcagagagaagtcgatgtgcttttngnaatncaggcgganaannnaggncgggatgttcaccacctgcttgcngaccctgntntggggctggngggtcagcacgcgagcntggtggatggncttggnaaaaancagcangaagttttgggtctgcaggcgtctctctaagatatcntctatcttcaggcccaggntgtaatctagcttcatcttgccctcatccagcaccccnatgtngnccagccgccgcagcagggcgttgccttcgaacagacgccgtgggtccttctcatcaagcgtcanagttcccgggcggccttgcgggtcttggccagggtaaatttnaccctccagacctcacgtttgttccggagcccatactcgccgatcagcttcagctcttggtcgagacgagatttctcgaagggtctccgcggggtcacataagttttgcgacaaacccagctccgggccactggcatgttggctccgcttccccgtctgcgctcatggaaactcggaaggcccgggccaccatccaacccaaaccctagagaaaaagcacaccaccgcaccgcaccta

SEQ ID NO: 613261 - DNA, 801 bp, Homo sapiens
  misc_feature (801)..(801): n is a, c, g, or t
gtaggaactttaattatcacaagtccagaagaggtaaagtatacttgcccaattgccacacagcaagcaaggtggcctgtccaggatgtgatcttaggttggtctgactgcaggagcccccaccctcactttccaggtgtgttgtgatgtgggtgtcatggaacagatggtgatggactattggtaatgctgtgatgccccatggcactggtatgtgtgtcctgggagaaataatgtggtgtgcatggtgtgtgccatggacgctcaacatgggtgtgtcccctgtgccctgtgtgcctgggagaaaatgtgatgccgagattgatatgtgttgtgatgtgttgcaagtgtgtgcatgctttgggtgcatgctcgtgatgggatgtggggtgtcatgtgttgagatgtgcgtgtccttgatgagatgtgtgctttacactccatgggaacccgtggtcctattgtggggcgcatgtagtgtgtgtctactcaatgctttgtgcatgacaaaaaacatctgcggcgtggtccacagtgagcaggtgtcccaacagcggggtacagaagttaccatgtgtgtggtctcccccaaaagtcaacaggggggccaagatgcgtggataagtacccatgtgtgtgcacctgtgtacgtttcgactggtggacgaacacctgggctcaatgtggggcttgcaatgtttgggaccatggggcaacagcacaagatgcctgggtgggttaaccaacacagaaaattgtgactttgagaagtccttcctttgaaacccttcccagggattn

SEQ ID NO: 613262 - DNA, 783 bp, Homo sapiens
cggcctctcctcaccgcgaccgtccacaatcatacatcatctccatgaatttgttctagctgaggtgttgagcacacgcgcgatgaggagatcctattgactggaccaaggatcgagcccagctgtcaacttcctcaagtcgcctcaaagactaccgtggaagaccccatcggggaaagtccgtagcgggcccctgacggggtgagcgcgggttccagctggttttgtgcgttctcctgggcatcgttgtatgcgcagtggtagggtcccgatggtgttccagaatgcggcagtgatcggaacaagcgctatctactgagttggcgcctccggtaggggcctagtccctgggcccaggatgcctaatgtgaacttttgtttttgtacacgggattataaagagaacaagcaagatgacgattatttcgtgtaagcgtgtttcataataaatgagttaaagtattttcatacattttgcttcttgcccagaagggacaggtggcagagccgaggcttagggtctggcaccccccacagctggagacggaggctctcctggggaaaggtgtatccaggagcaggggtctgtgtctacagatgggctgtggcccctgtcaggcagctgttgacgctgggcggtcccccggcactctggggtgggctcctgggacgctggggaagtgctgttgtttggctggtgtgtggcacgtgtggcgacgggtgaggccgtgaactgggagccgcgggccgtcctgtgcaccttggctgcttcctggcagagta

SEQ ID NO: 613263 - DNA, 182 bp, Homo sapiens
  misc_feature (16)..(16): n is a, c, g, or t
  misc_feature (24)..(24): n is a, c, g, or t
  misc_feature (67)..(67): n is a, c, g, or t
tacaatagcatcaatngtgccatnacccagttctcttgcaacatctcccacctcagcagcctgatcnctcagctagaagagaagcagcagcagaccaccagggagctcctgaaggacattggggacacattgagcagggctgaaagattcaggattcctgaaccttggttcacacctccaga

SEQ ID NO: 613264 - DNA, 295 bp, Homo sapiens
  misc_feature (149)..(149): n is a, c, g, or t
  misc_feature (151)..(151): n is a, c, g, or t
tttacccccccccccccccccccccccccttttttcctttttttttttgggggttaggcccaaatttggggggaaagaaagggtttgggtctttgggcccaaaaaaaaaaaggcttgggacttttttaagggccccccccccccggggncnccggtttttttccaagggggggccaaacccccgggggtttaaattaaaaaaatgggctttttccccccaggggaatttcttttgggttggtttttttaaaccggaaaaccccccccccccttaaaaaattttttttgggggcca

SEQ ID NO: 613265 - DNA, 148 bp, Homo sapiens
gggcaacattgtgcctcgaccagaccctgtcaggactgtcgaagaagccctgctgcgatcatctgtgcctgtcatgcacaatgcttgtacctgctgtgcactgctgtgcgattttactgttgctgctggttgactgattgcaacatgc

SEQ ID NO: 613266 - DNA, 121 bp, Homo sapiens
tagaggatccccataaagccgaagatgtggtacgctcaagtttgcagacctgacagacgctgctgcccgcaacgcgggagctgctccgccaggccaagcacgaagccaaccgtggactagt

SEQ ID NO: 613267 - DNA, 486 bp, Homo sapiens
tcccgaggtcggtggatggagcaaggttgaacagactatatcaggtatagttgtgcatatgaggactcccataataccctcagaggaactcagatcccaatcggtattatccaaagacacgatcgtggccagttaggcagaggagatatttgcctttctctctctaccagttcctcatgggaggaggatgcgctggaggccggggaacgagtaacagagatgtgtaaaaggctagtaacccaggccttcctgtttagaatccaagttagagctttgcctgaccaaggcaggaccttacataaaatcaaaattgagtttgagaactgaaatgtagattgatcaggctgggcatggtggctcgcgcctgtaagtcccagcgactttgggaggctaaggtggttggaccacctgagttcgggaatttgagaccatactgaccaaattggagaaaccctgtctctactagaaatacaaaattagctgggc

SEQ ID NO: 613268 - DNA, 114 bp, Homo sapiens
ccatatgggtcatgatgcaggctccagttgtctcgatgcgtggtggcgtggctcagacggacaatcgtgctcgaactggcgcgcgtcgacctgcgccttgttcgaactcgaacc

SEQ ID NO: 613269 - DNA, 298 bp, Homo sapiens
agtgtcggcacgtggcttaatgccatgggtggaggaagcagctactcctatgacagtggtcttggcgttggaagtggcttcagttccagcagtggcagagccatagggggtggcctcagctctgtaggaggcggctgttccaccatcaagtacaccaacacctcctcctccagcaggaagagctataaacactaaagtgcttctgctagctcacggacacacagtcctcaaggcccaatctctgactgcagagccctctcctcatgtagcctttcggaaaagaggggatcctctaaag

SEQ ID NO: 613270 - DNA, 1352 bp, Homo sapiens
tcgccgtttcccattcgctgggcgagcaggtgtctatggcgagcacccgccttagtcgccgccgcgtaccggcaccgccaccgccaccgccggcgagtgctgtctctatggcgaggaggaggaggaggagcgcgagctcagcgacactaagtacgagtaaataaaggataagagatatattatgaaacaaatcttcaatcaatgtataacactttagagtgcttgagcgatctagacgtccgcttggtgcccatcactatgcccacgcgcgcaacttgtgagatcactagccataccgtcaacttctcgtgaacgtttgcggctcttgccaccttggactgcaacgcagattgacaggaacatatatgcgctcacagctatatccgacgaaatactaattacggtcgactactcggaacgaccgcagttttcccatggtgtgcgtctggcagagaactccgattggcacgcaatgccaggtagccagatgcctgtacgtatccacataccaacacgtactcgggccgcgctgcctcccccgctgaggaccgtgtgctcttaggccgacacctaacttcaggcccgtaggagacctgacaccagttggcactgcaccgtgcagcccgaccgggcacgcacactaccccggatccgagggcacaccctgccatacgcgcttggcgcccaaggataaaagagcttcatcgagcacgtcttccacgtctccgcaccgcggagccgaaggacctggctcagtgcccccacgagcaaccgttccttacatgagcagccgctaaccgttaagcataacacgagtcctaggggtaacttcccaagacttgtgtaacaggctccacatctcactggcaacgcggacagcggccaacgcgcccacatggtggacaacaatcgccgccaaagcctaacgtgaacagacgacgcacagcaattatccctcaccttggcagcttcgctagtggccacgacctcgggatttccccatcccattgcctggcccagcgcagcgggcgtcccacaaccgcggccgttctggaccacaagttctgccacgatacagcacggcggcgacatacacggaagcccttttaggcgcacactaactctcatcgacactccgcagctgtcagcatcacatgacacgccgcaggcttctgctacacgctgtcgacgtgcctggaatacgccagctgaacacgttctgccacccatcctccgtcgtagacccgcactccactctcccgagacatgggaccactgagacaccggggcctgcactatcaacacgacacacgagcgtgacgcaagcctaacctacgtctacgtcgtacacg

SEQ ID NO: 613271 - DNA, 147 bp, Homo sapiens
tacaaaagcagcagaaagctcatagatcgagcgtacaaaggaatgcccataaacatccgggagcccgatgtggtcagtcctcctgaacacagagaaaatgcagttgaaaaaacccggaaagataacagaatcatgaaaggcaaaggg

SEQ ID NO: 613272 - DNA, 339 bp, Homo sapiens
agtcgtactgatgacgaccgtttcgttgactcacctgtttaccacaccaaacccaactaaatatcatgccaccatgccagagactaaattatcctatactatcacggacacataaaaatcctgactaaatatatgtaatacttgtgcaaatcagaaggttctgttgcttctgcatgcgatgaaacctagaaggggcagacacacaagaccctctcccactacaggcaatataaggatccagtgaactgtatgtaacttaccaaaaagaacatttcttaaaaaaactgtgtctataaaagatggtataatagtagtacacaatacagccaagttaaaaag

SEQ ID NO: 613273 - DNA, 855 bp, Homo sapiens
gagcggacaggatgcaggcgacttgagacactaaaaagagaagctgtcctctcgtgatccaggcattgcctcgctgcgtttctatttctccaagacgggcatgagcgacttgtacagctcatagagcgagaggttgcgggctcgtatcgcgtatcgcttacgactactgacatctttggctgcaatttccccccatcgtcctctgattctcccacgatttgccatgtgagaacccgtgagaagtggagaatggcagagggcggcatgcctgctccatctgacgaccgatgcctacgttccctcgatgcctcggaccccaggaccgaggctcattctcggcaagcgtagtaaacattgtggcgattaatcttatgacacacatctgaatagaccgccgagtgtacccttttactagtgctacctcggtttaattcgcctcatagctttaatctaaccccaaatgtagcatagacgaacattggtcggcaccctagggtcatttgagttttccattgtgccttctccgaagaatccgcgagttaagctccatgcacgaagtttacattgaattcgacatccttttccaatagccccactttcaaatcttcttgggcaattacttaggtgcacggcgaaccagcggatggaccttgtccgaacatgttaacttgcaacctactctggttgggtaaaggtcttccttattccgagaacttgtgctcggaatcaaatcacttgcacacaacactaggtggagtcacacgtataatataaacgggcggtgaaacacacggactctccgttgcctgcgtcacacatgcgaagttacaactcaccacgttccccctcaccgtg

SEQ ID NO: 613274 - DNA, 118 bp, Homo sapiens
ccagttaaagcctttaatgctttaaggtgaaaacgaaatcccatccggttttcggtaagatcgccttctccgagcgtatatggacgcctcatgcatacactgttgtatgtacttggaa

SEQ ID NO: 613275 - DNA, 299 bp, Homo sapiens
cggaccgaaactgacatgaggcaggtggatcacctgaggccgggaattgggaccagcctgaccaacatggagaaacctcgtctctactaaaaacaccaaaaattagccaggcgtggtggtgcatgcctataatctcagctacttgggaggctgaggcaggagaatcacttgaatccaggaggcagaggctacagtgagctgagatcgtgccattgcactccaacctgggtgacagagtgagagagagaaaaaaatatatatatatatatgtattcttactgcttgggtatactaatatc

SEQ ID NO: 613276 - DNA, 451 bp, Homo sapiens
  misc_feature (37)..(37): n is a, c, g, or t
  misc_feature (45)..(45): n is a, c, g, or t
  misc_feature (71)..(71): n is a, c, g, or t
  misc_feature (125)..(125): n is a, c, g, or t
  misc_feature (235)..(235): n is a, c, g, or t
  misc_feature (258)..(258): n is a, c, g, or t
  misc_feature (299)..(299): n is a, c, g, or t
  misc_feature (302)..(302): n is a, c, g, or t
  misc_feature (346)..(346): n is a, c, g, or t
  misc_feature (364)..(365): n is a, c, g, or t
  misc_feature (370)..(370): n is a, c, g, or t
  misc_feature (424)..(424): n is a, c, g, or t
ggacaaaatgacttgagtccacaaggacacaaacacntgagtagntgggcagcccttggaagggtttaagngaggaagtaaaaatgatctggcgtagaaatttaagggaactctaggaagaggcntaggtttttaaaatcctgtctctttgtctgaccaaaagaggatgagcctctattaatttttaagaagggccagttgtgttttatgttctgggaacttcattcatttttanaatgggttgttgatcagggcagnaatttagaggagcggtttatgtttggaggtaattggtcctntgnccaaaaaaatgagatgtaagtctaaattaccagtttatcttttnggaaaaaaaaagtggacnntttantggaaaagaaaacagcaaacggcacagaacagttgaatagattaatgaaaaacnacagtaaaagctatggtaaccactaaa

SEQ ID NO: 613277 - DNA, 193 bp, Homo sapiens
ctatatggtctaaaagtgggaggaaccctcagttccaggaattgcccacccctttctgggaaaactcatgaataactcactgcttgtttagcatataagcaagaaataaccaaaacactagccaaccagcagccctctgcctatggagtaaccaatcattctaagattactttcttaataaacttgcctattc

SEQ ID NO: 613278 - DNA, 111 bp, Homo sapiens
  misc_feature (86)..(86): n is a, c, g, or t
catgcaggagagagaactgcaacaaatatgtgagtgcagatacctcttagggatactgatttcctatattgttgggtatatacctnatgcagtgggactagctggatcata

SEQ ID NO: 613279 - DNA, 335 bp, Homo sapiens
ctcgggttagctgttgcgcttcctattcacatctcctacaattagcactgttgccatccactctttcgcctttgctaccaggctgctacccatacgattgctgtggtgccgcgttgtgggcgatctgaacaacctccttcccctctgcgacattaaacggcgtgcattcgatagtgagcttggcagttctgcggctgggttccagaaggttagaagtgaggctgtgagctggacctccttccacgggacatgcaacctgcagggagcgggctgatgcgggtcccatggtctctgttgtcttctctgtccacctctttgttatagtatccttcagc

SEQ ID NO: 613280 - DNA, 202 bp, Homo sapiens
  misc_feature (15)..(15): n is a, c, g, or t
gaaaaaacaatgcgnatataaataaataaaaaagggaagggaacttgaacttatgtccgagcaaatgcaggtctagaaacatatgctagtctagattacttttgatttaaaacagaaaacacaaaaaatagtaaaatataaaacaaattaatgttttatagacccggggaaaagaattttcagccaaggtacaaaattttaa

SEQ ID NO: 613281 - DNA, 119 bp, Homo sapiens
caacttgctacagaaactcagtgaacccaaacctatttttttcactctgaatattgctgcagcaaaaccaactccaccaaaaagccaggtaacattaacaaaagaattccctgtatcat

SEQ ID NO: 613282 - DNA, 407 bp, Homo sapiens
tctgccaccgtttacaggcaatgagtccaagctccttagtatggcattgcgcatatatggcccgtgtgttgtgttctctgccaacctctcctgccccatcccttaacagacctcaccttgtactgtgtcattgaacctcagtgacctagatgaatttctgccttctccactctctgcacctaggtttatgtcctttctttggctgagtgcagcgtctggattcttaattgtctggcttagtcttatttgtttaacacaaattagctctcttcttccaggatgggatcttgctcctctagtctgagttaagtggttctacatattttcctggcaggaactatcatgtgtcaccatagtactcaccaccttctactgtagttgtcactgtatcccgctgttacctatgc

SEQ ID NO: 613283 - DNA, 200 bp, Homo sapiens
gcaggatgtatacagtggtgtgatcgtgactcactgcagactcaacatcccgggactcaagtgattctcccacctcagcctcccaagtagctagtactacagacacacaacacgatgcctggctacaattttttttgtagggagacagtctcgcttaatcacccaggctggagtgcagttgcccaactggtcgagacttc

SEQ ID NO: 613284 - DNA, 2262 bp, Homo sapiens
ggagggactggcatggtggggcctctagactgtggcggaggccgagccggtttagcgtatggtggtcgacgggtggcgcatctagtttcaacagaaagccaccgatgagttagcgcataccgtgcagccggcagcactgcggccgcgccatcggacactgtgcgtggcagccaggctccaccgcgagcaggccctcgagcacttgccctgcgccaagcatatgtgcgtgccgaggcttctggccttgtcgcccgccttgccccggtgcagccagacgcgaatggcgctgttgcgagtgcggcggatgagcgagcgtgtcctccgcgagtgcatcggtcgactcgttggcacaccgagtagcgtatcgaccgtgaggcggcgtctctcaccgacggcttggtcatcgtgtcgtctaggatagctccgacgtgcgtgctgtccttcactgtttccgacgtcgtgaccctggcgcactcgcctggcaccgtggctccgctacgtaggaggcgctcactgccgtttgcgcgtgggctgccccgcttttggggaccgaagggctggagctcgggtgattcctgtcgcgtggccgcaagccgttcggttgagtcccccttcgcctggcttgtctcacggcacggtccaccgcgcgttccgaagccctgtccgccgccgcctcggcggcattcgaccccttgcgctcgcaatcgtgggcgtcgccccccggcccccgccttgtatcgccctcccaccgtgactgcctggacgcgctcactttgcgagccgccctcgtggatcatccctgagcgcgtccactgcgttggcgctccacgggcgccccgctcgctcgcgcccccatgcgccattgtccgcggcgccgctatagttccctttttgcacgccctgtctcccacccctcccctgtgccggctctccgcgcctccctcatcctttccccagctcgcagccactgccccggttccctgccaccgtcgccagccgcctggcctcgcacacggcctgcggcactcacccggtatatgcctgcctttttccccacctctgcttcgccctcacagcacacctgcttccggacgcgtccctgagacctcgcgagcggtccttcacactcgacacctgcgccacccttgcgcctggctctgagtccctcactcctatactccgtcctgctcacacttgccgcgaccccccctcggcctcctcgccacaatccccgtccgcctgcccccccccgctctccgctgtcctcccgcctcttcctcctgctcctccttgcttccacccgacggtcactgttcgtcgtggcgccctccttaccctccacgcccctcctctccctccccccgtccctcttccctcctctccctccctccccacccgcctctgttctcccagcactcacacactaccactaatagtcagcacaccattacacttcatcctcatccctccatactacctcttaccacttctctccactcgtactatctcttactatcctatttccactaccttgtatctacatcacttctccatctctatatactctcttcactccttctactctacttcctactctccctctctccttctctgctctacttttcctcttactcattactcataccatatctccacctctttcacctctctcccaccttcgctcccctctcatcgcctcccactcccactccttcaccctctacctcctccaccttcactacccaccacactccacactctaccagcagatctccccattcactgcaccctcactcgctcaccacccactcccactccctccccacccatcactctccttcactcttccctgctcactccatccccccttcctcctctccacagtcaacatctaccctctgcctcttcccccccctctactacgtctcccactactactacacactccacactctccattccatacccctcgaccgccacacacgtcctgccaccatcacctcctcccatcatccccaccctcaccctcccaaccaccctgtactcaactcatcatttcttcacttcactctctcctcactccgcctcttacgcttccttcctctcacgccagccatcatccggcactcagctcgcctcttacctacgcaattccatcaatcaacagcacctagcacacgcacccacctcacctcgacccactactcaaccacgccgccccattcctcccctccccaccacccatctccaccatcctcacgt

SEQ ID NO: 613285 - DNA, 183 bp, Homo sapiens
ccatgttgggcaggatggtctttaactcctgaccttgtgatccacctgccttggtctcccaaagtgctgggattacaggcatgaaccaatgcgcccggctcaacttggtcaattcttgttaattcttttttttttttctttttttttggagacaaagtcccacttcggtgaggtctgggatca

SEQ ID NO: 613286 - DNA, 222 bp, Homo sapiens
aatggcctgcagaataaaatcgttgattgaggggatctgaaggtttgccggggttgccgcacggttcgcgtagaccgaggtccaatcaacggcgcgctcgacagtaaattgtggcaccgtggcattgctcaatgtcatcgagcgtgccagggcgcgtcgcatgccggataacggggacgaaccggatatcgcgccagccgatgttctgattgcagttcgcgc

SEQ ID NO: 613287 - DNA, 290 bp, Homo sapiens
  misc_feature (204)..(204): n is a, c, g, or t
aggtcggctatgttgcccaaggcaggcagatcatgaggtcaggagttcaagaccaggctgaccaacgtggtgaaacctcctctttttctaaaattacaaaatttggctgggcgtggtggcgaaccgcctgttaatctaagctactgaggagattcgtttgaaacctggggaggtgggagtttccagtaagctgaggtcgcacgnttttcctccagcctgggcaaccagttaaaactcttgggggggaaaggaaaaaaaatgttttaaatccttggttttggggggttcaa

SEQ ID NO: 613288 - DNA, 342 bp, Homo sapiens
cacgaggcatactcctcgttctgccagtgacagaagctctccagggaccgctcaccatggtgcccaatggacaacttagcgggacgttgtcgtagcaggacaagcttggtcacttgaatgttaattttaatccccaggctctggtgctgaaacatattgtataccatgttcatgacggtcaggatgaacctctgggcggcctcggccccgtggtactgcaccatgtcggcgtcggccaccaccagggtctccaccgtgtgctcgctggtgagccggatagcgttcctccgctcccgccagtcccgcgaaggcctgccccacgtcggcttcttcttttctgtt

SEQ ID NO: 613289 - DNA, 192 bp, Homo sapiens
taaagctaaaaaaaaatttggggaaggttataataaaagttttttgtggggcccataaaaatgtcccccccccaacaagtaaacttgtgaaagtttaatttggaattaggggaagctgttcctttgaaagcccaaatattttttaagttgtaaagccagctaataaaatgccttagtttgggccttatccca

SEQ ID NO: 613290 - DNA, 207 bp, Homo sapiens
tcggcacaggggcacatggttcctggcggctgcacacttcggagatgcttgcaaggcccgcagcggcggtcttcacggctccctgcctatgaggactgggtcgcagtttggactggcaggctacttcgcgaggaacagagccgaggtgagctggaagctgctggcaacataagtatgtggcccggggctcctgccaaaccctgcctc

SEQ ID NO: 613291 - DNA, 101 bp, Homo sapiens
ttgtcagtgttgtgttaagtggttatctggatggtatatggatgagggtcttctggcccccattggcttttagggactggtctggcttcttcactgacaac

SEQ ID NO: 613292 - DNA, 752 bp, Homo sapiens
cttggaccgacttgaggagtttcccaacacctgtaaaatgacgcgcgcaggagctaggagaactatcacgaccagttttacaaactatgcagctacaacttggcttgaaactgtcggactatgtcctgtccctagcagcttgctacacattgatgacgtctcccccgcatagctcttccaagggcaagcttataccacgacatcttgacatcaactctactccgacaccacgcaacccacacgagcaaactccagcattctagcatgctgtgcaagcctacaggagcggctcacgatgactataccactgccttgtcagcacacactctgtcaacacggccctgaacactgctttcccccaccaccccagacaaacccaacgcccaccacgactgactcaccacggctcctacgccacactaccccccctattcgcgcacacatcaccacccattactcctcacctaccctcagcaagcagttacacacttccacaacctacccacctccaccgacatcccacattgcctactcccaacaaacaacacctactcacaacaccactctaccacatccccacactccaggccaccctacccccgcatcttgtctcacaaacacaatcaaccaatacctccaccacacattcgatacactcaacgcccgcaacatatccctctatcaaactctatctcgtacctcctactgtatacactccctcttctcactaacatatactatattgataaccc

SEQ ID NO: 613293 - DNA, 187 bp, Homo sapiens
agatcgagccggaccacatgattgctcaacgctcctcccaatgcctggcaccactagtctactttctgtctctatggatttgcctactctggacatttcatatacatggagttacataaaacatggcattttgtatctggcttctttcacttaatgttttcaaggttcattcaggctggagcggtgg

SEQ ID NO: 613294 - DNA, 1051 bp, Homo sapiens
ctggccggttctgagggacgtaatcctgtccgtcccctgtcttggtgaaaaatgccgctatgagcccgcatgcctcaagggctcgaagtgtacctaaccttcgagccactattcatcgtgaccgccgagtccactggggagcgcccatactcggctacatgccagctatctggtcggcctaattacgtgcaagcggagtaacctctgctaacggggtccgcctggcattctgcaccttgtctggggaaagcaacagccagtgcacggcgggccctcgttccgggcggcaggagaagatcacccggaccaaggacgaggccctggagctgatacaacggcgacatccagaagatcaagtcgggagacggaggacttctgagtctctggcctcacagtgtcagcgagctgcagctcagccataggtccaggggagatcctgggtgcctctctagtcagtaggtcagactgcagaagtccatttgaagtacgcctcagtttgcgttgcggacgggggagatgagcgggcccgtgttcacggattccggcatccacatcatcactccgcactgagatgaggcgtggaggagcccaggcctggcctcggggcagggtcagggcggctaggccaggcacagctcccccttgcccgccagccagaggcacgaacccccgcactccgtgccaccgtcacacagtatttattgttcccacaatggctgggagggggcccttccagattgggggaccatggggtccccactccacggggtccagtccccagttggggtctgcgatcacgccagagttctccctgtaatggaacttgacttcagcacgagggtgggacggctcccagactccagggcagtgtggtgggaggggtgttccaaagagaaggcctggtcagcagagccgcctccagtgtccaccaccacggtgactggaggcagactcgagggccgaattgtttctagcttaggcaacgctcccatctgttcagtcgcaaaggtgaacactcatgcggcataacaccgggcctctgagcaagctt

SEQ ID NO: 613295 - DNA, 395 bp, Homo sapiens
tccttcatatcactcctccagtgagacacacaacagaggcagtttttattattactaaatcttgcaaagtaaatctgtcgtgaaattaaataattatggccctacttcaggtaaagaaatcttctacgataaattcaactacatttatgaagattaaattcaaatactgcatcataaatttgaaaactccttattgtattgtgttttcttttcactggtaatctaaaccaagtaatctatattatctaaaacttcaataaataactgactttcttgctggttttaagagttaaaacatattattagctcaattcttgtcgtcaattgtcttattaatttttggcatatgtaaaattagtcatatgatcttaatacatctctagtacatatagaat

SEQ ID NO: 613296 - DNA, 371 bp, Homo sapiens
gagatttatctctttcacaaaacaaaaccaaagaagggcagagcatggtggctcacacctgtagtcccagcactttgggaggctgatgctgaaagatcgctgaaggccaggaatttgatacaagcctgggcaacacagcgagacccaatctctccaagaaactcttaaaaattagctgggcccattggcacacatctgtagtcccagctactcaggaagttgaggtaggaggattgcctaagcccaggagatcgagaccatcctggctaacacggtgaaaccccgtctctactaaaaatacaaaacgttagccgggcatggtggaggacgcctgtagtcccagctacccaagagccggggatgggtaccga

SEQ ID NO: 613297 - DNA, 151 bp, Homo sapiens
gaggaacatacctctaatctccgggaccctgctgagctactgccttgactagccctgacggtggaaaaacattatgatggtcaacatcggacacacattgctaccttgccctggccaaaggaggcttatctgatgaccatgtcctcatcct

SEQ ID NO: 613298 - DNA, 633 bp, Homo sapiens
agcacgtaggagggcaattgtgcccatcgggaagattctgcgggtgttcatctgaggctcagagcccaggtttctgtatgtcccatccaaggccgagtaatgctccacacattcccacgagggtagaaggatgcagatgtcatgatgctcatcaagaggttcaccctatctggcgctgtaggttggatctactggagtgaggaacagggtgtagaggattggggcgctgggacaggggcgctggcacattcctcagatgccggcatgtcatcctggaagtactcagcctgcgagtgctgccacagacgcaggttcccgtcccacgaactgctgacaatcttctcttcaaaggggtgccaactgacgtcgcgcacgcaggccatgtggttggtcagcttcttcacaatgtgcccccttagacggtcgcacacaacccctttgccagtggagcagcctctgtagatgaactgctggccagtcctatgaatgggggacaaccgccaccgcatgagggtgtgcagcactccgtggcccttgggcacttgctgcccccgatagtcccagttctgctgtgtggcagcctggcgtgaagcttccatgccctcccggctgcaagagcgtcgaatatcccag

SEQ ID NO: 613299 - DNA, 332 bp, Homo sapiens
tgcctcccgtaggagtaaggtccgtgtctcaggccccttgtggccgtttaccctctcaggccgtgtaccgatcatcgctttgttgagctgtaacccctccaactagctaatggctcgcaaagccctctcacagtgcttatagctttcataattctaagatgccttattatcatatatatcaggtattagcattcatttctaaatgttgtccctagctgtgaggcaagttctttacgcgttactcacccgttcgccacccaaatctaagttataaacccaaattcaagttgacttgcatgtgttaagcattctgtcagcgtttatcctgagcg

SEQ ID NO: 613300 - DNA, 156 bp, Homo sapiens
tgggactaccatcactactaacatgcttctgtacagcaaaggaaacaacataataaaatggcagcctatggattgggatacccagtttgccagccatatatctgataaggtattgatgtccaatagatataaagaacatatacacttaatagtaga

SEQ ID NO: 613301 - DNA, 886 bp, Homo sapiens
tcagtgttgtggatccgttgaccaattgcaccagttttatccataatgatggatttaacagcatgacaaaaattattttttttttggtccttgagggagattaagatgccttgaaatggtctagggtgtcctggtacttagaaagtaagagctctaagttacctttcctactttttcctttttttattaaccagatatcttcagttaaatggcaagagaacattttactggtggtcacaactcatgtcctgggggttggatggttcacaggatattccaaaataaagggaactctgggaagatttcatggaggataaatggccataatatgatgcaaacggtgcttctctatgataattacaatacaagggttccattcagtggcagcatatacaatagtgtaatttaagtctaacacagttgaccctattttttgacactcccatgtttaaaattactctgtggaaaaaaaaaaccctatatggtttacgggtgcacctaagagcctttttcataaccaggtcttttggtcggtggttgggtcctaacattttattttatgctattttagggcctctttagcccgatctcatagctgcgtccttcttgtatacttttctgatcttcccattttgtggctggaagttggatttggctcttcttgtgtggaccacacggacttctttatcctttaacctatggataccgggggaggctgtagacttttggccattgggcgtctggcaccggttcctatgtggctttataaagggatagctttggaggaagcctcgtcggcatagctctgttggtgagccacaccttggggaaaaaatgcggtctttgcgctgtgtggtgcgtcgtgtatcgtctctcgtcgctctca

SEQ ID NO: 613302 - DNA, 228 bp, Homo sapiens
tttttaaaaaacccccaaaaaaatgaacttaagatttaaaaactgttttccttggtcataaaaattttttttaaataaaagccttgggattataaaaatgtaatccaacccccaacataaattccttttccagtcccagttttttcaactggtgtttaaaaggagtcaaaaattgctaaaatttttttttcctgtgcaaacattcaattgttttttttttttcctcca

SEQ ID NO: 613303 - DNA, 208 bp, Homo sapiens
tgttgtatgcacatactcctaagataggttcagtcttactacctattaagttaggttgcagtttgtccacagggactcaaatctagaagtacagagtccttcccaggccatatttagattcacgtgtaacagttcctattatgacctcactgacagtgtctttttctctgaattctcccttcttctcaacagcttatccaattgtccg

SEQ ID NO: 613304 - DNA, 217 bp, Homo sapiens
gtgtcggcgacctagaggatcccccctacagagcacaggctcagcccacgcactcacagctgtttgtaaccatatctcctcggtacgtgctgtggctgtgtggggcattggcaccccaggtggccctcaggatcctcagccaggcctgactgcccatgtggtgtctgcggggaggcggcttggggtgctggggtccggagtaaccatgatgctgaag

SEQ ID NO: 613305 - DNA, 882 bp, Homo sapiens
  misc_feature (4)..(4): n is a, c, g, or t
  misc_feature (73)..(73): n is a, c, g, or t
  misc_feature (82)..(82): n is a, c, g, or t
  misc_feature (116)..(116): n is a, c, g, or t
  misc_feature (139)..(139): n is a, c, g, or t
  misc_feature (166)..(166): n is a, c, g, or t
  misc_feature (169)..(169): n is a, c, g, or t
  misc_feature (172)..(172): n is a, c, g, or t
  misc_feature (176)..(176): n is a, c, g, or t
  misc_feature (186)..(186): n is a, c, g, or t
  misc_feature (229)..(229): n is a, c, g, or t
  misc_feature (250)..(250): n is a, c, g, or t
  misc_feature (255)..(255): n is a, c, g, or t
  misc_feature (303)..(303): n is a, c, g, or t
  misc_feature (307)..(307): n is a, c, g, or t
  misc_feature (312)..(312): n is a, c, g, or t
  misc_feature (328)..(329): n is a, c, g, or t
  misc_feature (349)..(349): n is a, c, g, or t
  misc_feature (377)..(377): n is a, c, g, or t
  misc_feature (406)..(406): n is a, c, g, or t
  misc_feature (421)..(421): n is a, c, g, or t
  misc_feature (442)..(442): n is a, c, g, or t
  misc_feature (481)..(481): n is a, c, g, or t
  misc_feature (497)..(497): n is a, c, g, or t
  misc_feature (528)..(528): n is a, c, g, or t
  misc_feature (560)..(560): n is a, c, g, or t
  misc_feature (569)..(569): n is a, c, g, or t
  misc_feature (590)..(590): n is a, c, g, or t
  misc_feature (877)..(877): n is a, c, g, or t
gggncactatatcattccccttcagggttgcagccaacaatggaagctttaaaacctcttccacacaaatgcnacccctaanatgaaagactttaggggttaaataaaacaagtgngagaccatttacttacatcagtncggtttatagacatttggctcatatcngantgnctgncttgtttccnatgtgaaaaccaaattaaaaataacttgatcactgtgcttcanacacaactgttcacatatcanattcnagctccagccatgtgaaattcaacttttctgtgtcagagagaaaagcnattnaggtncgggggcgttgggtcnntcatggacagcatgggaatntgggtgggcggggatattccagggtgcnacaataagtggctttttgtcttacatatnagtgcactgaaacanaatactaaatttgtgtgaaanataggtatgagagtgttccgttttgtccaaacctattanataccttccaaaagtntcataattcagtcctagaaattcttggagcngtgaggatatcctgttcagggatgtggctgcnacgaaagcncccagggaatttcagagaagnatatatataatcttctaattcaaaagttgattgatttgccaaatgacgcagcaagatttgcttctctaaaagcttctgataaggtcggatgtgcatgacagactctagctatatcttcacaggatgctccatattccaaagcaagagcagcttcatttaccatttctccagcacctggtccaagaatatgtgctcccagtactctgtctgtcgatttctgcccaaggatcttcaccatgccatctgtgttagcatttgtcttagctctgctgttagcgcaaatgggnatttc

SEQ ID NO: 613306 - DNA, 977 bp, Homo sapiens
  misc_feature (14)..(14): n is a, c, g, or t
  misc_feature (259)..(259): n is a, c, g, or t
  misc_feature (375)..(375): n is a, c, g, or t
  misc_feature (787)..(787): n is a, c, g, or t
  misc_feature (793)..(793): n is a, c, g, or t
  misc_feature (974)..(974): n is a, c, g, or t
tggggggttgtttnggggggtcaccctgtagctcttctcatgatagccctgtgaggtgtgtggtggagttgatgatggagagaggagtggcgatacatgcattgcgagccatgacaaacaagcctatccgcccgcaacacaagtgcccctcagcatactcataacacaataaatcctgccactcacatacatacctactacaacgatcacgtctaaaaaacaatctagtgcttcactttgtcgtcgagcggcgaatcanatcaacaccactagaccgcccgaccaaacaccttacattttcttttattgtttgttgattttatcgtttttttggttttgttggtggtgtggtcgattggtttgggtcgggtggcnggtaacggtatctgattttggctgttaggaccgctctccgagcaagggcggagcacgaaacgagacgcgaggcggagcgagaggctctagcgcgcctcgccacgtcacgagtggacgcgtgatactgggtggaagtcgtcatgttgtcgtgttgtgacactcactcactactctaacagcctcattacactccaccaccgccgctatgacaacaaacagtgggacaacaagtaacaaatgagaactcatatattgtataaagaaatagggagaagatgcgcgacatacacaattgagcgttattgaccatccgctcatacactatctccgcgtagcatgatatttcttctaccagacaccgacaataagggagacgagtatgagaacaagtaaagcagtcacatgcgtgtgntgattncggagggaaccctatacgtgcgatagtacacatgtacagtcgatcgaggttacgttcaaagccagcagcccaccatctctttctctatactccctactgcggtagagtgaggtggcatgagtgtgaatgtttagtatatgagtcgaggagcagatccatgcttccacgtcctacaactacnaat

SEQ ID NO: 613307 - DNA, 501 bp, Homo sapiens
actattcagccataaaaaagaatgagatcctgtcatttgcaacattatagatggaactagagatcattaagtgaaataagccaggcacagcaagacagacatcacatgttctgacgtatttgttggagctaaagatgaaaacaactgaacttatagagggtagaaggatgtttaccagaggcgggaaaggcagtgagggcatggtgagggggaagtggggaatgttaacgggcacaaaatgtagaatgactaagacctagtatttgatagcacaaggttactacagtcaataataattgtgcattttaaaggtataattgaattgtaacacaaaggataaatgcttgaggttatggataccccatttaccctgatgtgattattagacattgcatgcctatatcaaaatatatcatgtaccccatagatatatacacctagtatgtacccacaaaaattaaaaataaagtaaaatttcaatgattaggaagaaaaaaaaaa

SEQ ID NO: 613308 - DNA, 447 bp, Homo sapiens
ggaatcgctgttatgtgatagctcagttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctttaggattgttgtgaggattaaagtatgtgaaacatgggaagtgttatacaacagtacttggcacgtgataaattgctaactaccaacaattgttatttatcactgaaatagatctactgtagagatcttgtgcaagagttgaaatgccatgatagtgatactactcaccataggctaccaccaaaccatctcccatgtggtatttctactccctgacatatgtgtgaagcggtgactgtggaccagacaaattgctagcccctca

SEQ ID NO: 613309 - DNA, 346 bp, Homo sapiens
  misc_feature (2)..(2): n is a, c, g, or t
  misc_feature (76)..(76): n is a, c, g, or t
  misc_feature (84)..(84): n is a, c, g, or t
  misc_feature (108)..(108): n is a, c, g, or t
  misc_feature (124)..(124): n is a, c, g, or t
  misc_feature (140)..(140): n is a, c, g, or t
  misc_feature (142)..(143): n is a, c, g, or t
  misc_feature (153)..(153): n is a, c, g, or t
  misc_feature (162)..(162): n is a, c, g, or t
  misc_feature (201)..(201): n is a, c, g, or t
  misc_feature (217)..(217): n is a, c, g, or t
  misc_feature (238)..(238): n is a, c, g, or t
  misc_feature (251)..(251): n is a, c, g, or t
  misc_feature (291)..(291): n is a, c, g, or t
  misc_feature (318)..(320): n is a, c, g, or t
  misc_feature (329)..(329): n is a, c, g, or t
cnttgatcgaaggtagttttggacagaaccgataagagcgagtcgaagcactgctttcactaattggtgatataancccatatnatttccacgtcagttaatcagcanccacagtccataatanctgaggaatggggtgnanncaaataacanataattaanagccattttattgtcaatactgactgtcatacgactggnacacttggaaggagantcgcaaggctccccacgaggncagattccgggangtgcagggggcggggtatctgccataggcactcgtttcgnggcattgtcttctttctgtccggctgnnnaagaggggncgcagggtccatatcta

SEQ ID NO: 613310 - DNA, 171 bp, Homo sapiens
gtacccagggatctagcttggcattatccccatctctataacactaatgagtcatagatttagtctctttacattagttccgatagtttctcagagtgttttatttatgtgttatcattcttgaaggttgatacttggtactgactggcttatttcagaaagcctgtcttc

SEQ ID NO: 613311 - DNA, 424 bp, Homo sapiens
  misc_feature (23)..(23): n is a, c, g, or t
  misc_feature (45)..(45): n is a, c, g, or t
  misc_feature (51)..(51): n is a, c, g, or t
  misc_feature (246)..(246): n is a, c, g, or t
  misc_feature (293)..(293): n is a, c, g, or t
  misc_feature (311)..(311): n is a, c, g, or t
  misc_feature (356)..(356): n is a, c, g, or t
  misc_feature (362)..(362): n is a, c, g, or t
  misc_feature (383)..(383): n is a, c, g, or t
  misc_feature (406)..(406): n is a, c, g, or t
aggcacaggactgggatgctctncacccaagcggccccgactacngggganaacaagatcggaggccgtagtaattgtggtgctggaaggggccagtctggagacagtcaaggtagggaagacatatgagctactcaactgtgacaagcacaagtctatattgttgaagaatggacgggaccctggggaagcgcggccagatatcacccaccagagttttgctgatgcttgatggatagtcccctngaaccgagcttggcttttcttacaaggtttattatcccttacacagnaaggaatgttcttgattngaagttgaatttcccaggaccccgaattttcccagaaaccttttntaaccnctttttttttgggcctccatngggtttcaaatttttttttcaanaaagtttcagtttttttt

SEQ ID NO: 613312 - DNA, 363 bp, Homo sapiens
  misc_feature (62)..(62): n is a, c, g, or t
  misc_feature (349)..(349): n is a, c, g, or t
  misc_feature (360)..(360): n is a, c, g, or t
tcatagggtcggtggggtgacacctgtagtccactgaggcaggagaatcccttgaaccaggngtggcagcctcagttttcccgtttccttgacgcaggcctagcttctctaaagatttgaaaaggctcctttattttttattttttgagacagggtctcactctgttacccagactagagtgcaagggcacgatcttggctcactgcaacctccacctcccaggctcaagtgattcttaatctgcttcagccttccgagtagctgggactacaggcgcccaccaccacgcctggctaatttttttttaaatatttttagtagagacggggtttcaccggtgttaaccanggatggtctcngat

SEQ ID NO: 613313 - DNA, 144 bp, Homo sapiens
  misc_feature (6)..(6): n is a, c, g, or t
  misc_feature (37)..(37): n is a, c, g, or t
gggggngttttagggtcttagtgtggtcttcaccagngtggtggcccagcagttgtgctgcgggaaggaatagaactgttgcaaatgtcaacccaccccctcacagagggctttattttctggtttgaaggaactgttccttca

SEQ ID NO: 613314 - DNA, 961 bp, Homo sapiens
atactagcatttaccatctcacttctaggaatactaggtatatcgcttcacacctcatatccttcccttactatgcctagaaagggaataactactatcgcctgttcattatagcgtactctcgataaccctcaacactccactccctcttagcgcgatattgtgcctattgccatactagtcgtttgccgccgtgcgaaagacggcggctgggacctagccctactagtctcaatctcgcaagcacatatgggcctagactagcgtacataacctataactctactccaatgctaaaagctaatcggtcccagacagattgatattactagccagctgtacatgactttccaaacaatgtcatcataagtgttgaatcgaatcacaatcctactccacagacctaattgattagtcatcgagtccctgctactattcttttaagccataagtcaactaaacaagcctatttagtctgtgtccccaacgctttttccatgcccgatgcaccacttagaataagactccctcttcgcttacattatctcagactgaaacctgggacttcgcataacccgcgcatcaaacaattctatagggtcaaatgctcatattgcacagctttagttcccagtgtggagaccatgtttacttcacgggaaaatcaacggttaggcaactccataaccaaaggattcaaagtggacacccatggtttttggtccgttccgtccacatgtggttggccacctggccggttaggtacacccagggttgatcagagtcacccacaatatacagggggcgagtggattggacagtggtcggccatatatgtaggggttgaccactttgaactaattgggacgcattgcggacgagtggttatccgggaaagagagaagaacgtcggtgaggtaaggagacatcgaaggaggagaggagaaggaattatttaacc

SEQ ID NO: 613315 - DNA, 506 bp, Homo sapiens
ggcttaaaaaaatttttttttattacacacctaacttttgacctacttaagaacaaaagaaaattaaacctcatacaatatttaatcaacgtcctaattttaaggttctttttgcacctcccccctttagggggcgtttttaaaaaatcccggtcggcccttttcctcccttctgtttttggtaaaccccgtgtttttcctgggcgatcgctttacggatatttggccttttcccccctatggggcgtcgaataaaaacccgcggcggggggtttttccaacctgtgtagggaaaaatctgtggaggcaacattgtatagcggtttgttttattaaaccttttgcgaaactggtgggttaactaaaaaattttttttccctaaaacttttcaaaattttgggccctttttattgcaaaaaagtaatcttcgacgttaattttttttaaacacgctgggaaatatttgcaaaaacaaaaaaatttttacccacattgccgaggccgg

SEQ ID NO: 613316 - DNA, 691 bp, Homo sapiens
gacacgcgactcccacaaggttgcatgcggagccgccatgtcacgagagcctagttccggccagggtcgccccggaaagccatgagcccagccaatcagcgccccggaatgcatccagtagcccatgtgtcggtaggaaagacgccactggatcgtacttggtctcactcagaagtaggacgtccttcaactagtgccatgaaaggaggctgctggcaccggcggcttttggacgcaacgccaccgctggccacagtgggggcaacaattcgagacccttttatgccaggtgaacacttcaaatccccatctatttcgcacgaaggggacactcacagtgtaacagttgagagggacaccgtgcagaaacctttgcagatatcctggccgagtcttgtcccggcgcgttataaacggaatgtgcattctgaggcccagactatttgtggcttgaaccacaacccgacggctgggaaacgccggaagaacctttggtgaatatttgcccagttcctcccgcttgagcgcggcgatgaggggagcgcccatggggccgacttctggaaacgtgctggcttggacgctgacgttggtccataggcgaagagttgggcttacaccttacagcttgccatggtattgacagatggtgaccttccaggagttaacacgggattggtttccatacaca

SEQ ID NO: 613317 - DNA, 201 bp, Homo sapiens
ttttgtaattttagtagaaccgggttttcaccatgttggccgggctggtctcgaactcctggcctcaggcgatccgcctgcctctgcctcccaaagtgttgggattacagacgtgaaccaccgcgcccggcctcaatatgttttcaacttaacggcattttcaaatacgatgggtttatcaggacataacctcctcctaag

SEQ ID NO: 613318 - DNA, 183 bp, Homo sapiens
gatagacgagtttctgatgttcataaagatggactgaattccactgactcacatgtggttgcccgacactgagaagttatgatgcagttgaaatcatccgcaaggttgcagtgcctcctcgccctgtctagaccacacacacgagtatatgacagcggccaatccgaacttgttcaaactggc

SEQ ID NO: 613319 - DNA, 507 bp, Homo sapiens
tatgatgcaccatgttagttatagaaatgcactgacttgagtgtgtactatacctgaaacttgttgaatttcactattctaccagtatttgtggaatttcaggatttttacacattacatcctgtgtctgtgaacaaaattttgtactttttcctttccaatttgcatgctttttattgctttctcttgcctaattattctaagtagaaattccagtgctctggtgaatagaagtggcaggaagagaagttgctatcttattcctgatcctagaggaaaagattttagttattcaccattcagtatgatgttagctgtgagcttttcatgtataatctttatttactgaggagtttccatatattactaattctttgagtgtttttattacaaaaggtgttcatctggctctggaaccagataaatgttgacctgatagaatggattggaatgtcctcttcttgtgttagaggatttttggaatattttgcagaggattggcattaa

SEQ ID NO: 613320 - DNA, 408 bp, Homo sapiens
  misc_feature (124)..(125): n is a, c, g, or t
  misc_feature (402)..(402): n is a, c, g, or t
aaaaaaacaaaaacaaaaaaaaaaaacctcttaaaacaagtacagcaagaactttgagggtctttgctaagacagcagctggcagcttcaatttggagtagggtatcaaaggcaactgtgtatnnggaatagttatataactggtatccaatttctgagatgattttgacttaaacattgtgtatttcccagcatactgttggtttttctaattatgtgggaaattatgttgcttttacttttttttttgctcattgcccagcctagcgtgcagtgctgcggtctcagctcactgcaacctccgcctcccaggagaatcgctggaacccaggagacagagattgcagtgagctgagattgcaccactgcagtctagcctgggtgacacagcaagactccatntcaaaa

SEQ ID NO: 613321 - DNA, 125 bp, Homo sapiens
gttccttccctagttccttccctagttccttccctccacaatccttctcccaactcacgaaagacaccatcatgttcaagaccaagcttcacgtctccggcaccgaaggcaccccctactacgtt

SEQ ID NO: 613322 - DNA, 333 bp, Homo sapiens
  misc_feature (124)..(125): n is a, c, g, or t
  misc_feature (327)..(327): n is a, c, g, or t
aaaaaaacaaaaacaaaaaaaaaaaacctcttaaaacaagtacagcaagaactttgagggtctttgctaagacagcagctggcagcttcaatttggagtagggtatcaaaggcaactgtgtatnnggaatagttatataactggtatccaatttctgagatgattttgacttaaacattgtgtatttcccagcatactgttggtttttctaattatgtgggaaattatgttgcttttacttttttttttgctcattgcccagcctagtgcagtgagctgagattgcaccactgcagtctagcctgggtgacacagcaagactccatntcaaaa

SEQ ID NO: 613323 - DNA, 166 bp, Homo sapiens
aactaattcagtacaggtacttgtatacagtttttcctttttccatttacaaaatgacgacatttctgttaaatgaaacctgtatcgtataatgtatttttattttacccacgcagaatgttgttattttgagcatatagaactcattgcagtgcattggttatta

SEQ ID NO: 613324 - DNA, 371 bp, Homo sapiens
gcatgctcgcatgctcatgcggctcacatttctggtacagctccgcgaatacagagtctcctgcacaggtcattcgctatgctacaggatgtcaacgacttttcctgtcctctgcacctaggttccttaacacctctacaacagttgtagttgcctcatcgtgtactttattggtgtactgacctaagagcgcattctgcaatgtgtcatccgctagctgctccaacagctcatccgttttgtctattcaaccctgaggctcagccacaggaggtttgcattcctcgcacgcatgggcacagcattcatcagtagccacagcggcccagcccttctcaacagtgctctcatatgtcttggccagtctcacc

SEQ ID NO: 613325 - DNA, 426 bp, Homo sapiens
ttatcacgtatcctagtgaacacacagctgggatgggtgtagagttgagagctggcctggaggaaaatcaggccaggcgaccatcctgtttggagcctctttctgctcctgaaggccacccatgcggggcccgttttggcctcagatcccttctttgcgaaaggaaggagctggcttcagtgtgaggagctccctcccacactctgacaggacaacggagcccgtagcctcagcacacagtgaaggggcaggccttccccatgtagagctaactcacacatctgcaaatgtttcccagaagaaaaatgccatttctcctccaattgttaaccaaaattactgtaggccgtggggctctggacatatgccctcatgccaagcttatctcggagggaggcagagaagaagaggggtgggataccaggg

SEQ ID NO: 613326 - DNA, 678 bp, Homo sapiens
cgcaggtcgcgcggcccgcctccttccccgcccagcgaagctctctgaccacccctcttggtctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattggcaccgcagttgtgaacatgattccaattgacatgggtttgcagaaagaatagcaactggttcttttctcaaacagaacatcctggtgtcaaggcacggatataagtattaacccacctaaagtgcagtaggtactttcaaggatgatgccaataatgacccacagtggtctgaggaacagctgattgctgcaaaattcagctttagctgggacttcttataggccagactgaagtggatatcatgagtcatgctacaacaggctatatttgacaatactggagaaatcctggttgccc

SEQ ID NO: 613327 - DNA, 110 bp, Homo sapiens
cctgtgtctagaggatcttttgggtgctttccgactcctgttgagggcattgaattctacacgttcatcaacagggcgaggttcgaggagctgtgctccgacctgttcct

SEQ ID NO: 613328 - DNA, 508 bp, Homo sapiens
  misc_feature (480)..(480): n is a, c, g, or t
ccccggatccagataagcacggtgctatgtgagctcattaatgcactgtaccctttttggcaggccccagtaaagaagatccaggcctgcaccatttccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctgacagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcacctgccgctccacgaatggntaatatatatgtagatatatattttagc

SEQ ID NO: 613329 - DNA, 777 bp, Homo sapiens
agagctgcctggaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattggcaccgcagttgtgaacatgattccaattgacatgggtttgcagaaagaatagcaactggttcttttctcaaacagaacatcctggtgtcaaggcacggatataagtattaacccacctaaagtgcagtaggtactttcaaggatgatgccaataatgacccacagtggtctgaggaacagctgattgctgcaaaattcagctttagctgggacttcttataggccagactgaagtggatatcatgagtcatgctacaacaggctatatttgacaatactggagaaatcctggttgccc

SEQ ID NO: 613330 - DNA, 862 bp, Homo sapiens
cgcgggcgcaggcggccggaatggcggggccggctgggtgtcccccgcgcctggacggcttcatcctcaccgagcgcctgggcagctggcactgtactgccacgtgtgtacaagtgcctacgccaagaaggacactcgtgaagtggtagccataaagtgtgtagccaagaaaatgtctgaacaaggcatcgtgtggatgaacctcctcacggagattgagatcctcaaggtgcattcgacatccccacattgtgcagctgaaagactttcatgtggtgacagtgacaatatctacctcatcattgtgagtttttgcagcagtgggtgcgaccctgtctcgcttcatccataccctgccagtgattcttgccttgatgacagtgttggctgcagtgtcttcatgcaggcaattacgctatgctgccctgcaattcctgcgattgaacggaatatctctcacctggatctgaatgccacagaacattctactgagctccttggagaaggccccacctaaaactggcagactatggatttcgaacaacaacatgtcccctgtggggcatgagaagcactgtgctccgatggaattcccccctctacattggccccccgaggatggtgtgccagctggcagtatgactgcccgatgtggacctctgtgtcaatggagggatcatcctgtattgaacgccactcatcagggacaatccccaccttatttgaccgttcacaagggttacgataccatccgggaaacatcgcacaagcaagaaacgactacgcgatagtccccacacctgggtatacaatcgaaagtataccaccattagtaagtacaccatgcgtctgtcccaggaac

SEQ ID NO: 613331 - DNA, 555 bp, Homo sapiens
tggaaacggagtcccgctctgtcacccaggatggagtgcaggggcgcaatctcggttcactgcaacctctgcctccgtgggttcaaagtgattctcctgcctcagcctcctgagtagctgggattggcaggtgcccaccaccacacccagctaattttggtatttgtagtaaagacaggttttcgccatgtgggccaggcgggtcttgaactcctgacctcaggtgatccacggccacctcggcctcccaaagtgctgagattacaggcatgagccaccaacctagactatgtggtggtaccttgatcactggttaagggggtgtgtgccaggtgtactccagcgtgtacaaactagggagtttcccctttcgaaagtggaacagagaatcttccacttgtgaagcttgtcgtgaactgtctcacttcttaaggatgtggccataggattcacattaccactcatcaaggagttcttgcttaatagcgggttattatgtgttatgcgtgcccagtggtgagtgagcttcatgatatacctgaatgataaggggac

SEQ ID NO: 613332 - DNA, 644 bp, Homo sapiens
  misc_feature (380)..(380): n is a, c, g, or t
  misc_feature (420)..(420): n is a, c, g, or t
  misc_feature (429)..(429): n is a, c, g, or t
  misc_feature (462)..(462): n is a, c, g, or t
  misc_feature (491)..(491): n is a, c, g, or t
  misc_feature (557)..(557): n is a, c, g, or t
  misc_feature (580)..(580): n is a, c, g, or t
atcgcaattgcgaagttgggaggcggggtgacaacgtttgggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctaacggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttttggcgccctcaagccgcggcgactgggttagagatgccttccaancggcagaacgcttctggactcgccgcttgacaagcggctnccttgcctncctggactctaatgtctttttcaacgaagggtnaaagggagccctttgcgctcggggactgntttacggtcaacgggggcgggaagcccgtttgtgcttttcgcaacaagcgcttgtcttgtttccgnaaaaccccctttgcaaagcttgnccgtgtggggggtttctaaccgccgcccggggcccttggccggcgggcccaggcctttggagct

SEQ ID NO: 613333 - DNA, 329 bp, Homo sapiens
cagttacatatgcacggaagacacacaccatgcacactggtttatagttttcaatatagagatctttcacttatatggttaattcttaggtatttaattttatttgtgtctgttgtaaatgaaattactggtggcatatagaaatagctactgatttatgtgtgttgacttagtatcctgcaactatactgaatttgttgatcagttctaatagtattcttgtggagtataaaagctattccaagtataagattatatatatatcatatacaaacaaggattatttgattcttcctttccagttaggatcccctctatattctttctct

SEQ ID NO: 613334 - DNA, 105 bp, Homo sapiens
acacacacagcgggctggtagtggttactcttcccagtggtgctatgagaactttgtacatgttcagatctgatgcgccgagccctgggatgatgcgggaacatg

SEQ ID NO: 613335 - DNA, 257 bp, Homo sapiens
aattcacaagaaaagccactggtgtaaagccccaagccctaatctcatggatattacatatgcccaggatgctattccatcaccacggtctttagtccatgcactaactgtactcctgtgtgttggctgctccactgtcctctgccagcctacaggaggaaaagcagggcttacagaaggatgttccttcatggagtaagcagcatctgcatgcactctcacgtcggtcttgggcatactggtgtccggttcaaggc

SEQ ID NO: 613336 - DNA, 1032 bp, Homo sapiens
tggtgggtaatatttttgctgcactgcagtgtgtgtgtctcgcaatttttatctcaaggtctcatcgtgaatgctgaagaaagtttcgtgtgatacaccgtgtccatctctagttttcaaccgctcttaatcagaaagttgtccttttgtgaaggtgggttatcaaccagaagggagtgaactccacaatttagtttctccctacaggttctcagggaaggaaacgtttgtggaagaaggcagagaaaatccgtgctcatccaacgcctttcacagcagttctccgtgttaggttggccaactcctcaagtgttcagagggcccatctttaacattagacgcaggtcctagggttattccacagacaggtagacagacgccatattctctcctatacataatatcctgagaatctacatactctgacatggcgcgccaataagtagtactagggtcaagttaagcagtctatcaagcggcaaaagtttctctctcacatttcaccgcattctggcgtaccacgggcactccatagggtctccttatagggcgcatcccatcttccacaggtgcagggatctgcactctgtctcccgcgtactccagtggacctccttgttttgccctgggcgccgggacatacatagatcccgtattggcaaccttcacgagcaggctcagcaaacctgtggatttatgtaccatatcctttcatattacgcgcaattgtgcatacccaaaaaaaacaacaaacaaaatataaaaaataaatacggtggtgtacatacataaatcaaccccccacgaggacgaccacaaaataaagtaacgatcacaccagcatttctttattcagaaagttgtcccccacattaaggcgcgccacatataaacaaaaagcaaatagaagcgcctgaatacacaagcttcactcacaaacagcaatagaagacaatctacaaacaggaccactatcatgcttgctcgtcacatcgtggaccaaaccacacacataacggcaaggcaaataat

SEQ ID NO: 613337 - DNA, 108 bp, Homo sapiens
gttgtgttgctgggtcttggtcttgagtgccaagttagggaacggcgctaagcagacatcccactaggaagagagagcgtacctccacatcaaggaatcgggacatag

SEQ ID NO: 613338 - DNA, 301 bp, Homo sapiens
tgatctagaggacccctgggctcagtgatcctcggcagaggacctctgaggcctcgcagtgttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacatggttggaggtaaggtcatagatcaacagcatcccaaggcagaagaatttttcttagtacagaacaaagtgatgtctacttctttctacacag

SEQ ID NO: 613339 - DNA, 299 bp, Homo sapiens
gtttttggagttgacggatgaggttttacaaccagtaaaatacaattcccttcttaaggtcccataccggtacctcacatgttcatacacccgtctaaaagtcgtgtgagaaaagggtgacaaattcctcaatcacctaatgacggtaagtgaagtattaggtcatcctaggtcactaggaatgttcaatcttttgtattagaagacggaagagtactaggttgattacggaatgagaagaactttaaaattggatactataaaagacacggacttataaacaatacatctattgttct

SEQ ID NO: 613340 - DNA, 201 bp, Homo sapiens
ctctggatcattacgaaagcccggaagatgaaggagatgactagaagaaagaaaatggaaggaaggaaaaaaggaggagagaaaaaggatggaagaaagaagcatgaagaacaaagacattcttcccacttcttggattttgaaaccacagtctggagtgatagctactgtagaaaggcttgagaaatgggcttaggggga

SEQ ID NO: 613341 - DNA, 158 bp, Homo sapiens
cattatcaccctataatcatccaccctcctctccctaggaggctgccccctctaaccggtattttgcccaaatgggagatatatctgaagagatacacaataataactataacctattctataatttcacactatttcatatatatcctacaactact

SEQ ID NO: 613342 - DNA, 315 bp, Homo sapiens
acggatacagggcgacggtacactgggcgcgtgttacactcgggatgacatgtactaccgtgggcgttcttacactgggtgaaccttctataatcggcaggcttgttacgactgggtgagcccttaatactgggcaatgtgttaaaacgtcgcggtcgagtactcttcgggctgccataacaacagcgcgccacaaaatacttcagacacctgtcatcactgccaccagtggttaagaatgaagcatcggcaccaagttgcgcagggatcttctgaattctctccttggtgatatctgatactctctgtctaatg

SEQ ID NO: 613343 - DNA, 675 bp, Homo sapiens
  misc_feature (85)..(85): n is a, c, g, or t
  misc_feature (518)..(518): n is a, c, g, or t
tcgcgaacgtgttcctgtgagaggaggagccagccagatggctccgatttatccatgtcggtgcagggctggagaacgagctcgngccagctgggacgctactgctgtgaggcttcccgtgcacctcagcccttgagagaccaagcctctcttttcacacctgagctcctgcaggaagcaagggctgcggtggctgggagatgcctgttgttcctcacattcagcaattagcgccatctccttaagggcagacctccacgtagctgtaatctgaaatgtcagttattacactctttgatgtaagtatagaagtgcctcggttatgatctcaggagtaagacagaaatagctagtcagtgtggtgagtaatctgctaaaagcattcacagggatcatcctcgccatggcattatgtgctgtttaaaatctgagtaaatgcttaggagtccgggattcagagatgcagggaggggcggtggaatctcttggaggaatcctgggttaagtctcctcactgnttctgttgcaggtgatggatcatgcctatgctattctttgagttctaatgtgtagttgattttatgggggatactgaagggcatgggagcagcccttgagtcttagcttaggtcccagttaggagggacaatacggcaaaggggtctgaagacaaga

SEQ ID NO: 613344 - DNA, 125 bp, Homo sapiens
accagaggatccaaaacaatacagctcttgggcctcctttctatttctttttaatgttctcaccattctgctgtctcacacaggctaaaagctagcttgtctatccatctaatcagcttatatct

SEQ ID NO: 613345 - DNA, 245 bp, Homo sapiens
ccttctcttgcctgtttcgacgtcgctagatagaatgactggctgcggccagaatgctggacacctgggcctgggtcagaccggcagctagccgcgcctcgggaacagcctcaatgagggcagcgtactcttttcgatggatggacttcgacacgagcgcgccttggttgagcggcctaaaaagctatatccagttctccgatatctaaaaaccagatattctgtcttcttcattgacaggggga

SEQ ID NO: 613346 - DNA, 366 bp, Homo sapiens
caggccctcaaaaaatatgtcaataaattaataggacttctgctggaagggaggagggcagccacaggcagggcagagagaacggggtctggtgcgctgatgagagaagatagaagatagaaggattcttggatgtgagggcgatctggctgcgacatctgtcaccccattgatcgccagagttgattcggctgatctggctggctaggcgggtgtccccttcctccctcaccgttccatgtgcgtccctcccgaagctgcgtgctcggtcgaagaggacgaccatccccgatagaggaggaccggtctttggtcaagggtatacgagtagctgcgctcccctgctagaacctccaaacaaactct

SEQ ID NO: 613347 - DNA, 452 bp, Homo sapiens
  misc_feature (55)..(55): n is a, c, g, or t
  misc_feature (164)..(164): n is a, c, g, or t
  misc_feature (183)..(184): n is a, c, g, or t
  misc_feature (260)..(260): n is a, c, g, or t
  misc_feature (279)..(279): n is a, c, g, or t
  misc_feature (296)..(297): n is a, c, g, or t
  misc_feature (323)..(323): n is a, c, g, or t
agaggatcccctggtgatgatgtgaacgtgctgaaaaaagaccaaggatacaatncacatgttagcagtggctatttctggatgatgggcttatgtcttctttttcccaaaatctctggcatggatatgtattctttttgtgtacacgagaaaaacaatgaagnaaaaaataatccctacagnnaacccaacctcttttggattcagagagcgcattttctgccagagtggtatttacgggagaaaaggcagagaactgntgcttccctttaaactaanacaggcagaatttattnnaaaacaaagcgcagaaggtagaatcncggccacaggcatttacctcgcccatctctgaggcagtggggggacaatggaagaacagggactggccaagggaaactgtctggattggattgtcgaggttttcgcttttgtaaagcttgacctggagg

SEQ ID NO: 613348 - DNA, 130 bp, Homo sapiens
aggatacgaaggcactgccctgagacttcagcgcatacgtatggcgcaagcgattcgcgcaagcgataccaatgaacagcatgcatgccggatccaacacgcctacaaaggcatagggcgtagatcaagt

SEQ ID NO: 613349 - DNA, 912 bp, Homo sapiens
  misc_feature (398)..(398): n is a, c, g, or t
agcgggggatggcgtagccatggcgtctcttgtgtcctttcagcctatgtcgagccggctgcccgcgggctttgcgccgcgtgccccgggtccggatgctgaccgggggccggtctctcagacacccgctctctgctcctgcgggggactcgcagacgagggtcgtgcgactttgctagcacggacttaagtgcatctgcagtcaggttacctggtatgagttaacatcagttgtgctcgccagtataacgacaggtgcctccattgacgttccgtagggctatcctagggaccgttgttactttacgtattgaaacatctatgacgagattgacccagtagaagcatttcatctaaagtactcaattgtgtatgaaagacctgggcgttagaccagntttggaccaagtggaagattatcatgggcatggaagatcagaactatgtgggttttgaaatttcctgatataagatgctgaaacagttgaattgtgtcacactaaggaatattgtatgattcacatgtgctaggatgaagaatggatgtgatattgcaatcaaagttattcagactcgcttgttggtctttgctgcagaagaggtactacaatatgatagtagacgaatagtactggacagtgaggacacatataggccattctatgattgaactactggtacaaagatggatttctgatgggacttgtcatgtaagagtcgtactgatggtcttcacgtcccttctggagtatacttaggatcatactatcaatcgccgaaagcacctttgacataactaaatttcccccgcaagtagatagagacactcgggccaaaaagggggcttagaaacttgtgccgggggggggccccggaatcacaaggaaagggcccctatagatggagggtcac

SEQ ID NO: 613350 - DNA, 540 bp, Homo sapiens
ttttgtgatgaacgtcctgcctccgatgtgggatgcgatggtgatgctgcaggcatcccgtaatatgtgccataaaggatgtgggcctggcaggccccggggtagttgaccgaatttttgggtcgtgggcattggggcgtggcacatctctaatgcttggacaacgcgtacggagcgtgtgcaagctccgagtactctcgagcgttgcaatccgcactggcatcgaggcgacgcaccaatagtgaagggcgatttagaaacctagatggaacgcagactcggcgaccgctggttgagtctgatgcatcaggaatgacgtagtagttaaccgaataaatgatcatctctacagcacaacccaaagatcacagactgaatggacccttcctgttgagcaaggacaattcccaaagtaaatttgaaaagaccatgcttaggcccatgagtggccacaggggaggtgtcgaacaatgggctcaatctagcttcctcgctctggagtccagacacaacgtgaggcagcattaacattaaaaacag

SEQ ID NO: 613351 - DNA, 408 bp, Homo sapiens
cgacaccacgccaagtattgatttttaaacgaactaatacaacgggaaaactgatgcaaaaaacaagcagcagcagtaaaaagaacgaggccccgcctttcccttccaaacccaaaccaagggaagaaactttttcttatgtgttgccttatatttgaaccaagccggccttattagggccgcaaaaatgagtctgtgcccccacttccttagaaaccaagccggggtcctcggaagtcccatgaacctgtgtcttttaatgtgcccccacttcctgagaacccaggccgggctcctcggacgtcccatgaccctgtgtctgtcactgtgcactcaggagcatgagggccaaaaacaacccccaaccaacttcttcgcaagggaagccttgaattcttccccaagccc

SEQ ID NO: 613352 - DNA, 1419 bp, Homo sapiens
ggttctatattggcctgcgtggcattcccgtgacgcatcgcgcgtgatgcccagggaagacaggcgacctggaattccaaccatacgttcttctaagatcatccaatcaattattggtatgtattattccgaagactgtttggatctgtcgaggcagactagtacgataactgtgagtgcatccgaaggcaatgcattgcaagcgaggaattctctgcgatgatgcacgttcagcagggaaagtgcatgtgggtgtctgattgggacaaggacatccgaccaatgatgctgcaaggtccgatcgcagatgagggactacctgagaaaagcgatagcccagtcttctggagaatagactgcatgtgctcattatctcggtggtgaactgtgggcctttgtgttctaccaaaggacggacctcatgtgatgatcaggtggtacagtgattgcgtggccacgtaatggatgctcgaagactcgtctcgtcccctgttggcctggggttactcgaattggcgcccccattggttggaaagaggtacgacttggttggccctaggaccctttaggaaacctacctgggggtgcttccgggcgtcacgcggaggaaagggaccctcttttttgtttcacacgggacttgtcagtgtgagttcgacccatctaaaagaacttcttctcatggggatgtccactcaaatttggagaaatatcctatgagggttgacgtggttgcaatcgctcttggcagtctgcaagggaccttgtgcgcaagcaacgagaacaggtcggggtgaatggccacgagacgaagatgctcgcacctagctgtggcgtttgaaaacgaattgacatgtcaagtacagttcatcccgcacccccttattcgtcccattatttggggggcaatgggattccaattccccatagccataggggttggtatccaggaaactaagagtgagtgccacaggcagattccttaatcggaaaatcacatttggaaaaatggttggcttattgcaaatcacatcaaccacaaggagagcgaacaatcttcttggcaattatccttccaggcttttcaccataggggaagagggggttggttcccggcaaaagctgggttttagtgcacaaggatgttcgttagtccattggaccaaggaatattgtgggggttaaaccacacacatacagttgttttcggcacagtcaacaggtaaccccccgaaatttatactaaattggaatttcaacacgcggggagcataaccaaaagaccggaatgttacccatgtgcacccatttgaattccttgaggtgagcaagacagcggtgacatttaaccaagccatgtacacaccacacatttggccttgagacaagcagggttcaaacggcgcgctatacctatga

SEQ ID NO: 613353 - DNA, 189 bp, Homo sapiens
gagaactagtctcgagttttttcttattttttttggaaatagagtctcaacttactctgtcgccagggctggagtccagtcacgtgatcacagttcactgcagcctcaaactcccaggctcaagcaatctcctacctcagccctcctgagtaattgggcctacaggcatgtatcaccaggctggctaat

SEQ ID NO: 613354 - DNA, 1028 bp, Homo sapiens
atatggctatggatcaggccgggtgtaatcggacgaggcagaccggaaaactggatacttctgcgctgaccagggctgagcgaatccagaccaggtcggcgtaccgtggtactgagtgaaggtgcagtgctggctgtcctctggtggacctggagaatgatgagcaggcagccagtgccatctctgagctggtcagcacagcctgcggtttccgtgctgcacctgcggcatgaatgtgcccttcaagcgcctgtctgtggtctttggatgaactacacactgctttgtgacggtgtcaggacagaggggtgtttgtggtgaattaggctgaaccgatggtcgggagcccattgatgtctgatcctgccggagggcgagggtcggagaagcggatttgggtcctgggcctctgtgatgaggcaggcagcacctgtcggtcttggagttgcgtgctagaacgtagggccttctgctctgcccagcttcctcagtccactacctgtacgggcccatggattggggactctgagctgtgttaagggagaacaagggcaatggagagctccctttgtggctccctcagtctcctagtaaacgatgagtcttgatgttctccaacagtaagagacggactcagtgtacacggagataagtatgtgcaagtaatacacggatcgaacggaggaaaccaaacaagggaagggaggtaacaaaacggtttcaattaggagagtaggcatgatgcatcgagaagagtgaatgttggggaggcacacttgaatgttcaagagaaggtggggtgataatgcggcgcgtggcatcgtagagatatgggggagggaatttgtttattatggcaggcaggggagaaccagttcgaattggaggtcgagagtaaaaacgacggggtggataagcggtgaacaagggagtgtgtatcattttggtgaaatttgtaatgaaataaggatgacgaggagaagtagggcgtagttgaggatgagaaaagagaatgagcacagaggaaa

SEQ ID NO: 613355 - DNA, 947 bp, Homo sapiens
ggcggggcgcgtggctcacgcctgtaatcccagctctcagggaggctaagaggcgggagggatagcttgagcccaggagttcgagacctgcctgggcaaatatagcgagaccccgttctccagaaaaggaacaaaaacaaacaaaagacaaaaaaaaaattaggggtaatttcccccaaaaaaaaaaaaaaaaaaaaaaaaaaaaacttttgggggcgcttctggcctccgagaaaaggtttttaagaacacatttgtgttggggcgggggggccccaagtaggtgtagcggcaccagtgtggcgaacagcgtggttccccaagggagaagccgcgggggccaagaacacagcagggcgctcgggacctccccacgacatataaaaaaaagcgcgcggcggggggagaaccggactgttttgcggaaccaccatcccgagaggaggggagctttcggagcgaccccaaaggggccttactacacacagagaggtcttccccgaggggggctccggatatacaaattaggaccccgtgatggggggggaaataccgacacgacagagcggagcgaaaggcacgacagacgcaaacgccgacggagcagacaaggccacgcacaaaacagggaagtagcagagcgggccacactgccacgccaatcagaccacagacccacagccacacccacagtggaccagaccacgagcccgactgcacaacacgaaaggagccgacgaagaagcaagcaaaggggaacaggtaaccgacaacacgcgaaagcgcaacacaggacaggcggagacgaccagaaacaacaatgagaacaccagccagagacaagaaaacagcgaccagcaaaaagaacaagaagccaaaaacaaggtaagcaagcggagagacagcgagaaaccaccaagacaaccaagaggaacacgagtacaaaa

SEQ ID NO: 613356 - DNA, 346 bp, Homo sapiens
  misc_feature (221)..(221): n is a, c, g, or t
gtcggttccatcaatataaacagagagggttgggacggaatcagggtgcagaaaagacggactcattttatcatctgcgggggggcgggagttatatggagaaccaagacatactacgtatcgctcaagatcagatcgggactatattaggtcccctttaccatttcagaataggtacccaggtactccagctgatttcaatccgggttcttaagcaggtnctcagcttcagaattacgatccggacagagccctatcagattatatcactcggctagaggcacggcaaagacgagtgggaactatacggtcgggttcaactactcaatttcaggctggcatgaga

SEQ ID NO: 613357 - DNA, 793 bp, Homo sapiens
  misc_feature (153)..(153): n is a, c, g, or t
  misc_feature (476)..(476): n is a, c, g, or t
gctacctcatctgaccctggtattaattgtgatagttttttggttgagtcttttggattttctaggcagacaattatattgtctgcaagtaattaccatgtatagcttgtcttattgcatgcttctttgtgggtacctcattttgtgaatatngtatcatcatttctcaggaagtctgaaccggtcagtttttgctttagtacagggacaccttgccatttctttattttaggagcacatggagcagttgtttaaggggccatgtagatggaaatccagtttagaaactcttctccctgcagctcccaacaccttattaaattcaataggatgaatgaacttatgttattccactgtactgagagttttgttttttatttccttattttttcccctctctattaattctgtgctcccattgctcaagtttataagtttctgattcttgagtgaatcagaaacctcaggcttccttntgtctagcctgggctaggctctcctatccttggttaggctgaccttgtacccttcgttaaaatagagaataatcatttcgtgtttctctgtaggcattctctggctgtaggaatgcactcctccacagaaaccctggtttgctgggccttatttgttggagttggagttgggggggcacggagcaagcagtaaagagctccagcctctggacactatccaggagctgacctagggacctacttgcaccattcctgccctgatgcacttgggttgagaaaagggtgcgtgtgtgtgtgtgtgttaaacgaatatgtgg

SEQ ID NO: 613358 - DNA, 467 bp, Homo sapiens
tttaggcatattttttttataacttgagtaaattgctttttttattgtgcactgtgtaaaccaaaggcactaaaaccatgaatttgactagtgtgatacaggtattccccctcaaaaggcgacaagtgagcatacagccgcctgttatggcactaactcatagatagactcgagaaggtgagagctgttacatagccacagtataactccacatgtgcattgaactggcaaactgaccgttaactcttcaaagaaaaagtgctcataaataacgtgttaccccaaaattgttgacaaataccttagaagattagctgaggcgattgaaagcaccacacattaaacagaatgcatgtggtaaaatggattcaactctacaggttcccattcaggaaatactttgttaagcatggcctgtctgtaaatcgtgctgaatcacggactctttagcaaaaaacttctcggta

SEQ ID NO: 613359 - DNA, 144 bp, Homo sapiens
cagggtctcactgtgttgcctaggccggtcttgaactcctgggctcaagtgattctcccaccttggacctcctaaattgttggggattacaggggttagacactgacacctggccggaatgactcagtttctttaaacgaatct

SEQ ID NO: 613360 - DNA, 171 bp, Homo sapiens
gcaggaagagaaaacatctctgaacccccaccattctgccatatgtatgtcaagagtagacacaaaagagtcattatggtatatgtaatttgaagtgcaaggtgatatattgccgagaagagtgccaaggtatttgccaaatcaccaaatgtaccgtaaacgcctcttaca

SEQ ID NO: 613361 - DNA, 188 bp, Homo sapiens
acccttcaccttagaagttgtggaaggatcataggaaatacttgcaataaaatgtataatcattaacattggcaactgccagtgggaagttgtatatgccacatactactgataaaaattgtagggacccattggtagttcccataaccaccattgatgtgttaattcccacaacttctaaggttaag

SEQ ID NO: 613362 - DNA, 293 bp, Homo sapiens
gagggtccgcggaagaggcgcactaaacaattagggaggatgaaggttgggcgcgacactcgagtgtctcgcctaatagaaattctagaaagaggaagtagagaatagagaggccaggtgcagtggctcacacctataatctcagcactttgggaggccaaggcaggaggattacttgacaccagagttcgagactagcctgggtaacacagcgagaccccccatctctatttaaaaaaaatgagctgggcatggtggcatgcacctgtagtcttagctattcgggagacact

SEQ ID NO: 613363 - DNA, 965 bp, Homo sapiens
ttatcttttttttcttctctcttgttttgctttgtcctcttttttgcttccttttttttcgttctttttctttcttcctttttttccctctgtctttttgttttcgttctctctcgtttctcttcttcctcttccgcgctctgtttcctgtctttcagttcctagtctctcttatttgattgttttgtcgtctttccttcttctctgtgtatttttcttctctctcttctctgtcccttcccatatttttccgtttctttccttttgctcagtatgtttttcagggagctttctcttctctctctcttgtcccctgttctctgtgacgtgtctcctatttatgtctctttttcctgccttcttggcttccattgtaatgcgccacacgtttctggtcgctctgactgtgtctttgtttctttcttttgccccttgccgtcgggtctcgcttcgctctttcttgtttccttcagcctcttcgagttcacttttttcttcattctgcctattctggcatcatgctcatcttcgcacggaggtccctcagccttcttgtagtttaaggcaatcgtctatagactccttgtggctcctaaagtaccctgtctgttgagatttcaagtctcttgtcaccattcctcacatctagtgacaactgaaccccataatgcataagtggcctttattgataccaaagacttgtgcaaacagtgatctctctctccctgtgaacggagttgagcacattagctaacaatgtacattaattttggattttcatgttctcatgttgtttatttttgtaaatattatctgatgtttggagcttgagtatacagatctgtaaatatagttcatcgtatttgtactcacttctggattcttttgactgtatagccctctacgatgtgcaatgcagacatctactctaaccttatactgtcccggaagccttgcagtctcga

SEQ ID NO: 613364 - DNA, 1042 bp, Homo sapiens
tcataacgctggtaggggagcgagatacattaatgaatggtataatatcatagtagaggtttgtagacaaagacatggcagctccagcaagagagcagtacctgcctgggatttgttggacatggtattaggaggcggtatttgagcagcagtagaagggcacgcatggccaggcatggctgtgtaaccatgccttcagaaactccctaagaagctagatgagaccttgagaagcagtccgttgagcatgactatcctcctgtcgtgtctatcatcgtatgtgaaggcccacttgatgaatttggattatcccagttgtagctggcattgctagaatagtctacttctgttcttgctcgcattctggctgacgagagagaagccttgtattactttgctctatttacatagtgaatgtatggactgcttgaagcttcaggttggacatgggaagcagtagaaggaagggaattcctttatgagcagccatcggtacacatcggtcacgctctctttcattccattgtcttctgtccgcaggaagagcttaattttgctctaaaggattcatcgatagaattctaggatacgcacacattcctcacgtgacaaaagagactcatgcaatagtccgcacgaggcccataaataaaacgtactcggtaagttggagtccagcctaatgtagaggtttgcaaactcgacacacgcgacctctatcaagctaacttttcttacaaatcccaccattatgccgaaaggaatcctagcaccttgaatctacagctaacctattgccaagttcctcctcccacgtgtgtggaatttctagcacacgtgtaagctggggctacacaacgctacgccacgcttgtcccattaatctaccacgcgccacggggatgactacctctaatttccctctacacctcctgcacggtcactcgcgcagcgagctaccaaagagttccgcaccccacatagacactaaacccctataaccttgcagtttggcccttcagttttacccccactcacctcc

SEQ ID NO: 613365 - DNA, 840 bp, Homo sapiens
cgacagccatcccagtgccaagcgcgtttttttcaccggcactcccctggtcctatgcctgcctaagggctttttacctctggaattgggagggcccacagaagggagacccctctttgccaccctcttgagaggactggggcccccctctccagggccggcctttgcatgggcctggcccggttcaccaatcgtccggggctcccacccctcctgcttgctgtacgttggggatgtaaacgacccccaccaggttccaggttggaagggttgggcctgggcaatccagcccagggattgcccggttaccagatctttttctcagagaagctaccaaaagatatctttccctgggtacataaatagtctgccacccccagccaccctcttcttctgccaccacacgggggcgcctgccatagtccagaatggccgtggtctataccagggggagactcttgtgccctagatggctcttggcaggacaactgagggcctgcctgtggtgtgcccggcgtctgcccaacatcccgggaggggaagggctgctctagctcaaggtgtcctgttcggtagagccagatgtcctctgaccagccgtgtcccccggaccagttctagacaaacccctgggagatggccaccatcccaaccaccacgacaagagaagcaagagggcccgggaaaccccgcgctcggttgccctttgtccacgggttttaaatcggcctttggggtttggtgagaaggccggttttgcgggtgttgaccgaagtattttttccttataagttattataataatgggtaatttgtccattaagcattcctttgggggga

SEQ ID NO: 613366 - DNA, 5713 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacgtggcggccacctgagcacacaggcatttggtgctgaatgctgtttgggaatgacgaggaaaactttcggatttttgcgtttttttttcagcatgttgggataagtactgtgttcacgtggttgggaatctgaagggtataagagccggaactgtgtccttgcaccctcacgtccctcccccaggcaccacctcctgtgcagccttcatggccttcgagtggcccagagagcgtgtgtctggatgtgagcgtgtgtgggcgcgtgctgagtgtgcatggatgagtgtgagccatggtgagtgtgtccccctcacacctacatttaaacacacgggcggcccctccacccacccctgcaccaccttcgtcacacccacatttaaacacgggcggcccctccacccacccactcctgcaccaccttttgttttccggaggctctgacttgacctctctgggggatttcctaagaaggagcttccctgtttttccattttgattacctagttgtgatttttggtgtgtgatttatgcagacctgcctgccctcaaatatatttgatggggaaagaggccaaaaaacccccctagaaatcatgaatgacggtgacatgctcagggaagcagttaaccgaatcgggggctctgttgtggatgctccgccccatttaggaggaagaaggcagatctgggcctgaaatgggacggtctctgagctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcgcgatctcggctcactgcaagctccgcctcccaggttcacgccattctcctgcctcagcctctggattagctgggactacaggcacccgccaccacgcctggctaattttctgtatttttaatagagacgggttttcactgtgttagccaggatggtcttgatctcctgacctcatgatccacccacctcggcctcccaaagtgctgggattacaggcgtgagccactgcgcgcagcctggcgcacacttcttaccagaacctagtcacgaattcctcgtcgaactagaattaggtatgtttgttactgtaaacgcagcttggtggcttacagtgattggcactctaacagtcaggtcaggctagagagccagccaccgcagacagaggagtggacgcgtgaacgttgagttgagaccaaaggggccacctggtgggataactgtcctcacccgtgaggaggaggaatgtcccctgtccccgggggagagtgctcctacaccagcgccgaggcggcagaatggtgtcttcaggggaagagagtgcccagtttgagcttctccccccatttcgtttctttttgtgttaacatctgcgcatctggcagcgttgagaattcctagtgactgtcattacaggcggcagctttaaggatgtgattgccggtgacccttggccggtcccctgtctcctggctcctcagcaggaggctccctgtgtcacggtgtccttgggcagttctcggtggcctttgccgccaagcttccagggagctgctgggcgaaggctgagacccagcggccctgcctcacagtcacagagagaagagctccccacttggccctaactcataacctgccccaatcccggaacactcggtgaggtttgagagatgcacaccacgtaacatctcgtgggcgaatcaaggcacagcaacgcagtggagcctgaggggagccgggcactggtgcaggggaccatgcacagggcaccctcggagctccgttcctggccacaggagccaaggcaggctggaatgtccagcacctgcatgctgggggcctctgctgcgccactggcagtgggaatggaagcccccacctcttagccgactgcagatgggggtgtcgtgttctgctcatcgtcatttcgttttagtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccaggtggggtccctcggaggtacgatctgtgcccttgcttccccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgccggggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatctctgtctccctgtggaaaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttgactcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 613367 - DNA, 278 bp, Homo sapiens
  misc_feature (86)..(86): n is a, c, g, or t
agcggcgcctttttttggaggtcgatcgatcggctgactatatagacaagatactgataggttacatgtcgaagaaaacatacaantacaaaatacagaaaaagtcggttccgtcccctcccactagcggccggccttttttttttttttttttttttttttttttttttttttttttttttttttttttttttttttttttttttttttttttttttttttttttcaaaagagcataggaggagaagggcgccaaggggggggacacaaacaggggg

SEQ ID NO: 613368 - DNA, 1653 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcaga

SEQ ID NO: 613369 - DNA, 87 bp, Homo sapiens
gcggccgcctactactactactgctcgaattcaagcttctaacgatgtacggggacatgatagacataaaattggtttatctcctcc

SEQ ID NO: 613370 - DNA, 2839 bp, Homo sapiens
aaaaaaaaaaaaaaagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 613371 - DNA, 102 bp, Homo sapiens
tgcagacgtctgtgatgtattattatacgaatggggcttcaatcgggagtactactcgattgtcaacgtcaaggagtcgtgcggtgccctcatgaggccacc

SEQ ID NO: 613372 - DNA, 499 bp, Homo sapiens
cggcacgaggccacttttggtaagcagaactggcgctgcgggatgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcaga

SEQ ID NO: 613373 - DNA, 389 bp, Homo sapiens
caaacaatatgcactaagcaataaacatcaaagtcggggcagagaacagagaagggtttgacatcagagaacggtacatcagagtatagcaactggaatggtttctactcttaccgctgtagctggttccacctcgacatattatcttatacacctgctttgcatggcatgaaaccagactcatccttttaaacatgcaatagggacgacatatgcagtttattgcatgtccaacttctactctgaaacgcaatttttatctatgcacctagtagagacacacgagaccgagaagacgaaagagccaggacgggagggacgggacgagaacggggaggaaccgggtacagggcctccagaccacaggcatcttctcactcatggcccac

SEQ ID NO: 613374 - DNA, 592 bp, Homo sapiens
agggagtcggtgcctgtggtgtgggactgaccggctgcctcctgccagtgggcttgtggcctgtggggccatctggccatgagcacttctctctctgtctgccacgacaggggggacaggccccacctcggacacaggctggggctgcatgctgcggtgtggacagatgatctttgcccaagccctggtgtgccggcacctaggccgaggtgagtcacagccctggggagggcgcatggccacggtgttctcaggaagcaaaggggactgtggggtcagggctctttagagcagaccacaggtaaaacagtaagtagaacttgggggtttcttgagtaatgagccacttgtttttcttgatttaaaaaactgactttaaagaatgctaataaatccgcatgggcaacatggcgagaccccgtctcacaaaaaatacaaaaattagccaggcgtggtggctcctgcctgtagtcccagctacttcggagactgatgtggagaattgctagaacccaggagatggaggctgcagtgagctgagatcgcaccactgcgctccagcctctgcaacagagttagaccctatctgaaa

SEQ ID NO: 613375 - DNA, 135 bp, Homo sapiens
agctatgcgtgtccggcggccggtccggtcggacaatcatagcctcctatctggccgttcctaacactcaccctagcattacttatatgatatgtctccatacccattacaatctccagcgatcgtccgagcgga

SEQ ID NO: 613376 - DNA, 421 bp, Homo sapiens
  misc_feature (366)..(366): n is a, c, g, or t
  misc_feature (368)..(373): n is a, c, g, or t
  misc_feature (377)..(377): n is a, c, g, or t
  misc_feature (381)..(381): n is a, c, g, or t
atctgtatctttagtgtgaaagtgaaaacttgttctacatatttatggtagagcggacctgtaatttttattcccaataagattggaggtggacacaaaggaagaggcagccagacagctacttcagcgtcctcaacgcattcatcgacaggaaggacagttactactccattcaccagataggtgggaggctgcagaatgtgccaggccccacccgggctgtctggagagggtggagtggtcggtttcccctcagagcttttctggtgtcgtgggatgtggagcaggaggctgtaaacctgtaaacactgacctctgaccatctgtgcgctgctgtcacatcacccccgtgtcatcccacatcancnnnnnncacnaggnccaaccctgggccttgcccttcctgctgtccatgcggctt

SEQ ID NO: 613377 - DNA, 323 bp, Homo sapiens
tttttgggggcccttttaaacaagttttttcaaaaaaaaagggggggggcgggtcgggattttcggggatttttttccccccggggtcccaaaaagagggggggaaggggggaattttttttttttttccttaggggatggggttttggcaaccccccaaagcgaggaaggcttttttttttcccggggtaattagttgggggggggggaaacccccccttcccggggtttttgggttgggggggggaggttggggggggccccgtttttatttttttccggggccccgggtgggaattaaggcccccccccttcccttggga

SEQ ID NO: 613378 - DNA, 2887 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 613379 - DNA, 1400 bp, Homo sapiens
  misc_feature (863)..(863): n is a, c, g, or t
gcccacgcgcggaggctcactagatctgctcgcagcgacattcacgatccctaccgaacatgccatagatgtacagatgccagtgtcatggtgcctggtatctccctaccaactgcattctagattcacagtggtcctcagggtatattgtcattgatgtctatggcggagataaggttgacgatgtggtcatggtggatgtatggttggtagagtctaagcgcgaaggcttattctagagcagattatagattagtgagtctagaacgggacagtaggatgcatgacatcagcatatgctggctatgttaacataggacagagtgtagtgcggaaagaggcgagtcaagacagagtagagcttagaatctgttgcaactcgaatgggattccttgtgatgagtgatacttcatgttcataatttgagggaacactttgtgagggtacttagatgcataaatccgtggagatgtgtgtacccatagggcattatatataaaacgtacctatctgacagaaaggcggtggcattcaaatgaatgaggttaaacgcacggagatgataggctcgaaaattgctgcgtaggtacaacattcgagcaacttttttacacacagtggtgtcccagtacgttcacaaccagacgttgaacagttgcgacgtagaacgcacccaggtgaacgctacttcggaacgagcaactaattatccattagggatctcttcgaactactcgatggtgagagccgttagcttcgagtaagccttgcgaaaaaattggcacggcggtaaaaacaggactacaggcccaccgtttttgtgtcgcctaaagaagctagccttgctcagtccctagaaganaaggatcggagctcaaaaggcccgaacaaaaccgattttcgcttgtccattgtggcatcgtgcgtcccattgacctagaagtccaacaaagctgtttacacgtgcaaattttggagggcacgcaccaaagaccacaagcgtacaactgtgcgagtacgatacgtccgtaaagagggctgtggtctaacagggaacgctagatttgagtcgctccacacgtttcgatttttggaccacgaggggggggtcatagtatcgagagatacacgtataattactctgatggtttctttagggactttaagaatgaagagagacagcgttgtagaagtggtaggtactcttgttcatgtgtcacggttggaacgttcattgtacctatataagccatcgaggaacaggtgatggacccagtgaaagattattaaaggctgggcgaaattcacaacaaccggttttaagcaatagaaggatgtgaaagaagaatgaagagacccaatgagtgtggggggccctgtttggacagagaggttgtgt

SEQ ID NO: 613380 - DNA, 1151 bp, Homo sapiens
tcttctctctgccttcgtcctctggcttttgtgcttgctctttccataactgttttactgccgcgtaccgattggtcgtcactgggccttatgctctcggttccgctcacccatatctttgcgtgcctcgtcgtgtcctcttgatgcggcatcccttttcttcttctcattggctttcctgcctcttcatgttgctccttcctcgagctactacgtcgacgttgacaggattttgcgcgcgcacgccgatcacacaggtccccttcctttcaagatctctgtccctcgtagacggatccaagccctggtgctattccatcaatgctgtacctcgaggttgtttaacacgttatggtctattctcggggggtgcactgtgtcgatgcgctcatccctaataacttcatcccatggaagtccggtcccagacttcgtaatgttctccgctgttgacaaattctacgccgctttcaccttcgatgctctcccacttcaagctaatcatcgttacttgtcgaatggctcatctgggctctccagatgcgaggagctgtttttaagatgcatgcaaagaccggggcttataccgtggtcgaagcacagtaccatcggggtgcattcaagtcggcgtctgtaaccctctctccgatgaagcacgtttgcgtgacatagttcaatggttactgcgtgcaccatgctcctgtaccagcaggggccacttgaaacgccaaggtacagggtgatgaactctgtggtactcagcatacagttatctccacttctttctcccactcacccccagcaaggtgcctggggagaattgagcagatgttatcaattcttaggccttaggcctagatggcgtgaaaggccagagcctcggccgaatggcaacgtgtgacactctggcattccccagctagctttcgcccagagaggcagaggggccttcacacagcccgggattgctcctgacagcgatcctgcacgtgctgcagcatgcaggcattctgaggggcaacgtggaggaagggccagggatgcaagggattataatatgtttcagtcacacctatccccgtggcaaagaaacagtcagtcctcttcaggtgtcttcatgatttaaagcgctgctggacagagaatgcttt

SEQ ID NO: 613381 - DNA, 2975 bp, Homo sapiens
ggaagatggacgcaggtgttattgaatgtgatgcaggatttttctcagccactctggcagccagagacctccggctggcgaggcccctgcccaggccttgcttgggtccaggctcgccgcaggagataccccatctacttggtccaccggtgtggcacctggtttgcactatggcacggataccatgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 613382 - DNA, 81 bp, Homo sapiens
tgtgttctatctagcctaggggaggacattgcctagagggggagggattgtctgggttcaggggcatggctggaggctgcg

SEQ ID NO: 613383 - DNA, 2825 bp, Homo sapiens
  misc_feature (12)..(12): n is a, c, g, or t
  misc_feature (18)..(18): n is a, c, g, or t
  misc_feature (21)..(23): n is a, c, g, or t
  misc_feature (25)..(28): n is a, c, g, or t
  misc_feature (31)..(32): n is a, c, g, or t
  misc_feature (35)..(35): n is a, c, g, or t
tggctaggtacnaggctngtnnnannnnggnnggntgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 613384 - DNA, 195 bp, Homo sapiens
  misc_feature (195)..(195): n is a, c, g, or t
ccgtgtagtcacagcttaggagctgagcaagagatcgcttagctgggagctgaattgtgccactgcactctagcctgggcaacagagtgagacctgctccctcacacccccaccaaaaggaataggaactgttttccaataaatacagttcttatttatgtcttcctatcagtggttaaaagacaattgctatan

SEQ ID NO: 613385 - DNA, 159 bp, Homo sapiens
  misc_feature (53)..(53): n is a, c, g, or t
  misc_feature (73)..(73): n is a, c, g, or t
  misc_feature (114)..(114): n is a, c, g, or t
  misc_feature (119)..(119): n is a, c, g, or t
tcggcacagccagaatgtttcttttctcaccaggttactgagatccggctcanatattttgatactgtacccngttgctgctgccatgtgtgtgcttaaaacagggttcctttntgtancatcagaatttgggaaaccagtgagtaatcctcctgtacc

SEQ ID NO: 613386 - DNA, 128 bp, Homo sapiens
tcacgtttgtcagcagacacatcctgcatgtgctgacacggcgggcaccatgtgcgggatgatgcagtggccaacctgacccagctgattgagggggcccaggagctacatgcctactctatgcgccg

SEQ ID NO: 613387 - DNA, 573 bp, Homo sapiens
tgaccttagaggaccccggaacgcatcagagtcaaatctgagggtatgattagagatgactagcaatgttaaagctgagaaggttatggcatgtgtatcaaaatattggtttgtaaaagtagaataagaaaacatataaatatattaaagacaataggagcaagacttctcactattgaagaagaaagctacacatttaagaagtttgaggctaggtcgagccatgtgactggaattgaaggtactgctgtgaactcatggttttaatatacataaatcagttgagatgtacctatatacatagattcaaacatcatttcctagatctgtccactaagagaatgtagaagcaatgacattcaaaaaccaagaagcacacctcacatccagatcttggtttctaaaaaccatatccaccaagcaaaccagggcttcttggaaaaatggctaatttcagggctgggataaggaaagtgtaagaaaagtcaaaaacatcttgtttcagaaagtaagaaagtattataaacttatgggcatttgtcccataatccatgtgaatggtcgtcgaagttg

SEQ ID NO: 613388 - DNA, 3416 bp, Homo sapiens
  misc_feature (1268)..(1268): n is a, c, g, or t
  misc_feature (1300)..(1300): n is a, c, g, or t
  misc_feature (1423)..(1423): n is a, c, g, or t
  misc_feature (1435)..(1435): n is a, c, g, or t
  misc_feature (1447)..(1447): n is a, c, g, or t
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaaggtttgtagccgccccacacccacagccgagctgagccacccagggagacaggcagtggggcgtgcaggggtcgaaggcctgcgtccaggtctcaggcagcctcactgggccgtggggagctttgtcccgcctggcacagctatgtagctnagcagggtggggcgtcctggattgcccatctngcaacacagttaacaaccctggggacggatgttgcgtgttgactttagaatgggatttccagtgtcctcatccgtctcctgttgagatgggggtggtgatggggtgctgagctacgccggccnagtgcgtgtggnccacccccctcngccgtggtggtcagactgtgctgtgtgttgatcaccacactgggttctcgtgtagcctttagtgtggagctgcctctgttttctcatcagtgagatgggatgacaggtttgtccgctggctgtggccggctggcccctttctcttggccgcagcaagcactggggtgaggctgcacctaacggccatgtctcactaacagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 613389 - DNA, 315 bp, Homo sapiens
cagggatggtgtcgaacttgggagctcaggtcgaccgcggggagagctcagacttggaggttcaaacgatggtgctgcctcagcctcccaagtagctggaattacaggggcctgccaccacactcagctaattttagtgttttgggtagagatggggtttcaccatgttgtccaggctggtctccaactcctgaccttaagcgatctgcccaccttgggctcccaaagtgctgggtttacaggcttgagccactgcacctggccagcttaatatattcttagactatggaaggcaggtaggatacagtagggaga

SEQ ID NO: 613390 - DNA, 118 bp, Homo sapiens
cgagtggtccctgctctgcagtatagtgtgctatgttttgttttcccacttgagccagaagccgaaatattatactaccacgttaccaccatctaccacctccagcaggacccactcg

SEQ ID NO: 613391 - DNA, 494 bp, Homo sapiens
tccccttcgacgggtactgaaccaagtacaaattcccaactgtgaccttctggagctggatataacaggacaagtctgaggtgaacatgaaagacaagccaaagaaggtgtcctgttctggtcacagggggtaggaggtccccagaggcagtgacagagtcagacatctcagaggaggaaggtgtgacaagggagtggagagaagcttcgagtaaaagagggttttacctcatgcaaatttggagctcgttttgcagaatggcccagtagcctctttgggcagagggatgtctggagttgaggaatttcactttgtagagctgatcttggttcctgctgttttgggagacctcagcgctctacattctctgagaggggtatgtggaagtggctgactcaaaacccagcggtgctaccatgaagcaagcataagccagataggagctaggagaccctgcagctgaggctgtggagtggacagcactggtcaggag

SEQ ID NO: 613392 - DNA, 298 bp, Homo sapiens
cttgacatctccgccttactttgtagccttcatcagagattcgctgaagattgcggtatataggctgagcaagaggtggtgaggttgctcggggtttatcgattacagaacaggctcctctagagggatctgaagcaccgccaggtcctttgagttaaaagctgtggctcgtagtgtactggacgagcagtaatgtagattaaactgttgaggtttagggctaagcatagaggggtatctaatcccggatagggtccttagcaattgagtgtacagatatgttaaaaccacttgcgaa

SEQ ID NO: 613393 - DNA, 902 bp, Homo sapiens
gtggtttaaaagaaagtgtctactttagaagctttggtcgtttgctgaaatagccaccctttcagtgctagcccttgggctggaatttaagtccagggtctgatcgagccagaaagtaggtgtcagcgtggcttccggaagtccgttgtcacttggatttgacaagggacaagccgacctgctggtttctgggctcctgctcgctgtgcgctctgcgctgtctgcagggattggtgcccgcggagtgcgctttgtctggagaaactcagtgctcgaagagtgaggagaccgggaggaaaccttccccctgcaaagcttatctcccttccctctcatcagaggcggggccccgcaagacacaagggatttccccgcagaatgaaccaaggcctccccaggacatggggtcagttctgctgtgcaaagcctgaattcacgtttctttcctaaagtggctcccagtctctctgcagccttggcctctctttgaatcccaaccctgacttccctggtgtctgttggccactcccttctgggagccggcaggtgaaaccctgacctgtgagcccggcctgggctctccaggctctgggccccctaccctcccgatctgtggccctcactcctcctgggcgaggctgttgtgacgcggtgtgtcccaattgcacacaagccgaaacccaactttaaaaaaagcgtagaggacacattctctttctcctaacctttaaaaatacacccagggtatctggaaaggcaggtccacgtttagaattcctcaagctaaggcggcccagggttcacgcctgtatccaaattccaagtgaatggagatgttgagccggacttgagacagcgggttttagggactgtctcaagtaaattcccggctgtgatcttcc

SEQ ID NO: 613394 - DNA, 103 bp, Homo sapiens
catgtgtgcttctgtcgagagtgccttcccgccgcctcccgtcccccgactcgaggacatcatttccccctgcgccgtctggagggaggtagcatcttcccct

SEQ ID NO: 613395 - DNA, 331 bp, Homo sapiens
gcgacatgcgggtgtggctgtaggatgtgggtcctctctgctgccttctttcccacacaatctcgtgccctcactcatctgctccagctgcaccagcctccttagaacatggccgggagctgtggcccacgtctgtaatcccggtactttgggaggtcaaggagggcagatcacctgaggtcaggagtttgagaccagcctggccaacatggtgaaactccatctctactaaaaatacaaaaattagctgggcatggtaacgcacacctgtaatcccagctactcaggaggctgaggcaagaggatcagttgagccatggagtaaatggca

SEQ ID NO: 613396 - DNA, 910 bp, Homo sapiens
cacgtctctgcctgctcgactctccgcccgggccgctcggccggtccagccgcggccggcgcctggctgtgaggtggattcccggcccagtctgaccatctccctccagtttttccacttgcgttcggaccttctcgataacatatgtcgaccctcgtacgtcgtccccttcacccgagaatgccgttccgcctagcctcacgagcccgtcaatagtccgctcgcgtatggcggaggctggcgtgagggtcccgtgatggggcaggagccgcacgagcgggatcttgatgcatgcgcaggcgtgagccgtacagggagttatagcgaaagcacgtacaactcatgatcgcatagcacgaggtatttactgcgtccatgaggaagctcgattgtgtcgagcagtgtgcttcctgtgggtggatgtagaacgtgtgcttcgacctgcgctggcctgcaagtgccgaaaggacacgatcgccctacggagaccatcgagatgcgcgcaactgaagttgccgcaacgtgcgtctagttgcctcgcacgcacccatagcgtccgtcatgttgcagagttaccccaggccaacaacagcacctacttggcctggttgccccccttacgcaaacagctctttgattccaaggaaacgcggacgcaatacacccctgtacccaccttaagcgttggccaccgtctctcgcgctacaatcttccaccaccgctcggtaccctggcccacttccacaccacacgcgggtcgctccaggatggaccccaccccttccacccaaacttggcggcctcacctagcaaacctccgtagcaagggggttggtcgcaacgactttccccttccccgcgactccaactcaacagcagctcgccaaacgctccttggcaaccttgggg

SEQ ID NO: 613397 - DNA, 394 bp, Homo sapiens
gatgacatttcttaccaattttggctgaatgaccatcacctacattgcagaattggtgtgtatagtatatgcgttgctacttttgtaaacttttcctgaatttgagcggctaccttgatactgcagtttcatgtctgaactgaattagctcttattcatatagccactcagcagccataaaaccccctaggatggttagtccactcatttccgcttgggaaacttctgtgagagtatatttttcttgcgcaccatgtacggtatttcccactaaatcaatgctacgtgtcactaaggtatgtgtgtattatgatcatagtagtagcatagtttccacctgtatcacgtactttataatagtgatagatctgtttcattgtggacctgggcgtga

SEQ ID NO: 613398 - DNA, 933 bp, Homo sapiens
tgcctccgctaaccataatcatcgctatccccaccggcgtcgaagtatatagctgatctcgtccacactccacgtgaagcacatatgaaatgatctgctgcaggatgctctgagccctaggattcatctttctttttgtcaccgtgactgtggcctgacatggcattgtttcaggcaaactcatcactagaaccactcgttactaacatcggagcagcagtactatcgtttgctaagcattcgagctatcgcatctgatgctcactagtcacattaagcgagcatgtatgtgtgctcgatcatagtgaggctatcattcactagattatcgccctatactcaggctacatcgccctagaccagacctacgcctaaagccattttcaccatatgatatccatcggggtatactcgtaatgtttcttcccaaaacaactttgctctggcctatccggaatgcccccgacgtcacgcggactaccccgatgctacatgcagcatgaaacagtcctagtcatctgtagggctcatgcatttctctgatcaaggcagtgaatgttactaattttcatgatttgagaagccttcgctatcgatagcgaaaagtccctaatacgtaataagaaacctccatgatcctgggagtgactatgtgggatgccaccccaccgtacgaaagatcgaagacatccgtatacttatactctagacactactggcgggatctgaacccccaaaggaggttacaaggcagccatggctgcatgacttttcgacactgctcctacagtgccaacactgttgggggcctgcccttaaaaattaaacgcactgtggccggggaccccaagaaacagcgcccttctcagaccccggtacatcggggttcccaaaacccggccgcgttgaaacaggggtgccggataaagaacg

SEQ ID NO: 613399 - DNA, 283 bp, Homo sapiens
tatagtcacgtggtgtctatatctcccaatgtcagagtattactcctgcatagaactgactgcccgagtgcccatgtctttgatcttggactcagcggtgagcttttatggtgtgtgtgtgtgcatttgtgccccggtttttggaccatctttgttggtgcacgtgtggggtatgtgcatggggtgtgtgcaggtgtgtgtgtgcatgtgtgcccaggtgtttgagcatgtgcatcggtgcacgtgtggggtatgtgcattgggtgtgtgcacgtgtgtgtgt

SEQ ID NO: 613400 - DNA, 618 bp, Homo sapiens
cgcagtggctcatgcctgtaatcccagcactttgggaggccaaggagggcagatcaccaggtcaggagatcgagaccatcctggccaacatggtgaaaccccgtctctattaaaaatacaaaatttagctgggtgtggtggtgtgtgcctgtagtccgagctactcgggaggctgaggcaggagaatctcttgggcccaggaggcagaggttgtagtgagcggagatcaggccattgcactccagcctgggcaacgagcaaaattccatctcaaaagaaaaaaatgttcattttctaaatatataatttcttctacagtgtattaactagcatgctttggtaaagattttctattactttactattactataagctcatggatttttttaaagaatcaatatgtggtaatcaattatagctactgttcttggcttaggcattctgatgctcaatttgtctcaaatgtgactacatgggagctccttcaagatgactcttgtccctattgacatgatcccattaatctttatgttaaatcgtggtaaacaacaatacatctaacataaaattaccatcttaaccatttttaagtggacaattcagtaatgttacctatc

SEQ ID NO: 613401 - DNA, 276 bp, Homo sapiens
aaatataaacataaaatcagcccacactggtggcacctgcttgtatgtagtctcagctactcagaggctaagggaggaagatcgcttaagcccaggtcttcaaggctcagcaagctataatcacaccactgcactccagcctggggtacagagcaagaccctgtctctaaaataaatttttaaaacacacacacacacacacacacacacacacacacacacacatcccagtgcgtgcactctgctatagacccttcagcagttgcttgttccgct

SEQ ID NO: 613402 - DNA, 865 bp, Homo sapiens
gtggcctgtgccacgtgcgggcgcttcaggtgtgggtttggtcgaggcctctcatgtccctgtctcggggagctatgcgcgcctttgctggcctttcttgtggaataggacgccgttgcgcctccgtgcatggtgtgtgcggatctctgcctcgcttatgttggccccttcgtctacggcggcctgtaggtgtgccaatgtggccagccgttggaggtggggtttatatccccggccccgctgtgtcccgatttttgtcgaccgccgcccggccgtggcctccgcctgggagggggtttgagacgaggtgttggcgcgggggccacctttagtgaggccgcgctgtttttggagatgttttgagattgggccgcctagtttctccccactgctgagagcatcgcagggtcttggattcctcccgcccgccgctgccctttggtaatcgtcttgccccccgagaacctggtaggcgggggtgtcccccccggtgttgtcgcgcccccgcccccctcggcccctccttgggtggctgccgctccccccctggctccggtgcgtggtttccccccacagggggccctgtggagtatattgctcccagagcatagctcttagtctaggcccccccatcaggtcccccgcgcgccccatacaccgttgcttcttctagagcctctgattgtttccccccccttgctccagaacttggccccaattgttcaccacggttttaaatctaaggcccccactctgggtcaaaccaacaaccccgcccctagctcctcccgacagacgtgtgcccccctctcacacctatccttcctttctcccccttttataaattaaatttccccaacatgac

SEQ ID NO: 613403 - DNA, 182 bp, Homo sapiens
  misc_feature (46)..(46): n is a, c, g, or t
cggcacgagcatggcgcagtctattaacatcacggagctgaatctnccgcagctagaaatgctcaagaaccagctggaccaggaagtggagttcttgtccacgtccattgctcagctcaaagtggtacagaccaagtatgtggtaagtcaaggtatgttcgatacgagtcgtaacagggcta

SEQ ID NO: 613404 - DNA, 119 bp, Homo sapiens
aatcgagtggtaccgaatacggctctctgggggacagtcccagctgctatgtcgctgttgctgctactgacccgtgtcagcctgggacagacgtggtgccccagagcacatcagctatg

SEQ ID NO: 613405 - DNA, 872 bp, Homo sapiens
  misc_feature (6)..(6): n is a, c, g, or t
  misc_feature (124)..(124): n is a, c, g, or t
  misc_feature (163)..(163): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (195)..(195): n is a, c, g, or t
  misc_feature (228)..(228): n is a, c, g, or t
  misc_feature (248)..(248): n is a, c, g, or t
  misc_feature (251)..(251): n is a, c, g, or t
  misc_feature (276)..(276): n is a, c, g, or t
  misc_feature (280)..(280): n is a, c, g, or t
  misc_feature (289)..(289): n is a, c, g, or t
  misc_feature (295)..(295): n is a, c, g, or t
  misc_feature (302)..(302): n is a, c, g, or t
  misc_feature (305)..(306): n is a, c, g, or t
  misc_feature (313)..(313): n is a, c, g, or t
  misc_feature (337)..(337): n is a, c, g, or t
  misc_feature (355)..(355): n is a, c, g, or t
  misc_feature (357)..(357): n is a, c, g, or t
  misc_feature (438)..(438): n is a, c, g, or t
  misc_feature (450)..(450): n is a, c, g, or t
  misc_feature (465)..(465): n is a, c, g, or t
  misc_feature (503)..(503): n is a, c, g, or t
  misc_feature (549)..(549): n is a, c, g, or t
  misc_feature (553)..(553): n is a, c, g, or t
  misc_feature (574)..(574): n is a, c, g, or t
  misc_feature (605)..(605): n is a, c, g, or t
  misc_feature (612)..(612): n is a, c, g, or t
  misc_feature (681)..(681): n is a, c, g, or t
  misc_feature (761)..(761): n is a, c, g, or t
  misc_feature (784)..(784): n is a, c, g, or t
  misc_feature (811)..(811): n is a, c, g, or t
  misc_feature (840)..(840): n is a, c, g, or t
gctgcntatggaatactgttatgttaaacttcacttacaggatgttaaatccttagaactaaggtattccccccagaaaaagattaatggaaacatcaattgcttttcagacttgatagttgcngcttcaaaaggtggttttacacaaatactaaattaaaanaaaaaaaaaaaaccttttgtncncaangaatngcttttatttcggtatgcatccacatttcagcntttaggggtcctgaccagcnagnggcatgccgcagcaatttgccaggnggtnaagcccacnaatttngggggtntgnngtgcacnccgggttccttcttaatccctgcngaggatcttgggaagcancngcggccccaaaaccaaggcatgccccggattcaaggttctttttgttccagttgtcagattccaaactagaccccaatggnttgcaagggtgnccaaatgaaagcccngtttaaaacttcttcaatttttaaaagcaaaagcagtnacaggaaagtaaaacaattcagagggatcatgtgtgcttacaagtntctncatgcggtctttctccaagtncaaccaccaaggactccgagagctggcaggnctgagtnaccctggtgactattcttttcaccttatcaaaacctgagctaaaaacaatgcatcagctgatgacagcngagggtggcagggctgaggacccaatattcatttcccaggctggtggagagttagtcagtatggttccaaaactaaacangggaggtcagaggctctttccanccttcctgatggcttctggcaaagcangaagtgtcaaggaaggtgttgggtggtgnggtgcaaaaggacttgagggggggggaaaagc

SEQ ID NO: 613406 - DNA, 352 bp, Homo sapiens
aaaaaaaaagggccccctttttttctttttaattttttttccccctttgggaagcccccaaccggggccacccgggttttaaaaaaaaaaaaaaaaatggagggggtttttttccccctttaacctcgccagggggggtgggggaatccgggagacccaggttgttctcccccccaaagaggagggggaatggggatttgttttccccccccccaaagaattccccctttttttttttttttccttttgaaccccccccggttccccgggggccccggaaattttttttccccaaatgggaaagggcgggttgatatttttaaagggtaaaaaatttgggatttttgctgga

SEQ ID NO: 613407 - DNA, 87 bp, Homo sapiens
  misc_feature (63)..(63): n is a, c, g, or t
  misc_feature (78)..(78): n is a, c, g, or t
tgaggaaggacaaatgacttgtgaaccatgcccaagaacagggaaagtcttgggccctgaagnacccagaaggttggnataagtctg

SEQ ID NO: 613408 - DNA, 737 bp, Homo sapiens
ggatactgtatttccccatggcttcctcctcgcgttgtgatgcaggtgaagacattcagtgaagcttgcctgatggtaaggaaatcagtcctagaacttctgtattacgtgaaaaaaagctaggtttgcgttatccaggcgtatacagatatcttctgtatgggagagaagggaatcgtggaagaatatccggtaagtctttgccatgtttattcaatttctgtggaaaacaggatctgggttgatagtacaattatgtccagatgcctcaatctttgggtgagaaattgtcgggatctctctgcagtgcaactagcagtagtacagagctttgatcaaacttatagaaggttcaaactggttgaatggaagtattcaaaactacaagatgatgcagcgtgtccctgaagccagaataaaagtgtcacagagaagtagtgtctggaagtaagagagaaagcaactgagaaagggagtcctctgggaaaagtggtatgaacagggtaataacacggatgaggaaagccaatgagatgcagttggaagttgtgcgtgaacagagctaaagaggcaaagtgcattgtgggtatgtccaggcttcgtagtgggcgtgtgatgggaatcaattgctccgttggggaagaaacaattctgtgaatggagaagataaaagcgcgattggtgccacgaggaattagcacgttgttaaaacttgaggaaagtgatgaaaatgattg

SEQ ID NO: 613409 - DNA, 320 bp, Homo sapiens
tagaagcagtaacaccaaaaacaacaggttcatgtcataggcgttttgcagtcatcaactatcaccatccatttcccacatccagtctttgccctccatgcaagcacatccctcagcaggcaagcatccaggcaaacatcaagtcattttcccagttattgcttgcacagtttctcaaacacaaccaaacataacactccacatgcacacaggcccagcatgtttcttttacagctagcagcatgcacagcattgcttctctggtattcaacatcagtttcatgctggtggaggcatcctctcagcagtctgcacctgcc

SEQ ID NO: 613410 - DNA, 704 bp, Homo sapiens
  misc_feature (9)..(9): n is a, c, g, or t
  misc_feature (103)..(103): n is a, c, g, or t
  misc_feature (161)..(161): n is a, c, g, or t
tccgctgcntcaccatgtgtcactctcgcagctgccacccgaccatgaccatcctgcaggccccgaccccggccccctccaccatcccgggaccccggcgggnctccggtcctgagatcttcaccttcgaccctctcccggagcccgcagcggcccctgcnggcgccccagctcgttcgcgggcaccgaaagcgcagcgcaggttctctaccctcgagtggtccggcgccagtgccagtcgaggaaccgaacccagccaaaaggcttctctttctgcgtgctcaccatcgtcttcgtgccagatcctgatggctgaagagggtgtgccggcgccctttgcctccagaggaagcgcccctaagcgccggcatcccctgggtgcacccaccccgtgtggtccccgcgtccttcgaagcccttaaaagtctggacttacggagccctcggagtacgctcgtggacctcagcactttcctccagcaacacccgggccgcctttctaacgtgtgactccccgcgaatctccccaaaaaagaatccgaaaaaccacaaagaaacaccaggcgtacctggtgcgcgagagcgtatccccaagtgggacttccgaggcaattgaactcagaacactacagccggagacgccacccggtgcttgaggcgggaccgaggcgcacagagaccgaggcgcatagagaccgaggcac

SEQ ID NO: 613411 - DNA, 595 bp, Homo sapiens
taggatacataaggtttattgaaatgcttgtggagacagttcttactctgttgaccagtctggagtgcagaagaggaattattttccactgaaaatgaaaagaagtggggcaaggccattctcctgttgaaaaaacagaatagctgtgagtacagatgagggccgccacaccaggatattttttatttaacggagagataggggtattgattctgtgcgcatgctgggatgagatgtcggggttcaagaaaaattgccaccttgttttacgaaagtgttgggatagcgggcatgaccaatggagaccgcccggggtgacaagttatctgacatatgggttggtaatcagcactacgaaaaaaagctggtgaattacataactctcagtttagtacgaaagatgtgaccatccgtgtggcacttggttatttcacaaacttatgcacttagactaactctgttgactttaggcttatcagagttaatgagggacatactgagcttgttgtcggtttagtatgaggggaacgagtatacaggaacaatggcaaaggtgaggcgtagaagagatttctttggtcataccagaaaagaa

SEQ ID NO: 613412 - DNA, 534 bp, Homo sapiens
actggagtaaggctggctttgtcagtccggctcccccaggttgagagccacggctgagcaagagggtgcagtggcgcagccctttcaaccagtgccaccacctccagcctggcaatctgggctcccgagctccctgatgggcaggtggcggcgactgtcagacccacatctccatctgcttccgccctttacttttcactagtggtggcgactgtcagacccacatctccatctgcttctgccctttacttttcactggtggcggcgactctgtcagagccatatctccatctgcttccgccctttacttttcagtggtggcggcgaatctgtcagacccatatctccatctgcttccgccctttactttacactcgtggcggcgactctgtgagacccatatgtccatctgcttccgccctttacttcacactggtggcggcgactatcagacccatatctccatctgctcgcgccctttacttttcactggtggcggcgagtgtcagaaccacatctccatctgctcccgcc

SEQ ID NO: 613413 - DNA, 313 bp, Homo sapiens
gggaaccccggggggggagggcgggttttttaaattttttttaggggaatttttcccctttgatctcccggggggttcccccgggcccgggggtggggggggcccccggtttgggaattttttttgttttaaaaacccccttttttgaattaaagggacccttggggttttttaaggggggggggggggcccccccccccctccccctgggggtgggggcggggtttttttttcttttttcccccccccctttggggggggggggggcccgttgggaaacccccctttttttttttaaggggggtttccccca

SEQ ID NO: 613414 - DNA, 231 bp, Homo sapiens
tacgtctcgatcgttagaatctgaaataccaaaaataaataaagaggctggcttgtatatatagtcgaagacttttctaaactagaaaaatcttttatgtgtctcaactaccttatatcttctgaagaatgacaacatgcattctactatgggagaggttgtgggagaggtcgttacctttgaaatcccgtcctgcatctcatttcttggatcaaatgttccgtcatcata

SEQ ID NO: 613415 - DNA, 917 bp, Homo sapiens
  misc_feature (27)..(27): n is a, c, g, or t
  misc_feature (79)..(79): n is a, c, g, or t
ccccaagccgcctcaaaagcaaaaaanaaaaacctcgttgggttacgcgcaccggacttttgacggtgtacctatctgngtatctgcccttctccttgggatactatggaataaaaaaagtgatcattgtctacgttgaaagcctcctgccgtgttcaaacgttatccatgcccggaaagattctcgtccatccctcagactacttcattagtcacaggccggatctgaaggactcctataccacatagacgcacattgagcgattttttttgcaaatgggaactgactcattaagaatattgcagacaccgacggatcgcctctcattgcaggtaacaaaccctcctagttatttgaaaggcccctcgccgtacagcaattatcacacgctaggaccaaaaggtcccccacacgtcctggcaatcagatgcttcactcacacacccccactgccgaccacgcacctcacccctcccatcaccaataacacccgcaccctcacgcacaccccttgtcccccgacctgaactatccacgcacatatatacatccgcgccgcccaactcgacactccgcgctccgaaacccaaccttaagccaagaccgattttgcgtcccagcgactagcactgcacctcccatacaacatcctcatcactgaccaatccgctacgcggcgcccccaaccatggatgactcactccccggtctcacctcgctactccgcccccccccatattacacatacccgcacaccgtcctgacgcaccccccgctcccgccgctccgtcaccccacccacccaccaccgctcccattagactcatactctcattatccccgcctcatatccttcccactgacatctccctcgcccacacgccatctcctgctattttatacctcggtgccgatg

SEQ ID NO: 613416 - DNA, 216 bp, Homo sapiens
gttgagagctacaccttcttcatagacatcctgctcgagaaaatcagtgctgagatctcggggtgcctcgagaatgcctacgagaaaatccttttcagtgaggccacccggatcctcttcttcaacacacccgaaaaggtgacagactacgccaagaagcgagggtgggtcctgggccccaacaactactacagtattagctcagcgctggaacca

SEQ ID NO: 613417 - DNA, 250 bp, Homo sapiens
ctatggggacgggctgttcatctacttcaggaatcagaaaggtgaggagccttaggtcagtggctctctccatacgcttattctggaggaggaactatggcttagctgaggttagttctcagtatatgaatggccctggataaagcttttctattcccaaactgacctccaatgttctgcacttccagacaatcatcagggcactggttgctctgtcaaacgcataactagcttgtggccatacagagac

SEQ ID NO: 613418 - DNA, 183 bp, Homo sapiens
  misc_feature (49)..(49): n is a, c, g, or t
  misc_feature (154)..(154): n is a, c, g, or t
ggcttttttcctcccctttccgtggagagactatcaactccatctgtcncaaaaattaaggctaaatctcctatcaaaaaaaaatggtccgtggggctttgacgcgctcagcgtcgggctgtctgcctctccctagcggccaagtgaatttganatggcccccgtcacagccggaggcccagc

SEQ ID NO: 613419 - DNA, 125 bp, Homo sapiens
gaaagccatattatctggagaaaatcattttaaataccatcattcaacaaattatgttcagaaagtggtcagaacttcaagcaagatgaagtaacagaaagaatgcagaattgtggatgcaatgc

SEQ ID NO: 613420 - DNA, 476 bp, Homo sapiens
cagggttttatagcctcttgctgagtatttctcatctcttgctaagtatttctactgtggtgcaaaagcaatcttattatgtgttgctgtatttttatagtcaattgaaatgactattaaaatataacattgctcatcaggctcagagcagcactgctggagaggcctgcccttgcagatgaggcagctgagtcctggaaagagaggccttcttgggaatcacagccgatgcaggggcctgaggcctgggctgctatgtaggaccctccacaacctcagaacagtcctgggctctgctgtcacatcttgaaatgtttttttctattttctttattgtggcaagatatatataacctaaaatttcccatttgaaccatttttaggtgtacagttcagtggcgttaaacacactgacgttgttgggcaaccatcaccaccatccattgccagaactcttttcttcttcctgaagacag

SEQ ID NO: 613421 - DNA, 133 bp, Homo sapiens
gacagccagaggagggtgacagctgacagcacagaggagatgacagcacagaggaggtggaaggcccgcttcggcatgagtcgcagcctaatcgagaggagccattaggtggctatctgctccacactcacat

SEQ ID NO: 613422 - DNA, 935 bp, Homo sapiens
ggcacgcaccgcctcttccgcttctgtggtctgatcttcctgcgtgtgaaccgcccggctgagccgactttgccggcgtctgtgggattcgggcccagagaagctccgaattcggctacacgcatgggtggcctacttggagacaaggctgggacctcagctacaatccggatactcccaagatctggtgcaaaaagcagtgacgagatgcacgtgaagaacagaatttcaaaggcaaattggctgagaagaatttctgggacagcaagcgtacaaaattggtgacaaggtaaaagcaacggaaataagtctaaccgctgaactaaaggtctgggaacaatggctaacattttcccaaagggttgaacagattgctgtggggccaccattgctacatggggcagaactgggaccaacagagaattcttcaattatccaatgggcgcacacaaacaacacaaaaatctcctctgctcatctgggtcccaacatcacaacctgtgtggcacaaagtgaggccaaacaccaacaaacgttcggacacaaatcaggggggtacacactgtggcccaaaacatacaacacacaaacacaaccacgcacaacataacaaaacaccacaccaacagtgatattcacacaccccacacactatcgacccacacacacaaaacaaaaagtataactaagaaaacaaaacccacaattccgcagtagttgcgagaaacacagccgagagaccacaccacaacaacgagcaaacaagagaagaacacacctggcgacacaaacaaacaagaccgcggcattcaccaccaaaaaggagagaaaacaactcacgggagcaacaagcacacaaacaagcgcggcacagcagggaacaaacacaccacaacacaaaacataaaacaaacaacacagcaccgccagaggag

SEQ ID NO: 613423 - DNA, 551 bp, Homo sapiens
gtatgctgctgcctgctgacgcctgtacctgctgctgtgccgtggtgtgattgtgtgccgtgggtctccagcgtctgacctgatgggtgagctgggctccgctcgggcctgctttttgctgacctgtgcctgtcatgccccagcgtctgcctggcctggaggggcgaagaggacgaggtgggccaatggcttcctccggggacattggctccctggattatcaatgagtttgtagtttgacatttgaatccatggctgacggactggaaaggtgttggaacttagaagcaacgcaatggcaagatgaagattttaccgatacctttaccagaagatgatagtattgaagcagatatactagctataactggaccagaggaccagcctggctcactagaagttaatggaacataacagtgagaaagaagcctaatggctccagacattagcctgacactggatcctagtgatggctctgtattgtcacgatgatctggatgacatgtggggagattgaccttagatggcttagacacaccgtccgagaactc

SEQ ID NO: 613424 - DNA, 276 bp, Homo sapiens
  misc_feature (87)..(87): n is a, c, g, or t
tatattcatgggagattggaaagatgtgtgaggagaaggtctagtctaagtgattatccttcctcgtacggattcaggtattgaggnggcactcttctgtaattcatgtttttctctcctaacctcactcctgttggctgcatcttcttgctgagcaaaatattcaaggtcttcaactcctcacaccctggttgtccctccctggatgtgtttggttgttttagtgttccatttcaattttgatacacagaattagaatagcatccagatgtggat

SEQ ID NO: 613425 - DNA, 177 bp, Homo sapiens
gagctagataaggcgtgtctacatgcctgtctatttttttattttagagacaggtccgctctattgcctggtggaatgcagtggtgtgatcacagctcactgcagcctcgaactactggactcaaaggatcctactgcctcagcctcctgagtagctaggaccataggcatgctccg

SEQ ID NO: 613426 - DNA, 395 bp, Homo sapiens
ccggctcgttcgggtagagctgttgtgactaccccatggcctaagaactggtatttcaggcccttcgatctgccctgttatacctatcttctgtctgcctgctcctgggaggtgtctgtggccggatggacaataaaaaaaatggagagatgcccctcaggagcttggaaatcagtggggaacatcacctcctttcgtggtatactgatttatctgacatatccaaacaggtattgatcctgagaccccaggcaggcccttcttagcagcagtgctgtcggccagcgtcaagcttcgccatcatgctccttcacaacaagactcaatacctccaaagtaaccttactaacaacaaatcaatacttcctccaagacgaactcagacttgcttattt

SEQ ID NO: 613427 - DNA, 390 bp, Homo sapiens
ctgccctagcctcctgagtagctgggaccacaggtgtgtgcaaccatgcccggctaaatttttaaaatgtttagtagagttgggggggggggggtccccctgtgttgcctagcgtggtcttgagctcctggcctgaagccaccattccaccccagtctcccaaagttgtgggtttacgggtataagcccctgtgcgcggcctcagttgtgaccttccatctatggtctaaacctctcaagatatccagatgtgtcgttctttggccaatacccttttccctggagtcatctgatctgcccctctcttaggtgctggtctacattcccggaatccactttccctttttggattcacttcatcctgaatggttcctccaagaattcccttga

SEQ ID NO: 613428 - DNA, 197 bp, Homo sapiens
tccctggaatctgggcagggatcagagggctgctggacacaacaaatgaagcagctttaaggatcggacactcacacgctgtgctggttgcaaaatgccagggacaacaaccactggacagatctggtgctgctgaacacgggcttcctctgtggatgtgacttgggtttcctcacagtgcatacaggggctcaatg

SEQ ID NO: 613429 - DNA, 167 bp, Homo sapiens
acgatcaccgccctcattaacgtgttaatttctctttttttattttttcacacggaaaaaaactttatccccccattcgtgaggttgcccgaaaaagtgtttaaaaaattccccggctcccccccccgcatatacactcttctccatctcacagtttttgagacaac

SEQ ID NO: 613430 - DNA, 345 bp, Homo sapiens
gcatgcacctgtagtcctagctaatcgggaggcacaagaattgcttgaacccgggaagcagaggctgcagtgagctgaaatcgtgccactgcactccagcctgggtgacaaagtaagactgcatttcaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaagaattattgctggaataacataaaaaaaaaaaagtcgacg

SEQ ID NO: 613431 - DNA, 121 bp, Homo sapiens
gagtatagtctctgaggctcctatcacagctctgcctgcaaccacgatgctttgacagtaacaccttctctctacaacctatgaagctggacaacggatgctataacaactgatgtagttc

SEQ ID NO: 613432 - DNA, 282 bp, Homo sapiens
  misc_feature (186)..(186): n is a, c, g, or t
gatacccatgcggggtaggcagaaaatcgcaatcgtcggtgcaggtctgggtggggcagccgccgccacgttgctgcagcaggccgggttcgatgtcgaggtgttcgagcaggcgccagagttcacccgcctgggggcgggcattcatatcggccctaacgtgatgaagatcttccgccgcatggngccttgagcagaaactggaactgatgggctcgcacccggacttcttggtcagccgcgatggccacagcggcgattatctgtcgcgcatcccgttgg

SEQ ID NO: 613433 - DNA, 399 bp, Homo sapiens
acgacgtgttaatgtctacgcatagcatgtatccccctggcagtgcgagtctgtagttgtcgagaatgtgagtggcatacaagccagtattgtcacacagctggcgtgcgataatctccaagggcttggcgtatgcgccaatcaacaggtgctgttttcctggaatagtccttgagtaatcccgcaggtacttggagagttccatctcaattggcccgtgattagccacccagtgagtcattcttgatggccctcctgtaggatcatgatcgggatcatgccaggaaccgctctgtgtcctccataaagtggtcggggccgccaaggagaaatgaaggtgcattgtcttggctttaggggaggcacgtaacaaaattgtaccttttggcgccccaattt

SEQ ID NO: 613434 - DNA, 140 bp, Homo sapiens
tggaaagggagttttgcttttgttcccaagtcgggagggcaagggcacgatttcagcttacaaaaacttcggcttccaaggttaaggggattctcctgcctaagcctccaaagtatttgttggggaagccggtacccggc

SEQ ID NO: 613435 - DNA, 374 bp, Homo sapiens
  misc_feature (24)..(24): n is a, c, g, or t
tgggtggaggcaggccccgagctnggggaaggggttttcccttcctttttgacccagatttgggggcggcctagcccgggcctcattttttatccccgccaagggtttcctttcagtcatttgtttaccagaaacatgaaaactgcctgtttggccgggccgcacttgtggcccccgggaccccacctttggccccacctccctcaagtttgggccccgtccccagccagacccacttgctgccgggaccctttcactgccccggtggagtgaataaaggatgaggggccctgaccctgtgtttccaactggtgcaccccatcccgaccctgtttccgcccccttgcagccccattaaagggctttcatttgga

SEQ ID NO: 613436 - DNA, 165 bp, Homo sapiens
  misc_feature (32)..(32): n is a, c, g, or t
  misc_feature (53)..(53): n is a, c, g, or t
gtcccgcgactcaatagaagaatgctaatgcntcaggatacaaatattatttngtaattttcttaagtatggtacctaaggaaattttcttcttccaggggaaaaaaagagtatgtttaaaaagtagctttaaaacataactgaaaacttactgaagtgtcaacg

SEQ ID NO: 613437 - DNA, 286 bp, Homo sapiens
aaagaagagcgccaaaaacacctcaataaccagtatatgcagagaatggcagtgttcgagctggaccaaaccctgtaatcaaaccctacaagccagcacctcctacaggttacttcatggcagctatccaacagactcagaaccgtgctgcattatatcctcctagccaaatatgtaaaataagaccaagtcctcgctggacaggtcagggtgccagacctcatccattccaaaatatagccggtactatccgaccagttggtcctagaccaccctactcttacga

SEQ ID NO: 613438 - DNA, 316 bp, Homo sapiens
acgtgtgcagtgtgtctgctgacaacgagtggtgtgccctgagtgcatcttttgaacgattctgtgatctcacactcaggagaccattgcatcattgggcgcacattggtggttcatgacaaatgcagactacttgggcaaaggtggcaatgaagacagtacaaagacaggaaacgctggaagtcgttgggctcgtggtgtacttgggatcgcccaataaacattcccttggatgtagtctgaggccccttaactcatctgtgatcctgctagctgtagaaatgtatcctgataaacattgcaacacggtctctca

SEQ ID NO: 613439 - DNA, 177 bp, Homo sapiens
ccccccttccaatgggccggtggggttcttgttttcattgcattggttaaaccaaccggcaagcttcggtgccccaccccaccaagcaggcattcattaagtccattcctttaacccaagcttaatggggtggttttttcccaaaataacgaattaaagtgtttttctgggccctaa

SEQ ID NO: 613440 - DNA, 1787 bp, Homo sapiens
  misc_feature (444)..(444): n is a, c, g, or t
  misc_feature (1385)..(1385): n is a, c, g, or t
tgaaaccaaatccccagacttttttttatgcccaaataacccttcccacccaaaaacagaagtgaatttaaaaactccaccacaacttctcctgtggaggccacgctagtgtgtctccggtgttactctcggacacgaggaagagggtggaacaaggtgggtgtagaggggcgtgggctccacgaggaattagaggccacaagaagagcttccaccacacaagagggacgcctagaggatagagacagagagaacacagacgagagagaaagaagagagggtcttatacaacagagagagacaagaagacagaggcgttagagacacaccactttagagagagggacacacacacgcagagagagagacgccactccctcgcagggcgacagagaggtgtagcctgtgtgactactctcgagatatctccatgtgtgctgcgcngcgcgtgtagttgtgttcccacgatgatgctcccaacgagatgatgtctccccccgcgaagggcgctctctcctccaatgtgtgtagtgtcttcacgagctgtggggcgccccgtgtgcctcacgagaagaaggggcacagaaatgttctgtgacccccccgaggtgcagagtgtagagcgtagtgttctcccgtgtgcgagagagaggacacccccgccgtggtgcctctgtgttgtgcccacccactatgtgtgtgatgacacagcgcgagtgcgtgccccccagaagtgtgtggcgcgtctccccgtgagcacctctctttctctcacgcgaggtaaaaccccggcctatattcaaacacaccagattgttggcgtcgccatctcccccatgtggtgatgcgcccccccccacaaaaaaagtagaagagtagagggtaggtgttcgctggccacgcaaaaagtaggtgcggccccccccccgacgtcaccaagcaggcccacacaaaaaagtacatgtatttctcccacaagcagaactgcatgaggagaagcgctcagagagaaaacagcatcctccacccatatatttcatatatacaacaaaatactattagtaaggaggagggtcacatcatcgctgataagaagacaacgtactttcccatatgatgtgagcgccccattgtaggtaccgcccccatcttatttattccgaacacgacccaccacacttgttgtttggtggcgcgccccgcaacgtgttgggccccctactattaccatcctactactgcctgtatgggagaaagatctccattacaagcagagaaagcgagcaaccacatataggaaaaggaggaaggcgcagccactacccaatacatcccaaacagtgatgagggagaataaagaccgacaattaaaaggagagccagancgcctcccctcactaaaaattgtgtgcttccccaacgtgatgaaagacgaatagaggcctctttagtgcgaccggaggaaaaaacacacagtgccactaaaggaaagcgacgagaaacagagagcgtgaactatagacaaaaagacggaatataacagccccactcctatcaaccaacgagggggatgattaaacctaccaagtgagagccccccgatcctgcttgtagataatataaaaaacgccccacaacaacgcaacgacttgagacacacagttggaggagcccacatcgaataaggccccccgtggatgtaaatatagaatgaccaccaacacccctatagtagggagcggcgaccaatagagagagaatatatacgacggcgacaaacactactt

SEQ ID NO: 613441 - DNA, 401 bp, Homo sapiens
  misc_feature (101)..(101): n is a, c, g, or t
gccgcatgtgtaccccacaaatgtcgcacccgaacatagcatcagaggtgtcaacgtcttctccactccatctgcaacaagaagcaatgacaaatttcatntgacatgttgagattcaagagtgagtttaccgtagcatttcaaccagcacgcagagttgggccctcttgaatctttcaagaaaaaacaaaatgaaaagagagaatatttgagtgagacattttcaaatctgagcccaaagcagttattctgcatttactttttgttgagttgtaaaatataagaggatattaaatagttctatgtctaaattacccttttattactttttatcattcttccttagaagcaaggtatatattacacattgacaattttattaaaatgcagattttaatata

SEQ ID NO: 613442 - DNA, 699 bp, Homo sapiens
  misc_feature (70)..(70): n is a, c, g, or t
  misc_feature (185)..(185): n is a, c, g, or t
  misc_feature (637)..(637): n is a, c, g, or t
ggcttctgggagccccattcaaatccaacagggtgaaagctggcattaggatgcacgcaaattttttccnagtggaggccgcctcccagcgggccaagcaggacatgcccgggcaaattgcgtgagtacagaaattttatgacgcaaggttgggcctggacatgagatcgcccccctacagaaantcttttgaagggcgagaaaaagcgggctggagtttgggatgcagaacatgagtatttatacgaagacccccagcgggctatgcaggtggtttgagctcggcctatgggggcctcacaagcccgggcctcaattacagcttgggttccaactttggttttgggggggggtcaagttccttaaaccgcaccagttcctccagggccgtggttgtaaaaaaaatcaaaacacgtgatgggaaggtggtgtttgagtcctttcacgtcctgcccaagtgaacaattgggggagccccttcaaagcctacccctcctggggttgccccaaagcttggaaaggaggcccttattcagggtagccttgggaacaggaaaccccctttggggtcagccctagccctcagcccccttggggggttttttacttggggaccccccttgcccatgcccccagntacaaaaaaattcaattgttttttttttttgggccaaaataaaaccccagctagttttgcca

SEQ ID NO: 613443 - DNA, 714 bp, Homo sapiens
cgagaggagagaaaaaaatacacaaacggtggggtgagcatacagtggggagagacaaccgcggttgcgatgagaccacacacagaagagtgcactccgcgcagcagagagagccgcccagcacagaagaataaaagagagcagcaaatagagcagagaaaagagaacagtagtgagagaccatacaatagcgtacagcagagagtgcaaaatatacaacactacatcatcgtcctctctcatgatagaagagaagagacaaaagcagcgataacagggctataacacaccccccacataagagagagggggagacccacagacaagagagatgacatacaggaggagccccccactgccctgtgagaagcgcatcacctcacaagaagtctcatcacgaggcgcgcacacacattgggacgccccccacactgggcagagagagagacaatatgtgagagagagaatgagaggagccaaacacgagatatgtgaaaagatatgatagaatagttgatctcccagcaggagtctttttaccaaaaagaaggtaaagaggagcatcaccactcgccggatggctccactcccatatgtcgtgcgcggcgctgatcatatagcagaggcaaggacaagaaaaacacactcatctagacgccgccccagacttgcggaagaacattaaccgcccccatcagttgatacaggaagaag

SEQ ID NO: 613444 - DNA, 324 bp, Homo sapiens
atatcacaggtcagagccagcatcttggctgtcttgccaaaacctgcatacgtttttctactgtgatttgtatgaaaggtcacatcaaatcaacggaatagattcagtaaagtcagtcgtgttcagtaagatgatgtatttcaatttgtactagggaaggttgatgagaacaaagtgggaaaacttgtgaacattgcccagattgtggacatagggtttttaccacaattgtaggtcttaccttatgcttgagcttttagtgatgttcttgtgtccatgtgttttactgggtgattttttctatagtagggatattcttggtgt

SEQ ID NO: 613445 - DNA, 306 bp, Homo sapiens
  misc_feature (98)..(98): n is a, c, g, or t
catcttccaagacaattctatattgaataacacatacctgtaccactgattaaaagctggggttaccaatgcgcgtggcacagttagaagcttatgtncaaaaatgagcacatcctggaagggcccgggaaaaggtctcctgggcagcgcggagagggagctctgaggctgtgcggcagcggtcttgccgccgtccccctggtcgctcccggaattaacgcgcgcacgcgtcggagcatggccccgtcccgaccccgtttggcggctcaccctcgcagcgcggcacagcacgcgtgctcgcggcag

SEQ ID NO: 613446 - DNA, 187 bp, Homo sapiens
tcatgagagtaatgggaatgaggcagaactgtcaatgcaaatgaacttgcctaaatgctgataagaatggcatgttatccagtcatttccatggagtaaagtggcctcttgggacacatggaagctgccaactgagagacatgcatgctggttgtagacacacatgtgccatgatgtggaacgccat

SEQ ID NO: 613447 - DNA, 894 bp, Homo sapiens
  misc_feature (289)..(289): n is a, c, g, or t
  misc_feature (296)..(296): n is a, c, g, or t
  misc_feature (340)..(340): n is a, c, g, or t
  misc_feature (349)..(349): n is a, c, g, or t
  misc_feature (501)..(501): n is a, c, g, or t
  misc_feature (504)..(504): n is a, c, g, or t
  misc_feature (514)..(514): n is a, c, g, or t
  misc_feature (517)..(517): n is a, c, g, or t
  misc_feature (549)..(549): n is a, c, g, or t
  misc_feature (553)..(553): n is a, c, g, or t
  misc_feature (586)..(586): n is a, c, g, or t
  misc_feature (732)..(732): n is a, c, g, or t
  misc_feature (865)..(865): n is a, c, g, or t
ggctgggtcctgcaggtcttggggctcgggactcttcctggagacagcgcatggcgggctatcccgcgggtcgcgcgcgcactgtcgccgcctgctggcgtcgacgctgttggcgctgctcgtgtcgcccgcgcggggtcgcggcggcgggaccacggggactgggacgaggcctcccggctgccggcgctaccaccccgcgaggacgcggcgcgcgtggcccgcttcgtgacgcacgtctccgactggggcgctctggccaccatctccacgctggaggcggtgcgcnggccggnccttcgccgacgtcctctcgctcagcgacgggcccccgggcgcnggcagcggngtgccctatttctacctgagcccgctgcagctctccgtgagcaacctgcaggagaatccatatgctacacttgaccatgactttggcacagaccaactttctgcaagaaacatggacttgaaccacaaagtcccctttgtggtccacaaaangcngtcaggaacngtnaccaaggtgaatgaaacagaaatggatattgnaaancatcgttatcattcgacaccctgagatgaaaanctggccttccagccataattggttctttgctaagttgaatataaccaatatctgggtcctggactactttggtggaccaaaaatcgtgacaccagaagaatattataatgtcacagttcagtgaagcagactgtggtgaatttagnaacacttatgaagtttcttaaagtggctcatacacacttaaaaggcttaatgtttctctggaaagcgtcccagaatattagccagttttctgtcacatgctggtttgtttgcttgcttgtttacttgcttgtntaccaatagagttgacgtgttattggatt

SEQ ID NO: 613448 - DNA, 382 bp, Homo sapiens
tatataggtcgcaggagagaccaaatgagatttatccgtggttgctggaaactattatattctgtctaatgtaacgatggtctgttccagtgaggtagggatataaagtgattaagctaagtattaatcggcaaaaatagtccttcgttaacttagatatgacatagctggatagaggaagatctggtatgctaggaattactaaagaagaataatacaacgtagaatgtctgctttcactaattcatgtaccggaaggaggagaataatgaagatatactcagtagagtactaggtgggcggatatggaactttgctcagaaaatctcttataaaacgtgcatataacaaaatgacacccagtaggcctgcgaacctatga

SEQ ID NO: 613449 - DNA, 424 bp, Homo sapiens
  misc_feature (12)..(12): n is a, c, g, or t
  misc_feature (33)..(33): n is a, c, g, or t
  misc_feature (182)..(182): n is a, c, g, or t
  misc_feature (271)..(271): n is a, c, g, or t
  misc_feature (274)..(274): n is a, c, g, or t
  misc_feature (300)..(300): n is a, c, g, or t
  misc_feature (306)..(306): n is a, c, g, or t
  misc_feature (350)..(350): n is a, c, g, or t
  misc_feature (411)..(411): n is a, c, g, or t
ggggggttaaantccggaaatttaaaaagcccnttttggaaattaaaattccgggaaaaattttcccgggccggggggcccccggcgggtttcccggaaacccaaaccggggggccctttggcccggaaagggaaaaaaggaaaccgggaacccaagggaaaaagggggggggggggaaagnccttttcccccgggccgggccgggggttgggggcccttttccaaaccttcccttcccccttgggtttaaaaaaaaaaccgggcccttanagnaaagccccgggggccggaaagttttngttttnaaccccttgggccgggttcccctttccttggaaaccccttgaangaaagcccgaaaaagggggggagccgggccgaagattggaaccttgaacccgctcacccantcccatagcccgc

SEQ ID NO: 613450 - DNA, 134 bp, Homo sapiens
atacagcaacagcactgaacctgggaagagattaaactctgaatttatctttgataacaggtattgattttaaaatgtacatgtattaaattacatatgtaatataaggtctgtttgctgctactgtgtgatgg

SEQ ID NO: 613451 - DNA, 678 bp, Homo sapiens
gatgggttttgtggcattttaacatttacctttccataggaaacaaattgagattattaggggggcttggattaaacacatttgaatgtcagaacaagaatttcccccgagggcctctctctattttttgtgaaaaacccgccgccaggggtagaggggaaggcgccccttttttgttgtctggtccgccaaaagaacagcgcgtggtaaatttgcacacccatgatattgtcgacaagttagtggacaatgtagacaacaggtctacaggttttgctttaccaagaatgtcccccaagggtacctatggtctaaagagcaaacttgatcatctgggcatccctaaggtctgcatcgatgtggccgacctatccaaggtcaaaaatgaggcccacatgaatatcgtccagtctgtgcatatgagtgtgctgaacaactcagagaaagtgatttaagctgttggggccatgtgttttagaggccaaacacatgtcaatccccggcgaggtggagttgaacaaacgctgtgttgttttaatcattgaagcacatttcgagtgtcccattgtcatggggcaagtggtgaatgcctcctatatgataattgcttcttgctccaaaaggcgtcacctccatccctgaggcctccgtggatgccattaaacaaaggttgagctg

SEQ ID NO: 613452 - DNA, 350 bp, Homo sapiens
  misc_feature (1)..(2): n is a, c, g, or t
  misc_feature (5)..(5): n is a, c, g, or t
nntanacgatccccttcgcggtatcataaatagatatggtaaactaaaggattcttcatatctatccctgaatggtgcatgatggcccaggatggcatcactattcgtaccagactgcaatttaaatcttatcaatgatttctggaattttccatatagtatgtcaggactgtagtagactgtgggtaactgaaatagctgaatgtatatccttgtgtcccggaaaaccgctgtacttgtctgtgaattctaacagcttactgatctgaatacagccatcatctcctttgatatgagaaaattttctcctacaaacacatgtatcattctatatcctgatgtctgtttgt

SEQ ID NO: 613453 - DNA, 316 bp, Homo sapiens
  misc_feature (82)..(82): n is a, c, g, or t
  misc_feature (117)..(117): n is a, c, g, or t
  misc_feature (127)..(127): n is a, c, g, or t
  misc_feature (238)..(238): n is a, c, g, or t
  misc_feature (249)..(249): n is a, c, g, or t
  misc_feature (266)..(266): n is a, c, g, or t
  misc_feature (276)..(276): n is a, c, g, or t
  misc_feature (313)..(313): n is a, c, g, or t
ctgaccaggccctggctccaagcgaccacccctccccctcctgcctggacccagggagcaggtgcagggggctccgagcctngggtgactgtcaccgtgcagtgcgccttcacagtngccctgaggnacgaagaggagccgacctgtccagcctgcgggcactgctgggccaagccttccctcaccagggcccagcttgggaaacttcaggtggggccagaaagcccccggttggttncggttggagtngggcaccgcccgaattnagggcagttncttggaagagggggttggcagaggttcattttccttncct

SEQ ID NO: 613454 - DNA, 586 bp, Homo sapiens
ttttgcctggggtgtcaaaaggcccaccgccaaggcctgggtgcccaggtaatcaaaaagaagctaaggtgaagtttcgcaccaggctttgaggtccggggaaagctagaaactaatttggccctgaacatgccacagcagaaaaaggaggaaaaagcccggctcctcattggtttaagtgtgggcgccaaaaaccctggcaaaaagtccatttttggcgggggcaaattatttggcgattcgagtggctccagcacaggattttactttggctcaggctccagggacttttggggtgggaggggcttcccgttatccccaaggatttgtgggggtcagagcccataggcatcccttttcagcccctggtttgtttcctccagggaaggggggccaaaaaaatttaagtttttttttccccctgatcagggtcggggccagaggggcaccaaaagagcaagcccccgggaatgggcccagggcgggccccttttcccttggggtcaagtgaaaggggggggggaaagtcctgatcaagggggataaatttttatagccaaaaataaaaatatatattttttatata

SEQ ID NO: 613455 - DNA, 129 bp, Homo sapiens
ccccgactagctcgacagtaggtcccgcctggatctggcccacagcaccctgggggaccctgcagcactacatgaatgtcccatgtgggcatgactggtgtgccacagtgcccatgatctccacatgcc

SEQ ID NO: 613456 - DNA, 376 bp, Homo sapiens
agcaggatgcttaagactgcgagaaggagaactgggaggaggagaggtgggcgtctcgccctccagcaggcggggtagggtggcgatctcctgttccagccgcgtctttacgtccagcaggatcttgtactcctggttctgctgctccatctcgcagcggagttggcccaagctgctcctccacgctgccaatcatctcctggatctgggccagctgcatgcaagtagcgaacctttggtcctccttccagggctgttctccaggggctgctttcatgctgagctggggaacttgcagctcaattctccaagggttcctggcatggtggcggccgggacctcccggagaatctcggcttctttgccggcttctgca

SEQ ID NO: 613457 - DNA, 167 bp, Homo sapiens
ccgcactcgtgccaggacgcacagcttctcggcgccagcgttctcaagtaagctgggattgcaggcacctgccaccacgcgcgggtaggtttttgtatttataggtatcagactggggcttttgccgtggcgtggccagcgctgtgctctcgaaacatccgtgagtc

SEQ ID NO: 613458 - DNA, 397 bp, Homo sapiens
ggcggggtgtgctggtcccatttttgggtcggaaaatttaaatcaatcagtatagatgaggataaaaatagcttatgctggccaggcacggtggcttacccctgtaactggccttctttttcttgttttagagacgaggtctcgctctgtcacccaggctggagttcagtggtacaatctcggcccagcctggttggtgccccctcaggtgccctccctgatcccccagggtggaggtgtgtttgggagagcaggctgcaggggctcagaacacaagacaagcttggcattggttggttagtctccccatctgaaaaatgggcgatttggtgggtaccctctggggcctttctgctctgacagctccttggttttcccgcagcgggggaatatactg

SEQ ID NO: 613459 - DNA, 357 bp, Homo sapiens
gcgtcgacggcaaccccagagacactcacacacttccagattcatacacaggtgcatgctcacaggttgacacacacatgctcaaagactcatacacacacgttcacacatagctcacatgcacatacacacacacattgagactctcagacacacacagactgatacacgtacattcacacacagctcatacgaacatttacactctcaaattcacacacaggcacatgctcacaggctgacacacactcaaagactcatatacacacattcacacacagttcacatgcacactcacactcgcagattcacacacaggcgcatgctcacagatcgatacacacacactcaaagact

SEQ ID NO: 613460 - DNA, 242 bp, Homo sapiens
  misc_feature (15)..(15): n is a, c, g, or t
  misc_feature (176)..(177): n is a, c, g, or t
  misc_feature (209)..(210): n is a, c, g, or t
  misc_feature (242)..(242): n is a, c, g, or t
ctagaggatcctgantactggcattactcatcttccacaagtcacagagtggggcatctgattgtgcaacaaaacacaaggtttaaaaagcttccagggagggcagacaggcaaaccacgctgtagacactcttctatttgtcaaaatcagaccagagaaaacctactccacacanngatataataggtattggatattcactcttttnntctttttctgtgtgcgcggaacactttttccn

SEQ ID NO: 613461 - DNA, 699 bp, Homo sapiens
  misc_feature (11)..(11): n is a, c, g, or t
  misc_feature (77)..(78): n is a, c, g, or t
  misc_feature (84)..(84): n is a, c, g, or t
  misc_feature (107)..(107): n is a, c, g, or t
  misc_feature (302)..(303): n is a, c, g, or t
  misc_feature (305)..(305): n is a, c, g, or t
  misc_feature (309)..(309): n is a, c, g, or t
  misc_feature (332)..(333): n is a, c, g, or t
  misc_feature (335)..(335): n is a, c, g, or t
  misc_feature (338)..(339): n is a, c, g, or t
  misc_feature (341)..(342): n is a, c, g, or t
  misc_feature (345)..(346): n is a, c, g, or t
  misc_feature (464)..(464): n is a, c, g, or t
  misc_feature (473)..(473): n is a, c, g, or t
  misc_feature (476)..(476): n is a, c, g, or t
  misc_feature (626)..(626): n is a, c, g, or t
  misc_feature (665)..(665): n is a, c, g, or t
caattccttanaagactacaaaggaataaaatatgacacaggtacagtattagatggatggaagtttgacagaggcnnagaaanctccattttacactctgtacaantttggtattgaccaggaggcagtttttcacttaagatctttgaaaccaagcagttgggtgaaaaattctaagataacatttcgaatgctttaatcaacagacatatacaaatgaattttaaaataaaaccaaggcatcaatgaagaagatctaacatgaaagtcaccacatctcacaatgagaatccgatcaganngnaganggcaaaagtctaaatcatagagnngnggnngnnggnnggggggagagggagggctctgggactaaatccatccagggcatggccacctgatgtcttccgactttcagggtcccagggccctaggtggaggtttgggacaaatatggtatttggtnacaaggagnaanagtacgatctgctgtatctggaatgggaaaggcggcacagaatcctggaaggactgaagaccatccagatgctatgataacaagatggagagtacgagggccaagagctgtaaggaggctctgtgcctcttccggtgacaggcatgaatnagccccacccgccaagatgtcattaaaaagttactactnttagtgagaagatctgggagtagctacaggaaaa

SEQ ID NO: 613462 - DNA, 275 bp, Homo sapiens
aacgaatgcgatacatagacaccatcttgttagaactaccacagtaaggacgaggaagactccagcattggacataaccttctgcctccctaatgagcacactctttgctgtttacttcctcctctataaaagtgagggctgtgtccttaaaagttctcgtattccaggacatgcagcagcaagcaacaagaaaagcatttcagcaggctaatttcaaacacacaaagtcaagccacctcaccggcacggactttgtatttaacatgtaccttca

SEQ ID NO: 613463 - DNA, 193 bp, Homo sapiens
tttcattagcataatctcttccttttctgtttgctagaatcaccagtaaggcaatctgaatcaggagtatctttgtggaaaggaaaaaatatcggtaattcaatgtctttactaattatgaggccattcagatttttctttttctttttgttccagctttggtaatttgtgtctttcaagaagcaggaactgg

SEQ ID NO: 613464 - DNA, 364 bp, Homo sapiens
ctgctccgcccctctcctgctccgcccctctctggtagctgggattataggcgcacgccaccacgctcagctaatttttgtatttttagcagagagggggtttcaccatgttggccaggctggtctcgaactcctgacttcaagtggtccacccgcctcgacctcccaaagtgctaggattacaggcgtgagccaccacacccagcctgaaatctttagttatcaaagttgtattacatgggtgctatgcggtagtttctgtccttgaggtttacagtctaacaatgtccttggcctgctagggcgtacatgggaaaagttaggtaacagtaccagacatcccagtgggatatcgccagatgct

SEQ ID NO: 613465 - DNA, 342 bp, Homo sapiens
ggaaggtgacagtactaccttcttctagaaaacaaagattgttcaaccaccaccatgagaacaggtggaaaatatctctatagacccaacctggcaatgaagtataaacatcgcaccccgcaggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggccccaggattatcag

SEQ ID NO: 613466 - DNA, 222 bp, Homo sapiens
ttaacatacgggtgggtagcatataaagcgtggatatgcttgactaagggatgattcacattccaggcagaatgaagtgggatggcgcaaggatttcatcacgctactcagaacagcagcaagttgaaatgtatgaattgtttatttcctggaaatttccatttctgttttttttttctctttttttttgggacggagttttactttgggtcacccagtgct

SEQ ID NO: 613467 - DNA, 439 bp, Homo sapiens
ggacacctttgggcatgcctgagacccttgtgcagtcagaggctcatgggctgcagaagaactacagaaggaccgcagcaaagccatgatatttccctgtggaatgttagagacgccccgaggggctttttgggacatcttccagttgtgggggtgtgcaatgctctgttgtgatttcctgggacatcctgggaacgactggtggagttatcattatttcttgaaaaaaccatgaaatgtgggaaggaagtacccggggtttaaaccggggagcgcctttgagggatctctcattacatatctccatacatcaacaagctacattgacggagactctgttctaataatcaagagaatcaatgccggaagaatggccgaaaatacaactgagagtgggatgaggatgaaaatcttcaaggactactgaggcaatgagatc

SEQ ID NO: 613468 - DNA, 763 bp, Homo sapiens
  misc_feature (189)..(189): n is a, c, g, or t
gtctctaccggcgggatttgattggctgtgtatgtctcacagacaatacgtttctccgctcccagacatggtgtccctcgagacttcctgtccttcgtgcaaggcgcagtgcagctaggacatcgtgggtaaggtgaagagcttccctaaggtatgtaccccgttccaagtccggtccacactcacagnctcttcctgggatagcaaggctgggcatgactctcacattcgtgcgggcagtcgacaggccggggatccataagggtgatacataagatacgtgcaggtcgtgtcgggacggcttgttgagccatatgtcatacgcatcacctaaccatgagtgctagtcggagcatcgtcgggctacgtcggacaacccctcgagtggtcatcctggacccctgtccagtaactgttctcttgcatgagaccacattctcgtgactgacactgccaagacgagcgctatcgtacttaagaactttgggcattaaatcctcatcaacgaaggggccttaagccaacgttacctgcaaaggacaccctgagtccatacggacttgaaggcgcattgcggccccggtaatagtccacgtccctgggaacgcaaacgtgtaaatttacaagacccagcgcaagttgacaacgaaaaggttacttgtcccacgtggatgaattccctgatgcatccaattttggcaccatcaaatccgcaagaatttgcgcccgtggcatttccaatctatggccggccaagaacaga

SEQ ID NO: 613469 - DNA, 307 bp, Homo sapiens
  misc_feature (255)..(255): n is a, c, g, or t
gtgctcatctcgaggagtctctggtgtgtgttccatgcactgtcctagggcacccataaaaatagagaaaacaccactttacaagactgccaggtatacatagagctccacatatggacttacagatctataaagaagcacgagctccgatgcccggcattgagagagctggagagagccaagactggcaagtgaaagtgagcagaagatcatgtagaaactgacttcctcgagtccagcatccacagtcactgnggccctgtcgtgacaattacgtgtgcatgttctccgcgccgtcccctccctg

SEQ ID NO: 613470 - DNA, 226 bp, Homo sapiens
gttcccccaaacaccgcattcttcatgttgttctcgggtgttttttgttgttgttatttgttgttgcttgagacagagtttcactcttgttgcgcgaggctgttgtgagttgttttgatctctgcttactgcaacctctaccttccgcgttcaaacaattctcctgcctcagccccctgagtagctggaatgacagacgtgtgccaccacgtcccgctattttttt

SEQ ID NO: 613471 - DNA, 488 bp, Homo sapiens
ttctttaagaaagcatatattaccaggccattctaattcagattaccatttgaggcatcaggatgaagcaaatccatcacatcgtcaatgaacgcgagtatcatctaaagtgaactcgtctccctacacccatactggccgccgtcaaaaaacagcaaggatccctaactcctgttaaagatgtcaccttgcctcctggacacacccatcgctgtaaccacttggcaggaggaaccacaaagtaagtatcacagatcaccgccctcattaggtgtatttttttttttttttttttttttcaaaaaaaaaaaatgacccccgtgtaggagggtgacgggaaattgcattaaaaaatcccgggcccccccccggaatacaccctcccaacaaagtctaggacaaacaaacttcaccaaaacgaagggctcgtcaaaacgaccgggggggggaaggagggaaccgagcacaacatcgaactctgggccaat

SEQ ID NO: 613472 - DNA, 994 bp, Homo sapiens
aacatagacagcgggagagaacagctccttactctgctactcggtagtgatctaggtctcacaatgcgaagtagcgccctaggtgtggtttgagcatcgctgtcgggagccgccttgtgacgcccgggtaatatgtggctgctgggcgggttgtgtttcgcccgccggcgccgtgttttttttggcggctccttgtgtgccccgtgttctctcagggggtgttatggggtctcttgatacctccgggggttcccgcgcggggggtctccccccccttgaaaagtgcggggtgggcgccccccggtgtgtggggtgaggggtgacgcccccggatgttggtttgttcgccgggacttttttgtggtggcctttttttcgggggccgccctttataagggggggcataagaccccaattgttgcccccgtgggcagcttagttcccaagggtagaacatgccggtttcgcgccccaatgtgaaaaggtgcccctgcgaaaagcgtttttttctccccgctattattgcggttaaacatggcgagtctctattctgggagcttctgtgggaaattacctataaaggtgtctttgtgagaaacatctgcgttttaatttttgtgggcctctcctggggaccctcccctcttgacctttaagagcactccgggggttctagccttcataggtcgtcactctctttatattaagaaaaatcgcccatccttcctcccggttatttgtaaataattctgtgaatttctccccctgtaatatacgaaatttatatctatgaacgcccccccaacaaacttcttccccccccctctaaaagaggagaataatcccctctttatggtccccaaaagttctgttgtttgttttaagcttggggagaatttttgtgttgtgggatatattctcttttgtgtgggggtggaacaaaatcttctttttctgcttgtgagagcggtagtgagacaaaagaacagaaaaa

SEQ ID NO: 613473 - DNA, 251 bp, Homo sapiens
caaaagcgggagacatcaatgttccatcgacctgaagaaaaacgtgctggtgatcggcacgactggcacacagacttactttcttcctgagggagagttacctccgtgcgctaagttggtaagtggaactggacaagacgagtcttcagacaaggaagtagcagatactattaaacattcagtcatgaattcgggacgaaaaaagcattgaaacagcttagaactatgtcatcaccttgccgcttttgtgt

SEQ ID NO: 613474 - DNA, 155 bp, Homo sapiens
cttatgacggaggcattcacatttactgtctattatctcgtgtgccttatagagatggctttactcgactgtatctcaattagtctttctttctatgcaggtttataatcagtacaagctacggttttctagaaatactactatcgtcaaggctc

SEQ ID NO: 613475 - DNA, 840 bp, Homo sapiens
  misc_feature (245)..(245): n is a, c, g, or t
  misc_feature (424)..(425): n is a, c, g, or t
ctcctgccccttcggaggcctgtgccagtggcagctgggcccggagacaccaggccggcactgctctccttcgaggcacccgtgtttgtgccgacgctgactcccggttgtctgcagcagccacgtggccgaaatggagcctctccacgggggctccttccccagccctggatggcacagcagcctctcctgtctgtcaccacgtgtgacctgctcccttactcttcagccgctcatccacgtcngcaggggcatctaactctgtcccagggtatcccagaccctggctcacgccccaggctctccattcaggctccatcgtccacctcagaccatctcaggtttgctggtcttctggactagcgcagcagaaagaacccaggaaggaagcctcacgtctgacacaagaaccttcggtgctaanncgagggcggtatgtgcatcctcagcacctgcccatccggcaccatcctctgatccagggactgtgagcaacagggccccgtggccaggacatctctcaccctccagttaaaatctcgccagttgagtctgcccatgaaagtaggcgctgaactgcccaataaatccacaagtaagagttgcaagaaggagccaaaaagggctgagctgaatgactcatatatgaaataatttgataattaatataaataggaaatttaaagtctccagctgagtgacagaaaacaccttaaaaagctcaagagagaggaaaggaagaaaataaacctataattgcaaaataaaagcattgaaagaagccgtgctcaaggtaagatgctacagatgcaataaattcatgttttaacattaaaaaaa

SEQ ID NO: 613476 - DNA, 620 bp, Homo sapiens
tgtatcaaaaacacctaagtctatcttgctgtactgagcaatggttcatataatgcggaacacgaaacattgactaatacaagtgcttaaaatatcaaacatacttatttttttaaaaacagcaacatcattaaagaatatataccatagggacctggaatctgtaagctgattccaaaaacgaaataagtagaacatccatggtgaaacctgaacattctacctctgctttggagaagggctatcatacaacattcagtcagctgaagatggattggtagaggtgtgtctatacataaacttcagtcatttttgcttgtgcagaatcatcccaatcttcccaagactgaatgggcagtcctgtggctttcttccttttccatattcccaacaaggctacgtgaagttcaactcttgatgagccgcttacaacagcagttccttaggagccaacatgacaggtgggtcagatttccctatgagaaacaaaactggccacctacagcaaaatatcaaaatgggtaagtccttccttcctcttcctcctgattatatacaacatatctcctttcaagactattatctccatcatgcttattccttcacaaatctaaagctta

SEQ ID NO: 613477 - DNA, 167 bp, Homo sapiens
ggcgaggacttgggaatcacatgggtgcagaagagctcaggctgggccagtgtctgcccagaaaggcttcatgggaccggggtagcaggcttatttcgtttaatgtggaaaaggaacgttctctctccctttctcgttttctgcaaatgacagtcttttttggacct

SEQ ID NO: 613478 - DNA, 90 bp, Homo sapiens
  misc_feature (22)..(22): n is a, c, g, or t
gggaaaagagattaattacgtntgaggctggaagctgggaaacccaataaatgaactcctttagtttattacaacaagaaaaaaaaaaaa

SEQ ID NO: 613479 - DNA, 835 bp, Homo sapiens
tggaaatggagtctcactctgttgcccagaactggagtgcagtggcatgatcccggttcaccgaaacctccaccccccaggtccaagcgattctcctgcctcagcatcccaagtacccgggagtacaggtgcccgccaccatgccgggctaatttttggtattttaagtagagatggggtttcaccatgttaggccagactggtctccaactcctgacctcaggtgagctgcctgcctcggcctcccaaagtgctggattacttacaggtgtgagccacagcacctggtcttccctagtgccatttttcgaaaagactgttctctctccgtgggatagatttggatcccgttgtcaaaaagcaatagactgtaaatgtatgagttcgggactctcagttctgtcccatggatctatatgtctatccttatgtgtgtctgcataacggtatcttggtagaaacatttaggactttgaaccgtgtaagtcctccagcttggtaatccttttggaccgattttggtgactgtcgggatcatttacctttccctgtataagttctaaggattacctggtccaatttctacaacaagcggctttgacaggtggtctcatttctgtcggagaggacgtttggtccgggtcccccggtgagtcagtgtgaccgaccctcagttcggtgcacttgcctcggggcccagtattctcgcctacgccccccatagtgggattacggcttgccgtggcgcgcccactgatttggtatgcagcgagggggcttccacttttcacggggggttgacctcgctggtgtgccccgtggcccagtcgattcg

SEQ ID NO: 613480 - DNA, 188 bp, Homo sapiens
tcgacgcgtgcatgcacttacacagaacggcaatggaaagtatgtagacgaagcgatatgggctgccctggaacctacataaccgaagaaaagccgcaggtgtgtgctgccatgaacatctctcaacagctcgtactgcacagctggtgtcggcatcatactgaaaagcaatgtctaggtgcaaatca

SEQ ID NO: 613481 - DNA, 809 bp, Homo sapiens
tgaatatacatgagctatctggtctgctaaaggactcatagcttagacaaccatagcccattcaaggctttctacatggctgctaggcgggccccattaggtaccaaaagaagaagaaccccattgtcagtgaactgtaccagcacagcccaaccacctatcctacactacaggacaccatctgtgagaccaccctccctcgctcgacaccatagcaagacatgcacagacacaaaaggcgccatacgcacaggacaccacgagaagccgccaacaacacacacacaaactcccgccgacactgcacaccacctaaacaaccagcgcatcccacacgcagcgcaggacacatagacgccaatcgcagccacgccaccgccacaagaccaccacccccgcacacccacaccctccccaccacacgcaacaacccgccacaagacgcaacgccgcccctccgcaacgcaacgcacctaccgcacaaacagcccccgcaccgcaagaccgaccgtgaagaacaggggcggaggaacgcaacaagacgaagcgacgactcacaccaagaagagacactcgccgggacaacggcagacgccacgaaaaggcgcgagaagcgaaaccgcaagagacagcacaaaacaatagcgaccaaacaagacgccacccggacaggcgaacccccgagcggaaacccgcgaaccaaagaaagaaaaccccacgccaagcagagacaaagcgagcaccgacgcgagacacagccacaccacaacacacagccaccagagggaccgccggccgcagcccgacgc

SEQ ID NO: 613482 - DNA, 126 bp, Homo sapiens
gcctcgcagtgtcctagcctcgccatgtgggtctatgcctcgccagtgggtcctagcctcgcgagtgggtcctagcgtcgcgagtgggtcctagcctcgcaatgagggtcctagcctcggcagtga

SEQ ID NO: 613483 - DNA, 542 bp, Homo sapiens
  misc_feature (277)..(277): n is a, c, g, or t
  misc_feature (468)..(468): n is a, c, g, or t
gcatacagtccagcgtaggtgacagagtagtccaatcgaacaaagacataaaaaaaaaatcaaaaaacaaaaatgaacaaagcctccaaaaaatttgagattacgctaaacagccaaacctaagaataagtggtgttcttgaggaagaagagaaatctaaaagtctggaaaacatatttgagaaaataattgaggaaaacttcccgggcctcactagagatctagaaatccaaatacaaaaagctcaaagacctgggaaattcattgcaaaaagatngtcacccaggcacacagtaatcagattatctaaagtgaagacaaagggaagaatcttaagagctgagaggcaaaagcatcaggtaaccaacaaaggaaaacttaacagattaacagcagatttctctccagaaaccctacaagccagaagagatgggggtcctatctttagcttcctcaaacaaaataatngccggtcaagagttctgtacccagtaaaactaaccttcatgaatgaagaagagagagtctttttcagacaaaca

SEQ ID NO: 613484 - DNA, 408 bp, Homo sapiens
ctgattgagactgctgagctaatgagttaaaattgctttatgtatcaaggccaggcatggtggttcacacctgtaattccagcactttgggacgctgaggcgggtggatcattttaggtcaggagttcaagcagcctggccaacatggcgaaaccccgtctccactaaagatacaaaaatcagctgggtgtggtggcacacacctgtaatcccagctactggggcggctgagaagggagaatcgtttgaacccaggagaagaaggttgcagtgactcaagattataccactgcactccagcctgggcgaagactctgtctcaaacaaaacgaaccaaaaaaccaacacacttttcggtcgggtgcagtgacttacacctgtactcctagcactttgggaggccaaggc

SEQ ID NO: 613485 - DNA, 114 bp, Homo sapiens
ttcttcttatagtccagtgtcctttcacgccaatctgcaggactctctatggtatatcttacaggataagtctggtggtaacaaactccctcagctttgtttacctgagaatgt

SEQ ID NO: 613486 - DNA, 131 bp, Homo sapiens
cacgaggtcaacaccggactcatcgagaagaatatcaaattcttcttttctggttcagcaataccaatcataaacgagtacccgtctcttgacagtggtgttactgtcaaaactcttggccccatgaatga

SEQ ID NO: 613487 - DNA, 536 bp, Homo sapiens
gctgtcccgctccggctcctggggctccccgcagacgctgcttttcttagctccactggtggtgtgcctacttacctgggctgccctgccgcctgcatcctgctcgccctgtctgggaatggggcctgccccgggcttgggcctggccctggctggggccccctgaggctgcttcctgccccgatagtgacctgccttggtgcctgcccccccaccagagatgaagtggctgagcagacagggcgagactcgctgtgagcaagaacgacaacgtggccccccaccggaccatagcaagaacaccccattggacaggggggcgccagaccgaacgggcccgcgtggacaaggggactacgagagaccaagctgttaaacactgtgtgaagatataccgttgacaacacgacagagactaacccatggaaccctcaatggtgtgtgcccagtacacgcacatcgacttgcagaggctgactacagactggacgccagcactctcacctacagaccggtgccaagcttcaaagcttcca

SEQ ID NO: 613488 - DNA, 1376 bp, Homo sapiens
  misc_feature (201)..(201): n is a, c, g, or t
  misc_feature (425)..(425): n is a, c, g, or t
aaaaaaaaaatttacccaggtatggtgggcacacacttgtggccccgtctacttaggaggttgggggcaggagaatttgctttgagccccaggagtttggagggcttgcagtgtgagcttatgtgactcattgcccactgtgcacttcttagccctgtgggttgattagaaacaaggaccctgtgttcttctttaaaaaanaaaaaattgtgtttttattgcccccagggtaaccacagtgtgtgtgcaaagggacaccggtggggaggagagagatctcttataaaaaaaagtgtgtgttcttatatcacaccacagggtagtcacacagtgtgtgtgccaagagcgagtgctgtgtggagagagagagatctccgggagaaaacagagcgcagagagacacacacaactattctctgtgtctncctctctagtagtggggcagcctgtgtggggtgggcctctctaaagagagggagagggacaacacagagagcgccacatctacaaacacacacattttaacaacagagaggagagagagatttacacacaagagtggtctgtgtgttgggtcgtagacggggagtgtagagagtctcacacacacagagagagcgagacacactctcacagagccagagaggagaagaggatatagtagacacactctctgtgtggagacagaagaagagtgtaggaggggccccagagtgtgtcgtccaaatatgagagagagtggcgcccagagggggaaagtgtgcccccacacactgtgtgagaagaggaggtgtgacacacaccccaagagagcccaaaagagacaccctctcacagagggggagcgggtgacaagagtgggtgtgttgagacgccccattctccagggaggtgctccacttaagagaggggagggggcgtttgtgtctccccagagggagaagagaggggggggcaccggaacatagtgtgctccaaagagtgggccaagtacagagggtggacaccacacaaagcccctgtggtgtgtgttttctgttggcgcgcaaaacgcgctgtttgttggggggcacccccaatggggccgcgccataaaggcgggtggggccacccccttgtgtgttatccacagcaggaaatatataaacccgcggggataaaagtatgcaagaggcgtcttctgttgttaggaaacaacaacacaaccatcgggtgcggctgggcgggagaaaacacgggtgtgctctcttaaaaaaccctccggtgggggggcgggggggtgcattaccaccaatttatttcaacagggggagcaacatctagctcgagagagagacccgggaggggggacgaaaatctatcacacatggcgacac

SEQ ID NO: 613489 - DNA, 233 bp, Homo sapiens
  misc_feature (56)..(56): n is a, c, g, or t
ggtttgggggggggccccgggaaaaaaaggggggggggcaaaaaaaaaggcccccnccccccccccttttaaaaaataaccaggggattttgggggggattttttcccgggaaaatttttaaaaagggggggggattttttaaaggggggggggttggggaaaaaaaaattcggggccaaaaaagggggggggtttggggtttaaaaaaaaaaaaaaatttttccccctttta

SEQ ID NO: 613490 - DNA, 831 bp, Homo sapiens
agggaaacccggggaggccctccccacccaagagtggtgcccctaataggggaattccacaaggttcaggcccaggttttcgagtaaagaaaacgggaccagttttccccaaagacccgaaagggtgaatctcccccaattgatatgacccacccgcggcaaaatccatagagtttccggcagaggaacgtgtttggaaatttgggaggccaacattttttccacaactgggaagcccgtatgttctattgcaatgccatgtgggtaaacacggccccaaaagtgggccaaaaaacaaaacctgcgccaaaggggctgccccagggtagaacaattggaccacaaaccatttcagaagtattctcaaaagtacttttcatgccacgctaccctggtgggggcggacggttctcttgtagatacatacgaggtccatacgatgccccaaagagtaagaatcgcacatggacttggcgagcgtgcgaccgggtgcccaaataactaaaggaatattcgagcaagctctcatggtaacagaacccttcgcagattatggagagaagtggtggaagccaaaaaaaaagcatggtgcccttcacggtaagtagctggggcaatatgtcatttattgatcagccttagggttatcattgcgcattttgagggcctgtcagcggtctatgcgaaggaccttacaaaccctaagtgcggacaggtagggccctgagtgtccaggaggtgggctggaaccaagaagggggtgtcagaagggagggtatcttgtctaagtatgaagagtgcagtgtttctccaatcattgatgtcgggtag

SEQ ID NO: 613491 - DNA, 989 bp, Homo sapiens
agtccgagtggcgagaagcgagctggaagtggttgtggtggtcgcgtctcggcataccggtgagcgcttggcgcatggctgactcatctgcatctgaagagcatgattgcagaattctaaagaaaagcttgttcactatttgcaccataagatcgtggtggatggaaccttataacagacgaaggggctagtgggtggaactgtaaatgtatgatctctctgcgtgcagcaatccccactagtagagctaaagttgctgcgctcatgatctgcatgaagctagatgctgaactggtgagtgcgcactgttgcatttccctgaatttctgaccatctgtatggccaggagaaagatgaaagaatgagacagtgtaaccacacagtttcgagatgcctgccgtgtgttggactaaggttggctagtggctatacttaggtgctgcatgaagttctgggcatgtgatgatctaaaccttggccgagagagttgaacacgatgatcgaacgttgctcgagcatgactcgcgggcaagcggatattgaatggtgacgggtcagggtcacactatgaagagttggtgcagaacatgatgacctgttgagtgaaagagcttgtccatggagtgtgttatgtgcttgttcaaatcttgtttcattcgtcctctcactttggggtgtatactgatctgttcaaagtttctccctacttgtccgaacacatattgttgttagaagtgacgaattaaggcctccatggtgcttacctttttttactgcattgctgaaacttttttggaaatggtcggtacgcgggttgtgggtgacttggggactaaaacgctcggcattgagttaacgcgtgggcacgcgacctcgtgtgtgcgctcaaagagcaggaccggacattgtgggggaggaggagagggcgaagcaactaacggaggggcgacggccacttgtggcgaggcttggggaaagacgagggtaca

SEQ ID NO: 613492 - DNA, 124 bp, Homo sapiens
ttttttagcctttaaaaaaacggacatctacaaatgtgtgctcacaaatgctcaccgacttgatgatgccagtgtttgagattagagaggcttactgaatttcaaatgaagtgattagaatgaa

SEQ ID NO: 613493 - DNA, 632 bp, Homo sapiens
tccagtcagtttacacaatcattacatataatataaaaacagattatgttcactaacaagaccttataatcagtatttctctctctgattaagggcagatccatatgcttggcagttaaccaagaaggaagttgatgttccttggtggaaaaattagaagcctaattggggcatatgcctgaatagacagatgtgcattcagccttccaaggagatggaccaaagtctgcctgtaggtaggaccaagatttttatcactaagtttttgaattgctctatcaggaaaaaagaggagtgttcaagtgcccaaattctgcgccaggagcacatttagatctgtcagttgtccagtatagctcttttaaaaaaaaagaacgcatctaattggtttatcatagaatgttggtaaatactccctaggttataaaattagtgatctgcttaatagatgatggtcagctaaagaccaattatatctgtcaaaaatctttatttggtttttaggataaagactgtcttttggaaaataaactgtaagaccagttgcctcttaacaggcaatgatatatcataatgtttaaatgaatatggatctgaataaatagtcatgctttcttcttaaccacaagaaa

SEQ ID NO: 613494 - DNA, 369 bp, Homo sapiens
  misc_feature (3)..(3): n is a, c, g, or t
  misc_feature (20)..(20): n is a, c, g, or t
  misc_feature (26)..(26): n is a, c, g, or t
  misc_feature (206)..(207): n is a, c, g, or t
  misc_feature (251)..(251): n is a, c, g, or t
  misc_feature (355)..(355): n is a, c, g, or t
  misc_feature (367)..(367): n is a, c, g, or t
agngcacaaatccatggctnggcatngctttaagaaagtcttatctgagattcctcctgtggaacaaagttaattggttccagagattcaaagccagagttgctgtcagttcattggtagagatgccatcactgggcaagtgttctgaaaacatcttatctgaataacagcagtcctgggagaacatctagggatctagcaaagcnngagatacatgaaggacataaaaacgtttttagaaagtccttggnaacagttctcatttcagacatgtaagcctgagctagggttgaaaagtgattttcatcctgggtatctgccaatttttcacctttcatttagggtttccaacctnttaaacttttcngg

SEQ ID NO: 613495 - DNA, 113 bp, Homo sapiens
tcatctctgtatactattatcgtcactgtctgctctgagatcctgagctatggttacctttagaaaagcatggggagggtatcatcatttcataagatctctttccagttgtc

SEQ ID NO: 613496 - DNA, 135 bp, Homo sapiens
tatatcgtctggctcttgcattctgggaagcaagttgtgattgcacgtactcccctgcctcaacaagatgtttgccaactggccaagactgccctgtgcagctgtgggttgattccacacccccgcctgggaccg

SEQ ID NO: 613497 - DNA, 205 bp, Homo sapiens
ctctgctgaggtggagatgacatctatgtgctctcgcttattcacggccatgcagcccaaacctcggaggacctgacctctgcaacaaacatcgtgaagtggatcacgaagcagcagaaatgccagcgcgggttctcctccacccaggacacagtggtggctctccatgctctgtccaaataatggagcaggcaacatttaccag

SEQ ID NO: 613498 - DNA, 602 bp, Homo sapiens
gttggttcgtaacactaatacttcagttgtgtctgctcgtttgcaaatttgggattcgtctccttgccagtattatcttcggtgtagcttttaccagtattgtgttattttgggttatttttgcagctgtacaaacttcggtgaaggttattgataactgaacattgttcactgaagattccaggtaaagagtctggaagatggttaaatgatgagaacttgtctaggctacaccacaagcggatcgtatgtgtgtgatgaccgacaggatagtcagtgatcaggaaagaatggggttctttgatggtgtacattttgtacgattttgcaggtataagtggtatctgctcagagtgaactaaagaatcttttcctcgtgatattttcagcggtttatcatgatcttgaccgtgcacctagtacgatgcgatatactgatgggaccagtgtattacaccatggtataagaactgtatagataaggctgcagcagatcttccttacagcatcaccatataatccagcagtacaatggtgaacccggagaaccatctcttcactgctgtattagaccctcatatcttggccgtgtccacatcata

SEQ ID NO: 613499 - DNA, 206 bp, Homo sapiens
ctgattcataatgactctcagatcttagcaggcggggtacacaaatataggcaagaggaactgctggccacagtacggatgtggcagtaatcctgtggatgcatccttttggaggtggcaaacaagcatgcacatctgggaagccctcgcaccatccgcagagatgcccctagtggacgcaaagtgcgtctcattgctgcccgccc

SEQ ID NO: 613500 - DNA, 854 bp, Homo sapiens
  misc_feature (211)..(211): n is a, c, g, or t
  misc_feature (303)..(303): n is a, c, g, or t
  misc_feature (306)..(307): n is a, c, g, or t
  misc_feature (320)..(320): n is a, c, g, or t
  misc_feature (326)..(326): n is a, c, g, or t
  misc_feature (331)..(332): n is a, c, g, or t
  misc_feature (334)..(334): n is a, c, g, or t
  misc_feature (345)..(345): n is a, c, g, or t
  misc_feature (351)..(351): n is a, c, g, or t
  misc_feature (354)..(354): n is a, c, g, or t
  misc_feature (379)..(379): n is a, c, g, or t
  misc_feature (383)..(383): n is a, c, g, or t
  misc_feature (414)..(414): n is a, c, g, or t
  misc_feature (425)..(425): n is a, c, g, or t
  misc_feature (433)..(433): n is a, c, g, or t
  misc_feature (435)..(435): n is a, c, g, or t
  misc_feature (441)..(441): n is a, c, g, or t
  misc_feature (454)..(454): n is a, c, g, or t
  misc_feature (521)..(521): n is a, c, g, or t
  misc_feature (531)..(531): n is a, c, g, or t
  misc_feature (551)..(551): n is a, c, g, or t
  misc_feature (590)..(590): n is a, c, g, or t
  misc_feature (597)..(597): n is a, c, g, or t
ccctaccctcccctcaatatcccggtggggaggggaatagtaaaggggatcccatttttcagtccaattattttactccgagagtcggtgaattgtaacaaaggaataactgtcccacgacaaaacgaggattttctaggtccagtccagggttacaaacgccaaacgcatttattggcgaacagtgttgagtgggggcagcctttacatnaatatcccgggcggggcgttgcccaaggggagcaaggacacctttccagtttttctggagttcgctgaggagcagctgcgagccgccatgtnttnntttgtttcccaanaaccgngaggnnanagcccccttgntccganccntcagctttttgggctttgaaattgngagnccggggcatccccttgtccccaaaaaacccnacgcttgtttnatggcctncncgtttnaaaaaaagttttngggaaaggaggaggagtagggcccccttggggttgggcatccggcccctggggcccccccttgtcanccgggggggnaggaaccgtaaattcgctcntttcgcctgggtttgtccgcatgttgtaattgggcaaanaaacgcnccctccgaattagggggggattttttgaagtttaaaattgggtttgggaaactgaaggatttgctttaattttaaaaaaaaatttatattttccttttttatgggggggtttaaaaagattcaaattacccttggcctttggggggaagttttttttttggggttttttgggaaccgttttagtttttttacttggaaaaatgggggtttaatccccccccttgttttccaaaagccaataaagggttttcccccca

SEQ ID NO: 613501 - DNA, 294 bp, Homo sapiens
  misc_feature (88)..(88): n is a, c, g, or t
gcggccgcctactactactaaattcgcggccgcgtcgactcccattcctgatgcacatgaagctctgatgcaatctacagtctacaancctgttccatagttaagatgacagagacactcaatcaggcctgaaatgtattgagtattctacaactctaattacgcagtatgtttcttaacagttgttgaattttaagattatgcaaatattctgagaaaaagccatctaggaatcacaaatttctttataatgttttaataatgagctttgtgttgtattagggtgatagctat

SEQ ID NO: 613502 - DNA, 320 bp, Homo sapiens
tgcgtgcatgtggggcaatctcggtcatggtaactcgcccgttctcaggttccgtgattctcctgcctcaggtgatccagcgtgctcggcctcccaatgtgctgggattacaggcatgagccactgcgcctggccagtccatctcacttttagttctcttatctcattaggctcttcttggctatgacagattctcagatttccctagtttttgatgatcttgacagttttgaggagtgccggtcaggtattttggtaagagtgtccctcttttggaatttatctggagtttttctcataagatacacgtttttggcaat

SEQ ID NO: 613503 - DNA, 197 bp, Homo sapiens
gctggtatgactgagacagcttttggctccgcatataaaaccagacgggcatgtttcgtaccgttgggcaactctacaaggattctctcaccaggctgatggcacctctccgaaacaccaccctaactttgttcgttgtatcattccaaatcacgagaggagggctggaaaattggatccacacctagtcctagatc

SEQ ID NO: 613504 - DNA, 258 bp, Homo sapiens
gtctaatctaatagtcctcttattatgcctttagttgtatgagtctctgtctatgaactgaacacaaaactcaggagcttggtggctttaattgtagatcagtgcttgtactaggcttagttatatgagtctgtataacacataattactaactcttgtagccatatatgtaattgactttgagtgtgatgtacctgaggtaatcttccgtcacacatggaccgtaacgggtcccagttgtctgagagcctcatgagg

SEQ ID NO: 613505 - DNA, 187 bp, Homo sapiens
gctggtggtcgatctagaggtcccccaggaagaagaagcaaatctagtgaattcagccaccaagacttggggggtggttttctacaccacatacatttttgttctgtttctttctggctttctttctttcttttttttttttttaaggaaacagagtctggctcggccccccaagcagcggggcggg

SEQ ID NO: 613506 - DNA, 763 bp, Homo sapiens
cggtttcaagccaacatcagccaggcccagaatgcgcaaccagtgagtgggcgctatagcgagctgatgaggcccaggcgcaggagttagcgaaccagttgcaggtccaggctgagcttcttaagagaaagctggagatgacagctgagaacttacgcacctctatggaggtcggtgtggatgagctgcccagcctcttcgccccctactcccagaagatctgcgagcagctgcaggaagtcatggacaagatcaaggaggccacagcagctcttcccactcaggcttaagagctccacacttacctagtgttaacaccaaacagaaagaagaagggaggctttgtgttactgaaatgtgcttttttcattctgtgagaggttgataaagtggttaacaactggactcaattggactagcactgtcctttactggacaaaagaaatgccatgtactcaccacgtttactttctcagtattaacccatgtttgagattatatttctgttagcgtacagtagagcgaatttaagatcaatcaacttgcctgttttggaggctaatttttctagttagtggggccaaacgtggcgtcattcaaaataaatagtaatcaaaaggtgccttcagctgctgaaatgaatcagaacacatgaaagatgagctttgttagtcaacagtccacatataaatgcttgtttactttacatgtttgtgcactgatgtttttgaatttatttgcaataaatgtgcgttctactaca

SEQ ID NO: 613507 - DNA, 787 bp, Homo sapiens
  misc_feature (95)..(96): n is a, c, g, or t
  misc_feature (154)..(154): n is a, c, g, or t
  misc_feature (559)..(559): n is a, c, g, or t
  misc_feature (759)..(759): n is a, c, g, or t
  misc_feature (766)..(766): n is a, c, g, or t
acctcgtgatcaccctgcctcggctcttcttttgctggaattacaggcgtgagccaccgcgcccggacaaccactgagatttagaaggcatcgannccactatacaactcacctggtttcttcctctgttggggcccctcgtggccactgttcngttactttttggtcctatttatttaaatggatggtgagctgtttgtcctccaggatccaacacttccaccttcagcttgtattacaacaataccagcctttcaagctactccgggtgaccccagaactcatctgaactcagaagcccaagagtttcattcctctcactttaggggactaagtgcccctggtcagcatgaagtcgatacagaagcatgacctccatccctaatccctcaagaatgaggagtggaaggtgttggcaggagggtgggacgcggtttgtaaatctgtaactgcatcagaccaaatctagttcaactttttttttttttgatggagtttcactccagcctgggcgacagagtgagaagactccgtctaaaaaaaaaagttaaaattagcnccaaacgctttacaagtaaaaaaagtttttagctgcatatgtttaagtaactttttagattataagaaatacgcatgcaaaatggaaaggcacaaagaagagagcaaaaagtgcatgagatctcacatccaaggataaccgctgagaacatggaagtgctgactcttcagtctttatactatacacatttaggcctgttntgtttcnataaaactgtaatcatataaa

SEQ ID NO: 613508 - DNA, 304 bp, Homo sapiens
  misc_feature (201)..(201): n is a, c, g, or t
  misc_feature (233)..(233): n is a, c, g, or t
  misc_feature (244)..(244): n is a, c, g, or t
  misc_feature (289)..(289): n is a, c, g, or t
  misc_feature (298)..(298): n is a, c, g, or t
taaaattacaccaagaccttgggggaaaaaaagaaaagaaatgtaaaaaaaagaaaaaaaaagtgctgtatcaacgacataaacctgttggcccggcacagtggctcaagcctgaaatctcaacacttgggaggccaaggcggttggttcacctgaggtcaggagttctagaccagcctgaccaatacggtgaaacctgtntttactagaactacaaaaattagccgggcttngtggtgtgcanctgtaatcccagctactcgggaggctgagacaggagaatcgcttnaacccaggnggcgga

SEQ ID NO: 613509 - DNA, 258 bp, Homo sapiens
ctggactcccaaactgctgggcttacaggtgtaaccacccacctggctcccaaactcctgggattacaggtgtgacccacccactgtgtctggcctatatttcttatagtaatatagttattggtggggtctagaaacagaaataaataaatagcagcaaatatctaatgtactttcaacaatatggctcatgctacagcatcagtttctagcacggcagagcacccaagttatgttcctggcaggttattggcgagt

SEQ ID NO: 613510 - DNA, 542 bp, Homo sapiens
  misc_feature (95)..(96): n is a, c, g, or t
  misc_feature (154)..(154): n is a, c, g, or t
acctcgtgatcaccctgcctcggctcttcttttgctggaattacaggcgtgagccaccgcgcccggacaaccactgagatttagaaggcatcgannccactatacaactcacctggtttcttcctctgttggggcccctcgtggccactgttcngttactttttggtcctatttatttaaatggatggtgagctgtttgtcctccaggatccaacacttccaccttcagcttgtattacaacaataccagcctttcaagctactccgggtgaccccagaactcatctgaactcagaagcccaagagtttcattcctctcactttaggggactaagtgcccctggtcagcatgaagtcgatacagaagcatgacctccatccctaatccctcaagaatgaggagtggaaggtgttggcaggagggtgggacgcggtttgtaaatctgtaactgcatcagaccaaatctagttcaacttttttttttctttttttttttggaggggttggaggagacacgacctcttcagggatctcttgaacg

SEQ ID NO: 613511 - DNA, 366 bp, Homo sapiens
  misc_feature (95)..(96): n is a, c, g, or t
  misc_feature (154)..(154): n is a, c, g, or t
acctcgtgatcaccctgcctcggctcttcttttgctggaattacaggcgtgagccaccgcgcccggacaaccactgagatttagaaggcatcgannccactatacaactcacctggtttcttcctctgttggggcccctcgtggccactgttcngttactttttggtcctatttatttaaatggatggtgagctgtttgtcctccaggatccaacacttccaccttcagcttgtattacaacaataccagcctttcaagctactccgggtgaccccagaactcatctgaactcagaagcccaagagtttcattcctctcactttaggggactaagtgccctaaagtgagaagaaacgcaactggga

SEQ ID NO: 613512 - DNA, 135 bp, Homo sapiens
tcaggtcaccactgacactggcagtggggacacggaaggcatgccagtgagcttcccgttcagctcagggatgaccttgcccacagcttgtgctgcgccagtaaggcgggatgatgttctggagagccccgcggg

SEQ ID NO: 613513 - DNA, 454 bp, Homo sapiens
aaggcagaccagactctccaaatcccttttttttattttcttcttaaatttttatttattttttatttttttgggacagagttatgctcttgttggccaggccgaaatgcaatagcgtgatcttggttcactgcaacctctgcctccagggttcaagcaactctgtctcagcctcccgagtagctgggactacaggcatgtgccactaccacgcccggctaattttgtatttttagtagaggaggggtttcaccatgttgtccagggtggtctcaaactcctgacctcaggtgatccacccaacttggcctcccaaagtgctgagagtacaggcgtgacccgctctgcctggtgccagcataaaaatctttgctacaggtactgagacctttttcagcctaataataataacaaccgtaacaataataattagaatataaacctttgttactgg

SEQ ID NO: 613514 - DNA, 203 bp, Homo sapiens
tatggtttagaacccctgttcagctccatagaggaaagaatgttaacctttgtattttaaaacctcattctctgcggttaaacttggttttccaatgctatctttacttgtatcctgcctttggtcccgcccgaaaccgagcttgctctctcacagttcctgatatcttcagaaacatcaaaataaatttgttccctaaaaaa

SEQ ID NO: 613515 - DNA, 130 bp, Homo sapiens
acgtacattaattgcggtgagcatctgtgctgacactgtcaagaacaacccaggatacgggacaagcaggacaaaagaagggttaaaaacctggggccgggtgcggtggctcatgcctgtaatcccagca

SEQ ID NO: 613516 - DNA, 1032 bp, Homo sapiens
  misc_feature (468)..(468): n is a, c, g, or t
ggcctgttcctctttctccccgactccaccccagctccctgtgaagagagagttaatatatttgttttatttatttgcttttggcgttgggatgggttcgtgtccagtcccgggggtctgatatggccatcacaggctgggtgttcccagcagccctggcttgggggcttgacgcccttccccttgccccaggccgtcatctccccacctcgtccgtcccctctcctcagttttgccgacgtgcttttcagtctgagtcgaccatttactccaagcatgtattccgagacttgtcgacgtgactttccgttctggagcaggtggctagaaataagaggctgtgggcaggaaagaaaggctccgtgtttctcatttgtgaggccagcctctggcttttctgccgtggattctccccctgtctatctcccctcagcaattcctgcgaaagggttaagaaagtttaactgngtttttactactgagtgacttgatttaaaagaagagatacaagagatgctggatgctaacttgatacctaaccagtcagatggtacagtatggttgtcgctgtaaatatggtagcggtgagtggtagtggtattgtgcatgccccatactactgaataaactagttctgtgcgggtcaatgaacctgaggcaaaaagagtaacacaaaagccagaggaatggcaaagagtgataactcggagctggattaggatgagacaaaagcgcgcgggtgacaccaaaaggaacccccgagagggaacaacaagacgaagcctgtgatccagaaggctgaacacaaggaccagaaaaaacacccagacgaacacagaaaaaaacgacagagacgcggaagcaacagcccagagagtccaatgggaacgggacaaacccaacagagggggggaacgaacacagtcggcaaacccacagaacaaagtaccagcgcgggaaaaaccacaagacgagagcgacatgaacaaaaaacaactcggagaaaaaacagaacagaacagacacacaacc

SEQ ID NO: 613517 - DNA, 714 bp, Homo sapiens
  misc_feature (37)..(38): n is a, c, g, or t
  misc_feature (176)..(176): n is a, c, g, or t
  misc_feature (274)..(274): n is a, c, g, or t
  misc_feature (554)..(554): n is a, c, g, or t
  misc_feature (579)..(579): n is a, c, g, or t
  misc_feature (586)..(586): n is a, c, g, or t
  misc_feature (593)..(594): n is a, c, g, or t
  misc_feature (602)..(602): n is a, c, g, or t
  misc_feature (609)..(609): n is a, c, g, or t
  misc_feature (613)..(613): n is a, c, g, or t
  misc_feature (616)..(616): n is a, c, g, or t
  misc_feature (618)..(618): n is a, c, g, or t
  misc_feature (620)..(620): n is a, c, g, or t
  misc_feature (627)..(627): n is a, c, g, or t
  misc_feature (632)..(633): n is a, c, g, or t
  misc_feature (647)..(648): n is a, c, g, or t
  misc_feature (666)..(666): n is a, c, g, or t
attttttttattatacccatgtattatcatctaaaanntatttgcaaagttgataagcgaacgatcgtataatgggattgtcaaaacatattttcacaatgcggttagtgctacaaacatgggtgaagaaataaaattatataagctgtagaaaacaagatgcacgatattgatantttaagaatgcgctaattagagaaaacccatgtgttgttgtgtgttttcgttgtatacacaataattagagccacttactgttggcagctgtttggtntttctgttttaacacatgaaggagtgaaagtatttcctatatttatgaatttactactaaaatcttggcaaaaaaagaaaaaaattgtctaacatgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtataaaaanacattctcgtctcccttaccttaanccctaanacctagnntacttttnaaatttncagnctncncngcttttngaatnnataattctaatttnnacatattgttaaggaaantcatatctaataaaggttttagttattcccatgcacagtaaaaaaaaa

SEQ ID NO: 613518 - DNA, 134 bp, Homo sapiens
  misc_feature (3)..(3): n is a, c, g, or t
ggntgattgttgggtcccaatagaggaagtggtgccctctcattgattgagataaccggtgccaattcttttcttgggttttcgagtccttgtcattcattgctttgccatattcgttcagtgtctggcaaatt

SEQ ID NO: 613519 - DNA, 100 bp, Homo sapiens
cagtacaagcatgtgtaagtgatcactttcatatttgaaaaaatgatatgcttcacatcaatacaattactttagttttaggaggaggaggaattcgccc

SEQ ID NO: 613520 - DNA, 567 bp, Homo sapiens
  misc_feature (23)..(23): n is a, c, g, or t
  misc_feature (62)..(62): n is a, c, g, or t
  misc_feature (72)..(72): n is a, c, g, or t
  misc_feature (80)..(81): n is a, c, g, or t
  misc_feature (83)..(83): n is a, c, g, or t
  misc_feature (105)..(105): n is a, c, g, or t
  misc_feature (107)..(107): n is a, c, g, or t
  misc_feature (115)..(115): n is a, c, g, or t
  misc_feature (140)..(140): n is a, c, g, or t
  misc_feature (185)..(185): n is a, c, g, or t
  misc_feature (193)..(193): n is a, c, g, or t
  misc_feature (244)..(244): n is a, c, g, or t
  misc_feature (268)..(268): n is a, c, g, or t
  misc_feature (272)..(272): n is a, c, g, or t
  misc_feature (294)..(294): n is a, c, g, or t
  misc_feature (301)..(301): n is a, c, g, or t
  misc_feature (325)..(325): n is a, c, g, or t
  misc_feature (352)..(352): n is a, c, g, or t
  misc_feature (367)..(367): n is a, c, g, or t
  misc_feature (376)..(376): n is a, c, g, or t
  misc_feature (381)..(381): n is a, c, g, or t
  misc_feature (383)..(383): n is a, c, g, or t
  misc_feature (404)..(404): n is a, c, g, or t
  misc_feature (418)..(418): n is a, c, g, or t
  misc_feature (439)..(439): n is a, c, g, or t
  misc_feature (474)..(474): n is a, c, g, or t
  misc_feature (493)..(493): n is a, c, g, or t
  misc_feature (504)..(504): n is a, c, g, or t
  misc_feature (543)..(543): n is a, c, g, or t
catggagattacatactggtganaggaatagaataatatctagcaatagcttggaataatcngctctaaaanatacccannanctttttaaccgcatttttcaanancagcaccnctggtttccttaattttttgcagtnttcttccagtaatgataaagctcggtcagtatctgtcttcttgantggcattnttgggtctttccactgccacaggagttaatatctcttttcaggtctcagtntgatccagcgggattgaggccaanagcnaggaaactgtagcaaaccactncagtgtncagttttgaaatccaggctgagtnttcccctcagtaactcagaatccagcntgctgtacctatcanttttttctnctgtncnctccaagcccccaggcttganccttaatgcccctntgattctgatcctcccatgtnttaaccgagaggattgaaaaaaaaggaaagcaatnccttggcatggagacattnaagtgacagtnctactcaatgggcacttgaagcaggaagagtaggcgaanagaattcttcacactggagttatt

SEQ ID NO: 613521 - DNA, 334 bp, Homo sapiens
aaaatgaggtatttggctaagtgtcccaaccagtagaggtttggccaaactgcagaaatggtatagtaagtaagaaaatgaaagtgaatacattgaacctataacacagaaccaggatttcacaatatgcatctctaaaagcaaaacccagcatgatttcttcatagggcatacatttctattcagaaaagaccacagatataaagaggtaagttaatatgagaaaggtaaagactctaagatcattctttttgcccctttccacaccacatataaaaaaatactcattaaggggccactatttcccgcgctctcatattatcatagaatatat

SEQ ID NO: 613522 - DNA, 504 bp, Homo sapiens
agcggggaacaatcacttgacattatttggcctcagtatccctgaggcatgaaaactccatcctctttttcccggttggctggtgtggttggatgctgttaaaggaactaaatcttctggtctgggtagtctcccacatgtgggcttgggttaagggcattccaataataacagggtttagtacgtttccctttctccggtgtttcctgggcatgggtacttagagcgggaggtggtgcagacttagttggcattctttggtactataatcaggaggtgcataaggtcgggtggtgtctctcttgggatgttatcagctatggatgatgatggcttaggtcataacaagcaccttggatgtgactgtcccatgccaaagctaccaaaaaaaaaatacattaaaaataatgaatctgagaggtggggtatgttaccggttcagtttaaggtccttatgattacaagggagagcaattccgtggggttgggccaaaggagggcagg

SEQ ID NO: 613523 - DNA, 1984 bp, Homo sapiens
gaagagaccatatttgttcgcagaggaagccgttgctttctgggatctggctacggcagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggttggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccc

SEQ ID NO: 613524 - DNA, 458 bp, Homo sapiens
  misc_feature (433)..(433): n is a, c, g, or t
gactcttgtatgctcaggtcttgtcatgccagggcagaaaaataaacctatccattagggcaccaactaaagatatgaaaaagttataatcttataatctgatactctctagagattactgtagccaagatataattcatgattcaatctgcactcaaaaaaacaaaagttaggggtgaaatctagtataaagcattacatttttcctttgaaacaatttctctctagccctccttttctattaaagagaaattgtagtaagaccaatttgtgtgcaaaataagttctaagcttattatactttgcctgatgatttacataaagtgcagcaagaattcattgactatataggctcttaagttggctttgttggaactttacctaaaaatatgctattctagtgaaagtcttggtaaaataaccagtgtctccnactgttttgttctaaaagactctta

SEQ ID NO: 613525 - DNA, 184 bp, Homo sapiens
ttttttagcccatgcccttccccgggggggggggggggcggggggccctcactctccaagccccttgcttgcatttttttttagtttgggcggcaagtaacccttttcctccccccccccccaccccccctcaatgttggggccttgggtatcctttttttttataaagacaattcaccccgca

SEQ ID NO: 613526 - DNA, 177 bp, Homo sapiens
atcccggcgagtctaatgcggggagcgccgcctgtgatcgcggcaggtcatattgaacattccagatacctatcattactcgatgctgttgataacagcaagatggctttgaactcaggatcaccaccagctatttggaccttactattgaaaaccattggttacaagccgggaaaa

SEQ ID NO: 613527 - DNA, 559 bp, Homo sapiens
  misc_feature (198)..(198): n is a, c, g, or t
  misc_feature (231)..(231): n is a, c, g, or t
  misc_feature (242)..(244): n is a, c, g, or t
  misc_feature (246)..(246): n is a, c, g, or t
  misc_feature (322)..(322): n is a, c, g, or t
  misc_feature (332)..(332): n is a, c, g, or t
  misc_feature (415)..(415): n is a, c, g, or t
  misc_feature (521)..(521): n is a, c, g, or t
  misc_feature (539)..(539): n is a, c, g, or t
aacatgaggcaaggccgggacaagtacaagaccctgcggcagatccggcagggcaacaccaagcagcgcatcgacgagttcgaggccctgtaacagacaggcaaggaccaagcgcagaggggtgctcatacagggcgctgccagccccgcaacgcttgtggtctttagtgctccaagtctaggaactccctcagatcncagttcctttagaaagcagttcccaacagaaanattctgggctnnnanccagggaggcgccctggtttgttttccccagttgtaatagtgccaagcagggcctggatttctcggcggattattncttcggaatncaccttcctgtgttgtggctggggagcagggactggattggaatttacgggtgcctgttaaagttctggagttaagaaacttncatggctgggcctgtgtgattacaagagttcagcatcatttaaagggaaacgtgggcaggactttccatctgtgccatacttgttctgttattcgaaatggagctncaaattgatttttttttnctatggggattcctctttgt

SEQ ID NO: 613528 - DNA, 760 bp, Homo sapiens
acactgcagcctggatcgagaggagccggtatctggagaaggagaaggacctggcagagaacagggcctgagtctactggaggagatgtgaccatgagtttggtgtcagcactctggctggaggaggagtgtcgggacagaggcggcaggacctgattcagtgcccgggacctgtgaggggcctcgagccgctggagacatgccagtgggattccttccgactaaggggagagcaatgattcttaccctcatggactaatggcgtgcttgcagggaggaggagggacgtgcttggtgaagcgtgaacctgggggatgacggagcgggaaggatgagcatagtgtggagctagtgggaagacagaagccatgaactatgcgtgtgcttatgccgatggagcggagagctgtggaccgaaacctgagacgcgagacaaatagaccatcttgtctaatgccgtgtccagagttactgaactacatgaaggcgttgactgggaaggcctggccatgtttcccttcccggctttggacccgaggggcggggaacggcttgaatggcccgtgcggggaacgggcaagctgggccagggagcatcccggggggccagagcgcttggcgggcctggcaggtctcaaagacccctggaagcaccggtgcgggcgccccgggcgtggacatcccgacatacgtggacgccaggcgggagattgggcaacctccaaagaacaagccgaatggggaaggggcgaacgaagaa

SEQ ID NO: 613529 - DNA, 283 bp, Homo sapiens
  misc_feature (2)..(2): n is a, c, g, or t
  misc_feature (16)..(16): n is a, c, g, or t
  misc_feature (89)..(89): n is a, c, g, or t
  misc_feature (137)..(137): n is a, c, g, or t
tntcaaaatgtacctntgcactggaagtttttaccccaattttgagggatttttccagatttcagaaattatagttaatgtcatatcantcgtttaagttacatttttacctccagtcattttggctctcttttagntcgtttttatagggatttgtaaaattaaaaatgctttgcatgttttactttataccttaacagggtttattaagggaactccagcaatgttaaatagacatgttagatccactaccccaagtgcacttaaagtgtgatataaatgg

SEQ ID NO: 613530 - DNA, 887 bp, Homo sapiens
ggggcagaaccagtctccgcaaaactgacccctacccatcccagtgtcaaaggagagaaggaggaaaacatgcttgagccatccatttctctttctgaacctctaatgttagaagaactcagagaaagaagacatagaagacttccctacccatagctattagcccctgaacctcaagattctaaatttagtagaagaagagatcgtagaacttgattacccagaaagcccatggtttccgagaagaccttcccagcacgatatgtcccctgaagtggcgcacagaagaagaagagcttattctagacattatggggagcatcatctcctgaacatgtgcttgtctgaggaacgagagagaggaaattgatctgtttctactggttctgcttcttgtatcagagtattcagtaccacaggatttgaacccatgaattacaggagcaagaaggtgagccagttcccccatccaatgtagaagctatagctgaacatgcagtttgtcagcagaagagaagtgaggaattgaggctaattccccagctatggccctacatctgagagctctctctcaccatccgaccaagtgagaagacttctagagaacgcagtctccactgtttcaaacaagttaccccagaatacatggtcctatcaggagacgatggctcagaaagtggggtgttacaaaccaggaattcacatcgtggttctgactcattcagttcctccatggcacaactgagtccctgtagacaagatgccccgaagtccccgtccatattggaacggggtccgagtacggattcatcaaaagacacgagactgttctaaccaggggaccggttgagactttttaaccaacgaaatgatgcgacaggtatctg

SEQ ID NO: 613531 - DNA, 337 bp, Homo sapiens
atctattttgacgctgaagcgcgggcccagagccctggacaaaattttccttgttccgggatggggtagaggacaggttagcaatgttgctagagtaatggacagtacatgacacagtggttagagctggaagcttgggtcttatagtgccagggccctggttgtaaacatgccaagatcaaagagagtgacttcttcaaggtgaagcagaggcacagcccagatcagaacttggacttcctggcctacatgtggccacggatagaactatgaagttgcatcctccattccctcatccacgcaaaaattttcctttgcaatttggccactggaggtg

SEQ ID NO: 613532 - DNA, 243 bp, Homo sapiens
  misc_feature (29)..(29): n is a, c, g, or t
  misc_feature (34)..(34): n is a, c, g, or t
  misc_feature (44)..(44): n is a, c, g, or t
  misc_feature (60)..(60): n is a, c, g, or t
  misc_feature (62)..(62): n is a, c, g, or t
  misc_feature (228)..(228): n is a, c, g, or t
  misc_feature (241)..(241): n is a, c, g, or t
gactttgaggatgatcctcgggccctggnctggngcacctgtcngttctgtcagcagagngnctaccagctgcagggcagatgaaccgtgccgtctatgaggacaggccccctgcagcgtggtgccacgtcagcagcagaggcaagtcgggcatgcggggacacgtcactgagcgagaactatgcctttgcggcatgtatcatgtttttgaccagcacgtggatgagncagtccaagggtncg

SEQ ID NO: 613533 - DNA, 463 bp, Homo sapiens
  misc_feature (281)..(281): n is a, c, g, or t
  misc_feature (283)..(284): n is a, c, g, or t
  misc_feature (365)..(365): n is a, c, g, or t
  misc_feature (380)..(380): n is a, c, g, or t
  misc_feature (406)..(406): n is a, c, g, or t
  misc_feature (417)..(420): n is a, c, g, or t
aggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccccttacgcaacacataaccctactgagggagggccaccggcagccacctttttatttctcttcagggtggacaagttnanngggtgtcttgaacactgtcccaaacaccgcgcggtttggtggggacagggggttgtctgcataacaagctccccattcggnagaggaggaggggangggtagcaaaaagaaaaaaataaatnttccctgtgtnnnntattatgatttcgctcgcaccatcccactccccaaaactctcc

SEQ ID NO: 613534 - DNA, 381 bp, Homo sapiens
cttgtagtcatccggataatcacgttttcccaggtgaatcgctgctttccaggaagtgatgggcgtaccgagcatttcgtaccagccggggttgcggtagacgaaaccggtgttggcgttccagtcccagatcccgtcgctgaccagctccatgatggcgtgcagcatgtcggcgttgaggtcggtaaagtcgctccttgagggttcttggccggatgtatcgtccattgcgtgctccttgcgtgggctggctctcatggccagttactgttgacgccgatactccgtggctggcggtactgtacaacggcgctttggcgctaagaaaggggtgctttggtctagctggggttgtggcctagggcataacaccacacaatt

SEQ ID NO: 613535 - DNA, 219 bp, Homo sapiens
  misc_feature (104)..(104): n is a, c, g, or t
gtggagagccagcggcgtgtgacacataggagacatcaaaagcggttgagactattatcaggcagcgaaccgtcatcgccttctatgagacacgtgcattgtgncaaggtcaacgctgagggctccgtggacagtgtcttctcccaggtctgccccacctggagccctaaagtaggaacgctggagccgcttcccaggtcagaactcggcccaccccgt

SEQ ID NO: 613536 - DNA, 487 bp, Homo sapiens
tcgaagctggcggttggcccacggtgtctgtcatctcaaggctggactcagttgagtgtctttcggacgtgtcgtttcctcagtgtttcaagcgtcaggtcccttgagttgttcctgttaacatgtggggaggactctggtttctcttctgcgtgggccttgtttccctagtgcgattggctgggccccttctgcaggcccggcctctctagtggtccctgtgctttcgcctcagtcctaggattggctgggctccctccacaggctccgcctcctacgtggctgctgcacttcgccccagtcctaggattggctgggctccctccacagggtccgcctcctacgtggccgctgcaattcggcccagtccttaggattgtgtgggctccctccacaggctccgcctcctacgtgtgcgctgcacttcgccccagtcctaggattgggtgggctccctccgcagaaacccccaaccgggcatcttcag

SEQ ID NO: 613537 - DNA, 368 bp, Homo sapiens
  misc_feature (61)..(61): n is a, c, g, or t
gcagagtgtccctgagacagttgtgcacgaacacaccaatataaagctctagaatagcagnccagacgtttcgcgggtatgtcctcacagtcccattccctagatggactgcctccagttctgttctctgcctggcccatctctctttcccttcaggcaagagagagatggatggatcagactgaaaggacaggcatgctgatctccagcaagcaggggccaggagaaagtctcgtttgccaacacttgttactgaagcgcagaaaaagcagcaagtgacagtcacaaagtcttcctgggtattcttcataacgtacagtctatatgcgcaggaacgaagaagctcctgggggaggatgatggccact

SEQ ID NO: 613538 - DNA, 1089 bp, Homo sapiens
acgtactcgtgaatttctttggcaggaagggcacagtgcttattgctaccatggcaagaggcggcggaagaggtcttgcagatacttgacttcatatgctccaggtcatctgcacgcaactcctggacaaattcctgcttgtctcacaaggcaagcaaagcacggcacaaaggcaacaaattctgcaggcaggagcactatcacacactacacatagcaagcacttctatcatctcgctagctggcaagagctactccacgggcaggcaaccactccacatcacttccagagcgcagcacattcccttccaacaactgtcctgccacatcgtctctcatgcaagatccaacagatacccaggagcagacgcactttgcactatcacaaactcctggcggcctgacaaactcgaacctatatggtgtatatgaccatggattcatgcgcggacaacacaatgggcgtacaccgtcattaaccatccaccgatagtacacaatgtagtacacggctgatagacttataaccattagtcggccattcagcaaactgcaactaccctgaacgaacgaccacagaaacgcacattcacatttggcaaccattggcacacgactatacttcgccaaccgcgactttacatccaacctgatttcaccattcccgccggtaaaaacgcttgaatctacgaagcattcatcattcactcccaggaaagagaaaatacaaactccacctgcgggaaggcctcaacccggccagtatccccacacgaacaccacctggcaagcgaaggggcgccagagctcaagcacatgcaaacgagcatcggtccgggacatcgagtaaacccccatccggacaaccacaagcacaacgggccacgtcaaaagcagcccagacgcgcggaaggctccgacagcaacgcccgcgcacccagaaacctcagacaattatcacacagacatctttagggaacgaccccatacaccggagaaccacaccctttgagcaccgaacgggcctgccacggaacggcacaccaacagctccctcctagagtcactgagtcatcatccaaacgcgaa

SEQ ID NO: 613539 - DNA, 374 bp, Homo sapiens
  misc_feature (55)..(55): n is a, c, g, or t
  misc_feature (213)..(213): n is a, c, g, or t
  misc_feature (290)..(290): n is a, c, g, or t
  misc_feature (360)..(360): n is a, c, g, or t
  misc_feature (362)..(362): n is a, c, g, or t
gccagaaatatttaatttcaaaggcccaaaagcagtgcctttgtgcctttacctncccatctccctagtaatggcctcagaaagacaaggaaggccggcgtaagttgtcccgcctgtaatcccagcacttctggaggccgaggcaggtggatcacctgaggtcaggagttcaagaccagtcctgcccaacatggcgaaaccctgtctctactnaaaatacaaaaaattagccgggtatagtggtgcatgcctataatcccatctactcaggaggctgaggcaggagaatngcctgaaccaggaggcagaggttgcagtgagctgagattgagccactgcactccagtctgggcaacaagngnaaaactttgact

SEQ ID NO: 613540 - DNA, 411 bp, Homo sapiens
  misc_feature (49)..(49): n is a, c, g, or t
  misc_feature (213)..(213): n is a, c, g, or t
  misc_feature (355)..(355): n is a, c, g, or t
  misc_feature (368)..(368): n is a, c, g, or t
gaagaaagcaaccccaggaagcctggccccgaagactgtgaggtatggnggggccttgctgtgctctggactggacaagaggcaccctgggctctggacacagccagatcttcagccaattgcatctccggcccagggcaggccctttatcttatagcccagtggtgcctctctcctcacctaggaaacaaagccaacaggatctgcaccacntctgcctcccggacattggaaggactaaataagatcagagacctcattcctagatggaacgaggaatggtagcgaccacgatcctcccctcccaggatctgcgccacaagggaagatcagaaccttcagctgccagaagcantgtggcggaaatntaggtccccatccagggttgattttgagtttgggttttttggg

SEQ ID NO: 613541 - DNA, 548 bp, Homo sapiens
  misc_feature (19)..(20): n is a, c, g, or t
  misc_feature (60)..(60): n is a, c, g, or t
  misc_feature (68)..(68): n is a, c, g, or t
  misc_feature (75)..(75): n is a, c, g, or t
  misc_feature (180)..(180): n is a, c, g, or t
  misc_feature (212)..(212): n is a, c, g, or t
  misc_feature (340)..(340): n is a, c, g, or t
  misc_feature (345)..(345): n is a, c, g, or t
  misc_feature (356)..(356): n is a, c, g, or t
  misc_feature (367)..(367): n is a, c, g, or t
  misc_feature (495)..(495): n is a, c, g, or t
  misc_feature (542)..(542): n is a, c, g, or t
taaaaaattccaggcgggnnaccagttaccatttaagtccaataaccccaaggattttcngatggggnggccaanatgtaggaacaattgttcaaacagccccggtgaaattcaacagccagcattagcatgggaatggccttttcaggcatcagcccagtggattgttaaccacaaccntgccaacttttgatagtatccgcatgtgagantcaaagcaagaactgccagggggagcatttcctgatcctgacccacaaaatcctgagtgatgtacaatggttgcttgaagctgccaagttttagggtaacttattatacaacatagtaaccagagtgnttacnttccccttccntcccttgccantggccggaacacagatgaggccatggtgggctgttttcagtcctgtaaatgacatagatgagggcatggggaagccacaaacgaggagcctgggtttttggatgccctcatggagcacaactgccaantccccacgtgccactcacatttcatgcaagagaaataaatttccatnttgttt

SEQ ID NO: 613542 - DNA, 107 bp, Homo sapiens
gttacctcatgtcgtgcgttgctgctatagaaagtttgcctatctggggcgcctggtcactgaggttggctggaagtaccatgtgcagtgacatgccaccctggagg

SEQ ID NO: 613543 - DNA, 188 bp, Homo sapiens
  misc_feature (46)..(46): n is a, c, g, or t
  misc_feature (135)..(135): n is a, c, g, or t
  misc_feature (150)..(150): n is a, c, g, or t
  misc_feature (153)..(153): n is a, c, g, or t
  misc_feature (158)..(158): n is a, c, g, or t
  misc_feature (165)..(165): n is a, c, g, or t
  misc_feature (167)..(168): n is a, c, g, or t
gttttggccattcgttctccgttccggccagttcttccggtgtcgnggtgaaagatataggtttgctgacaagcccggatgctcgcttttttgctctgtcggcccgtttcgagcctttctgcatcaaaggcctgncgctggtggtgccgntcncggtnaacttgngnngaacatcgctgtgggcggct

SEQ ID NO: 613544 - DNA, 785 bp, Homo sapiens
  misc_feature (426)..(426): n is a, c, g, or t
  misc_feature (454)..(454): n is a, c, g, or t
acgggaaaacaccgctggggggtttattgagggagaaacgccacacacagggagagacaaagcactactcggtcgtcctctttgagacacaccgctcaggagtcgcgacacccaacacagtgaggagtgagagaaaaagagagatattaagaagaccttttttttgtcacactctgacactctctcttgtagagataaaaccggtgctctctctctctgcgtgttgagatcgcccccgggtagtcttcttaagagaagtgtgagaatagtgtgacacacaaaaaggagggtgttgggctccccccatatgagaccctttggttttggcgcacccagcgcgcacgtttttatatattaaagaaatatatgtaggggtttataagatatttagaagaggctccccaaacagattagatttgttgccanaatatttgcgagagagatatttgttcanagagcattaatattagagggtaacctttagcgtttagtgatctccacataataacagcgccattgtttggtgttctttttcaccaccaaatgaagtggtctatgtgtctttgcgtgataaatccaagtgccattcgccattgtggtgtctgtaaatcaaccagtgatgttgtgatttgagatgttgcgttagaatgttgtgactcgcccggccctttttattggggtttgaatattggagaaggggcccaattgtcaccccttttaattgcttttaaaaacaaaggtaaaattttgccccattaaaaaatcaggattaatttaacccttta

SEQ ID NO: 613545 - DNA, 138 bp, Homo sapiens
ccgtggatatttggggggccagtatggctgcgatgaggcatttcttaggacaccttggattataatgaaaacaactactctctgagcagctgttcgaatcatctgcatatttatactgaatgagttactgtaagtacg

SEQ ID NO: 613546 - DNA, 920 bp, Homo sapiens
  misc_feature (1)..(1): n is a, c, g, or t
ngacgaccctgtgcctcgcatcgtgttcatgggtgcgtcgcactggtgttgcagaacacagttccgccgtatgccatgttcaccgtgagcacattgattgccatggcgccccgttacaatcctcgcattgtctgggcgggagtttcgccggcacccttctgtgtccctcgatgttgtgtcggcagcagatatttggcgtggcgactggttggtaccccacccccgcgaatttgcggcgtcctcacatgtctcgtgtccacccgtggcgcccgttgactccactgcaagtagagtggttgtaggcgccgctgtcgtggtttttcccaccacagggctgtgagccttcgtgtgttggctggagtattcaacagcttccaatcaccttccggccaatcactcactatcagggacgagttagttcactcccacagtcgctcatgtatccttctcaatcacagctattatcttcgctacatgggattaagaaaaatctgcgcacttattttgtgccccctgtgagtagcaccccccgcggtgcattattcccactagatgtcaccccccctttcttgcgacaaaactaccaccctttcggaccacaacactcccccactttggagaaaagcacaaaccaccaccccccttggaggaaccccacacgctatgaaacacatttcacaagccccttccacaaggacatactcggtatcttaaatagcccttattctgcaacaaaaatgaaaaataacttactactccttctgcaccactatgagccatgcgcagaacactcacagtctcatattaagtaacacgaagaccccccctttgaaacacccgacccaactcattatctcagagagcatttatttccccgcacccttccaaaaaccccttgtttcccaagaacccacaaaaca

SEQ ID NO: 613547 - DNA, 926 bp, Homo sapiens
  misc_feature (633)..(633): n is a, c, g, or t
agcgggggactaggagcgcggcggggccggcggcaatctgtccgtgctgcgcggtgtgcccggggggcccgggcggcagggcaagcaccgctgcctcggcctatgctgaccggtggcgccggcgcggcttctgcctggacgaggattcacaggatgaccaaccgaagaacctcttcccaagaacggttcgatctgaagttgaatacagaccttcgataacgtgtatggcaatgacgactgaggttaagtctctaaggaattggacagacaattactgacacgctatatgctacagaaggcttctgtgcacgggcacacgtagctacatgtatactttaatctgcataactgcatagtaacctggacctgaagcacgagatctgactgaacaagatctaatagctaactaacaagtcaggagtcttgcacgccagggaagaacatccttgtaattgcgacttagtcaatccaaggtaacaagaagatgtcaaggagtgtactactcatgatcctgtacctcaagcaagtccagcagtccgagcgttgtccaagctgtagatcagcaatgttagacccaggcgatcaaagctttgatttgttactctaagaacacacttgaagaggttgagactngggaagcagacttacagatcgaactggaacaagccctgactgaacctgagttgcctgggaagtttacgccttgatagcgtaacacaaatcatactccccagtcaaggatcttccctgacaggcgcactacgagaaagctgtggtgggacaggcacagtactcgtttccacaccaagactcagactttttgaagccaaaaccaagcccacattcttacacttgtccagcttgtaatggtcaatgtaaaacttacccagatgaacccttgtgtttcaagccttttttcttttccc

SEQ ID NO: 613548 - DNA, 130 bp, Homo sapiens
tggcgaccttgctcagaggtggggctgggatcaggtctgagcgtggagtcctgggcctgggcatgcagagcccccagacaggtctaggcccagccacaggagacctaggggcatagatttcagggccgag

SEQ ID NO: 613549 - DNA, 541 bp, Homo sapiens
atggctgctgcaaatacttattgcatgaagaatagatttaagataaaatagacttcccagagaacagcttccgctgcactacactgaatacatacacgcataccaaggtatcaaagtagctgattacttcttgaggtcacagtaaaaattaagatcaccgataaagtaagattggaaattgttgatttgaggttgaggaaataggggtgctttgctttattaaggggaggctccccttgggaattgctgcaggggttttggtgatagcactctccaaataaaacctaggggaagagtttggagaagaaactgcctgtgtgagaagttacagcttgataatatcttattgttgtgtccaggaaaaacagcactggaggcaatgtttctataaatcaaagaagagacagtgtgagaatgtcagccctcaactggaagccgtttgtgtacggggggctggcctccatcactgctgagtgcggtaaggacctgagggtggtggatcacgtagcctgctgtatgtgatggctcaccgcagggtacc

SEQ ID NO: 613550 - DNA, 673 bp, Homo sapiens
ggtattaaatgattaacaaacatgaaatgtttatgacagtacctgatatgtactaataactaaatatttcctgttatcattttcattacacgtacatcattagtgcagctttataaaggaaatgaacgtgtgacccaagaaaactgtgttttcttcttactattacggctgtacatagatatgctgaaacactgaaaattactatggattctactttaaagaaaaaagagtgggcgatactgctgattgttgaaaccaaggaacagggtgattcaaagtaatagaatcagtagctactaaccaaccttgtgatcatgtgacttgacgtatacatgactaaacaataagaaaccaaaactagaaggtggggcaacgatgacaggatgcatggtaacttattctcttcggatgtacggtaggaaaacactccgttaactctgcacaaattgaaaccgcttcagtactctcgtcttccaactgaaatgcaacacctcttaatgatctcgtatatactcaaagaacatctatctgatgtatggagggtctcaacatctccacaggtactaattccatcccttaaactccaaatgtaagatcatagtcccattctaagggatacatttggctgttctctgagtatctgtcaagtggttacagaaatgtcacgctcacg

SEQ ID NO: 613551 - DNA, 140 bp, Homo sapiens
gcgggcgccagagaccagtccttctctaatcactctataattatgctgtatgagctgataaatactcagcactgtgtatgtgtctgcatagtctgggtcttgcactgtaaagcattaatcatcacagcaggctcttaagg

SEQ ID NO: 613552 - DNA, 796 bp, Homo sapiens
tggaggttccaacttaaacatttatggcacaactcatttcaggccactgttgaccatcccaaaacacagcctagtaacacacaacttcaccttcaaggactgcacgagatagaccacctatatataaataatcgtcgtgggaaacgtaattggggtcgagaaaaatatgcaacgctagagaacttggcgacgaatatttaggcctaagttcagaagcttgaaaatacagtgggcctacaatctcaaatttcacccaataaccgtggcccttagtcaccacgactttccataatcttttaacctctgcctgtacttgcccttaacagtgcagctctctcaactcccttgcctctagtagacttcctcttcccatagtcctacaactttgtgcacgggagcattttagcaacagcctattgcaaaggcgtccaaagtccaactgacccaatgcattactccagaaatttataccaccagggatgctttcactatttcaaactcacttgacgctgatatagcatacaactttaaacaccaaatgccttacacaatagcggtagctggataccttcaacactacggtccacattaaaataacccattaaaccttggtttccaagaccttttcactaaccaggtacgtccactatgctacctaacaggcatttatgccccggcgcaaaccaaaccccgtgtcacgagtaaagaccgcttagttgtttacctcagcaatcctaaacccatctccacactggctctacgagtcggtccccttcaaaggaatcttgacatctcc

SEQ ID NO: 613553 - DNA, 360 bp, Homo sapiens
atccccttgggtactctctaattggatgtcctgggtcctcccagttcttagtcctttaatacctgtttttctccttttcttatttggacttgtgtcttctgtttagtttctcaattcgtacaaaactgcatccaggccatcaccaatcattctatatgacaaatgctccaacaaccccacaatatcaccccttaccccaaaatctttcttcagtttaatctttcccactctaggttcccacactgccccaatcttcacttcaaagcaaccctgaggaaacattgccattatcttctccatattcaccccccaaaatttttcggccggccccaacactttcaccaccattttgtttttgtt

SEQ ID NO: 613554 - DNA, 150 bp, Homo sapiens
tgcttgacgcgcgcggttagacggaaaaacaatgtggtgttgtgaaaatctagaagggagtcatgactctgacctctgctgccacagggcttgggtctgctcctcagccggcacctcctcccctcctggggcctggtcctctggctcatt

SEQ ID NO: 613555 - DNA, 1134 bp, Homo sapiens
ttaatcggccgagggatggcagtgatgtatcacagaaagtctccgcaccagacatggagtaccatcggacttcctgcctcggaagcgcagcagcaggcatcgtgtggaagtgtgaatgagcttccctaatggatgacccatccaagccggtccacctcacagcctatcctgtgtgatacaatggctggcatgactcacatctgtgctgggacagtcgacagtgcctggtgatccaatggtgaaacaaagaatggaggtggtggagtgcttgtgaccatttgtatgatgacaccacccatgtgtggatatgtggagcattatgttggtgctactgtggaaatccctctgatggcctccgtgaccttcaatgactgtcattttgcttgagcacatcatgtgatgaatgcaagagtgcgtttctataagaattggccatacactctaacgcacgaacggccgtattaccaagttactgcacacgccacatggcaggatgaggcatggccaagaccgcagctggagcaaggcacttcagcacgcccatgaagaatgtactgccaagtcataccgtgtcattgcccacacccaggatgcgcctgcttcctcatggcgcaagaatcaacgtgcccacctgatggagatccagtgtgaacggatgcacttgtggccgcacgcagcctggcctgggccgcggctgaggcagtgcttgcagcactcaggtccctgtgacccacgtgttctggcgccggctgcgctgcttcggcgtcctcgcggtgccccgggcccagggctacacacggtgtacaccggtcgactggcacaccaagactgctgaccacgcaagacgccacgaatgcctgcgcacggtgcctgtacttggggcatgcaaccagcagatagtagcctcatgtgcaacccatggccccaagggctacctgtccccgccttgtgactcccacgacacttatacggattgcacagtggaagcaaaccacggcacggatgtaccgaaaacttgaccacagacatatgtaataatcggcaaagcgccaacccctggctgtatgacccaagtgtcagacccaagaatctatactcagacgttttcggtcagaacgtgtaccacaacacttg

SEQ ID NO: 613556 - DNA, 932 bp, Homo sapiens
gctgtcgtggtcgggtcgcggactgcgctgttgtggtcgccgacgttccctgggaagtatgaatttccctaacccaacccagtcctggtcgccgtccatccgctgaacgtgacgatgagcatctcagatgaggtgtcctggatttcctggttctgtggagctccgtggcaaatgaattgcttcttgtgaagttggatgaagactatgtccaggtcaaatgttagtctttgctggactcagatgagcgaaggtccctcaactatcagagatagctcatagacatgatccgttggacctggagcttgatgaagaactggaagcagaacccatgcagagggacctgatggagcagcgtggcgagatgctttatggatgatcgaggccgcgtacattcttaccaaccgtggatcgtccagatgtgggaaaagtaccagcaaggagacttggttactgtcctcgtgtgtactgtgagaagcaggcaaatgctttccatgggtgctttcagacatcccaggtgaaggcatgggtgaaggctctaatgcccaagtgatggatgtgtacacagcccaagtcatcaagaagcaacacaggggatggggcctacttcggcactggttttcctcacatgtcttcatggtgcttccgagtacggccagaagactgcaagcaattgtgccagtctagttccagatcatcgatggctacaggtgggtcagcgggagagaattagaacccagttaaaaattggtgattcctcccacttcggaattggattctttttgcccttaggaccgttggttagttatacggccgtgtgggggacagctgaaagcgaaggggaaaaaaaaacagggcttgggtgcaaagttatgagtctgtccccttatggatgtgcttgttatggttatatatatttggtaaagactatttat

SEQ ID NO: 613557 - DNA, 320 bp, Homo sapiens
ttaccaactctttcgttttacttaattctgtaatacttattattattattagtttgatctattacggaagacaaaggaagggaatgatctttactcaagaatttcagcaagtcagcactgaagtcctgacctatcagtagacacatttgtccctttcagatattttaggatattctagcaaagcaggccatttctcccagactgaaagtacataacttctatcacttgccaaataattgcaagaactcacattaagcggttactcagacagtaaatcatagcaaagattcttagcttcatcagttcatagaaaatatctg

SEQ ID NO: 613558 - DNA, 404 bp, Homo sapiens
aaacatcagctggggtcaaccgcgggcctcgagcccgagtgggtgagggctgttaccttcaaacctttgaatcccacgttttccccttgacttcctgtccccgttaaaaaaaagtggacagcgtttcggtcccaaagttggagaaaatagtgcagggccttttcagggagagcgttttcctcatcaaagcaaactgcaaaatcgcttttgccggggtggacctaataaaagtcggtcgtcgtaagggaccccctttgttccctaacgtccccccctgcttttttttaaacgctcggttggcgggaacccctgtgccagctgaaactccttcagtttggccccctaggaaaccccaaaagtcccctacatgggctgggtgggcaataaaaacgggaaaaaatgta

SEQ ID NO: 613559 - DNA, 292 bp, Homo sapiens
  misc_feature (36)..(36): n is a, c, g, or t
  misc_feature (60)..(60): n is a, c, g, or t
  misc_feature (69)..(69): n is a, c, g, or t
  misc_feature (105)..(105): n is a, c, g, or t
  misc_feature (142)..(142): n is a, c, g, or t
  misc_feature (145)..(145): n is a, c, g, or t
  misc_feature (159)..(159): n is a, c, g, or t
  misc_feature (165)..(165): n is a, c, g, or t
  misc_feature (173)..(173): n is a, c, g, or t
  misc_feature (230)..(230): n is a, c, g, or t
  misc_feature (233)..(233): n is a, c, g, or t
  misc_feature (261)..(261): n is a, c, g, or t
  misc_feature (273)..(273): n is a, c, g, or t
  misc_feature (281)..(281): n is a, c, g, or t
tgccctcccttttgccccctggggagttggggaaangaaccaaccctggctggagggganaggagggcntttaatttatttctttttttgttgaggcttcccccnctttgagccagttttcattttttcctgggggcattanccnctccctgcctctcnctccanacctgttnccccaactggggaggtaggctgggagcaaaaagaaagggtgggacccagttttgggnggntggtttttattaattatttggataacanccaaaaaactgnaaataaanagagagagaga

SEQ ID NO: 613560 - DNA, 289 bp, Homo sapiens
cagagatgatgccactgcactccagcctgggcgacagagcaagactccatctcaaaaaaaaaaaaaaaagctgctgaattcgggcagcgcttttaaaatcccgggcccaggtgatttcgtaactccgtgggcacccggggttagtggcccttcataggccctgcaataacccttcttcctcaatttaagcacttgggcccattgtctctcacattctcctttacccatttttttacggggccggtggtaagagcctttcacctagggaaacagtacaaccggggggggg

SEQ ID NO: 613561 - DNA, 166 bp, Homo sapiens
  misc_feature (6)..(6): n is a, c, g, or t
gactcngtaggatcccggaaatacctggattcaggcagaagtgtgctacaggggcagagcctcatggagaacctctgctagggcagtcgcagacgagaaactgtggggttggaaccctcccacagagtccctagtggggcactgcatagtggagctatgagaagag

SEQ ID NO: 613562 - DNA, 260 bp, Homo sapiens
tcacaaggacaggcacggaggtcaggctgtaatcccagcacttgggaggccagagctgcggatcacctgaggtcaggagatcgagatcagccatggccaacatggtgaaaccccttctctactgaaaatacaaaaattagccagacgtgatggcacatacctgtaatccaagctgaccaggagctgaggacggagaatcgcttgaaccctgggatttggcggttgcagctgcgccgagactcactgccactgcaacctcc

SEQ ID NO: 613563 - DNA, 824 bp, Homo sapiens
agcgggtggtgctgctggcgctaacgggcgtccgatgcatccagcgctgcgtcctcgagtccctgcgccccgtgcgtccgtctgcggacccgcagcgaccctccgctgctgcgtggattctgctgcgagccggacagcatggtgcatagactcgatcgcaaggtgccaagctaccggggctccatgccgctggacttcgccaggcgtttgagcccatgccatgatgccgaggcgtctgtcacactcgccactgaagcggctttggcagtgagctagagaagtgccatactggacataatcacctcacggacggcaacaggcacgaggcaggatgtctgccagagctactagtccctctacggtctaggacctcattggtgatttaagatgtatgaatttgtaggggcaagatttgaatcggctatgaattgtgggcctgtgatgaggccacctgccatatttgtagatgccgaatacacctctttgagattgccaatctcgggcattgagcacgtgactgaagagtgtagcctcgcttgatgcactccttgcgtctctcacctgcgactcgaattgagaccacggagtgtccacccaggcttggcttgcggaagacgattaccaaaacgcattgtcatatcggatccgtgcgaagcatgcgatggggctgaacattcattcgggtcggactactcctacttgcgacacaagctttcacagccatagattgctttgggtggatcccttggctcccagtggtacaaccaaagggagggaagggaatgaacagttatgtgaatcggaaggagccattgggtgataac

SEQ ID NO: 613564 - DNA, 439 bp, Homo sapiens
gctacgacctcaatctcctgacctcgtgatctgcccacctaggcctcccagagtgctgggattacgggcgtgcaccacgcctggccaaaaaaaggattttttaaaggagagagaggtgcaaacctctttagttagtaaaaactaactagagaattctcactaacaaaaggccttgttaccaggatagatggtcaatttgtgactgagttgtagccaaatcataggtgtgggataatcacactatatcaaaatttaaatgtaaaaatctgcctatctttattcattgaccatgaaccaagagctccagtcctcctggtcatatttaatagggaaaaatatgtttggatggattgatggatggagggccaaacagatggatgtatggagagacttatctaatgaggcagcttggtattttgagagagcacaggttttgtgt

SEQ ID NO: 613565 - DNA, 233 bp, Homo sapiens
tatatcagtgactggaagtattcggacgtgatggtaagttggagtgtgactatgtatgttgagtcctgtaagtaggagagtgatataagatcaggagaaagtggttactagcacagagagttctcccagtaaggttcaatacgtggcggggtacaggcgaggtatagccgacggcttgctcagcaatgtcatctacaaaagctatatagtaggtgaagatagagttagcacag

SEQ ID NO: 613566 - DNA, 446 bp, Homo sapiens
  misc_feature (169)..(169): n is a, c, g, or t
  misc_feature (439)..(439): n is a, c, g, or t
  misc_feature (442)..(442): n is a, c, g, or t
gacccagcagcatcagcgtccccctgagggccttaatagagatgcagattcctcaggcctcagcccagacttagctgagttacaaactctgggggtggggtccagcaatctgtgctgtcacgagtcaccctgatgattctgatgcacactcaagtttgagaataactgncctatattcaagaccacctgattaataaatgcacttatgtgaatgccataaatcctaaaagagggcttttctgggagatgagacctatacttctgtgggcctaactatcatttgacttattatttcagcacaatcacaaaattcccagcaccatgtaagaaaccctatcataactaaggatatgtatgtctgatcattttggtagtagttatatagaaagggctttttctctgtttttccacaaaaacttggagagagcttaaatttganttnttaa

SEQ ID NO: 613567 - DNA, 127 bp, Homo sapiens
  misc_feature (117)..(117): n is a, c, g, or t
gtgtgcctgtagtctaggtaccccagaggctgaggcaggaagatcacttgagcccagaggaggttgaggctacagtgagctgtgattgctccagtgctggatgacagagcaaaaaanaccctgtctc

SEQ ID NO: 613568 - DNA, 911 bp, Homo sapiens
  misc_feature (397)..(397): n is a, c, g, or t
tggaacgattcctaaactttatggaaaaagccaatgacaatcaattacccaaaaaccgaaacgccaaatcccatctcactccagcgccagtgccctctttctcaaacgctcgcgggctctaggacctctccaccagcacagtttctcaggagtctccgtgctgggtcctcccagtgtgctgtcctaggggctccacattgaaggcaggctcaggcgggacctccccgggacaagcacttctgtacgcggaaagcacagaggccgcaggacgccatgggaagacgccggccctatgggacgacagggaactacttaaagaggattggcgcaaaccgggagaaaccgctgggagaagatggtgcccccgcactgctggtgggataaggcaagagtctcnagtatcacctccgggcattgtcgaggtatgggggcccacaagggtctagaacgcatctttcccatcaagttagaagcgggactcgcgcttggctctacattctccgcaatgggcagaagtagttagaagaaggtcgaagtgggcccttgtaggacgcagtacgagtcgcggtgtgggttcaccagccactcccattgtggtggtgtcggcgtggcccgtgccgatgtcactgggactgcaggtgccacagcgggctatggatggtgtacgggcagtcatctcgcggtttccccttgcgatctcgaggtcagaggacgcaggtaacagccgaaaattacccccctataaaagttaatgaaaccactcatacatggaacctccccgagccaatccaaaatctccggatgatgaaaatctcgggtcactccttggagcctggcagaatcttcaaattagccaggggatatcccagcctgggatatcacaaaaggctaaccgcttttaaagcggccaa

SEQ ID NO: 613569 - DNA, 239 bp, Homo sapiens
ctgtctaaagcaaccgatagaacatttccctaagacagcttcggatattccaaccaagaaaggttaggtgtaatagcgggaacactgatttccatgcatgggggattcacattttcttgtagctcatctttcaaaaggaagaacagaacaacacatacagcaacagccctagtaatcgtggtaacatctgcctcagtgactcatgtgataatcccccaccctgagccggccgcgaccct

SEQ ID NO: 613570 - DNA, 373 bp, Homo sapiens
gcacgagctgaattgattgtttaggtttcagagttcttccagtttttgctggaaccacaggacagaaggaatcaagaaagtggtggggatgggccgtgtgcagtggctcacacctgtaatcccagcactttgggaagctgaggcgggtggatcacgaggtcaggagttccagaccagcctgaccaacttggtgaaacttcatctctactaaaaataaaaaaattagccaggtgtgtggtggtgtgtgcctgtaatcctagctactcaggaggctgaggcaggagaattgcttgaagctgggaggcggggtttgcagtgagctgagatcgtgtcactgcattccagtctcggtgacagagcaagactccatctc

SEQ ID NO: 613571 - DNA, 446 bp, Homo sapiens
tgctccgaggattcaccgtatatgtaccatctcaagggtgacataacagtgagcatagcttttttatttgatcaggcatacacaataagtgcagtccttaaatgccagtgaaaatttaccacataatcaattgtatagccccattaactgataatagagctgaaatttagcagtaccaagttattagtctaaggggtgggtatagagggaagtataggacagtgctgcaggaaggaaaatgagaaacagtttccttctctttttctagctgtacatacaaatagacctcatgctaaacaaacttgaactgtatcaggtatattataggcatcctgctaagtctctatctggtttctcttctgctgccacctctagtctctctgtctaggatgtatagcatccctaatacactgagtgtcccttacattgagttacatatacaggtg

SEQ ID NO: 613572 - DNA, 313 bp, Homo sapiens
  misc_feature (36)..(37): n is a, c, g, or t
  misc_feature (106)..(106): n is a, c, g, or t
  misc_feature (181)..(181): n is a, c, g, or t
  misc_feature (230)..(230): n is a, c, g, or t
  misc_feature (236)..(236): n is a, c, g, or t
  misc_feature (284)..(284): n is a, c, g, or t
gccaacatcatcgtagcggaatcgggggtatgctgnntcgaatcataagaacagggaggttagaagtagggtcttggtgacaaaatatgtggtgtagagttcaggngagagtgctggagatggtaatgggcatggagacatatcatataagtaatgctacggtgagtggtaggaagtctgngcataggaggtgcatgagtaggtcgtagcggaatcgggggtatgctgtncgaatncataagaacagggaggtaagaagtagggtcttggtgacaaaatatgtngtgtagagttcaggggagagtgcgtctac

SEQ ID NO: 613573 - DNA, 212 bp, Homo sapiens
ggccccccgttgggctctcaatggggcgctcagaacaaggtaagtcatttccattttaacgttatgaaaaagctatcaggcacaggagccaagatggccgaataggaacagctccggtctacagctcccagcgtgagcgacgcagaagatgcttccccgagttgagacctgtagatgacgtgtagacccatgttgacaccattgattgcagc

SEQ ID NO: 613574 - DNA, 383 bp, Homo sapiens
  misc_feature (371)..(371): n is a, c, g, or t
taggttcaagggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatgggaatatctctatcatataggacctgttgttacaggggcagggatcgggatggatgggacactggaagtccttcaggcttggntaagtttcagtt

SEQ ID NO: 613575 - DNA, 211 bp, Homo sapiens
  misc_feature (173)..(173): n is a, c, g, or t
  misc_feature (211)..(211): n is a, c, g, or t
gccaaattcctggtagagacgtggagcaacaggcactctcagctttgctgatcggtgcaaaatggttcagccaccttttgcagacagtttagcagttttttataagactaaaatgtactttcaccctatgattcagcaattgcacgctttggtatttgaccaaatcggctgancagattatgtcagctaaagccctgcacacagatgtttn

SEQ ID NO: 613576 - DNA, 176 bp, Homo sapiens
tgcctctggtggaccccttccaaacccagtttctgatctctgacaggggccaaagctgtgaggggtgaaggcccccgccctagttgtggccacccttatattttgttacattattggcatcatagatgctggccttccttctgcaaataatgatctgggaaaatccaacccatgca

SEQ ID NO: 613577 - DNA, 1051 bp, Homo sapiens
gggtgtgtgcggtggtgacggggttgtgtgtgctgcggacgggtgtgtgcggtggggacggggtgtgtgcggtggggacggggtgtgtgcggtggggacggggtgtgtgcggtggggacggggtgtgtgtggggggatggggtgtgtgggggggacggggtcgtggtggggacgggtgtgtggtgggtgaggtgtctctgtggtggatgacaagggatgggcgcgtgtgatggggcactggaagcgctgttggatagcagatggatgcgccaggttgggggtaaggcagactgggagggttcctcgacatttggggcacgctcgatgatggtgtcgggggcaacccgtagatgctgagggaagcgtgcattctgtgggcaagacacggctcttgatgggggtggacaccgtgccctctgggctcaaccagaatgtgagaccagggttgttgtgcttgaagttggtggttatcctggaaacatcacataacgtgacaatacggaggcctgggcttggcacagactgtctttgcctgctaaatagaaatatgaaaagtttcattgcactgactgacacataggtgaggtcattgcccacccctaaattacccgactaacagctaagtccttaaatacacgcaagcactataagagagtgcttgagagtagggaagggaaacaaataaagcctaggagagtaaagaactggagttgcctgtaggagaggccgcgccaacttggcttacaagaggcctgggcaactacatgggagccctgtcgtcaaaaacgaaggggtatcgttgtcgttcgcctaagaagttgtaggaaatcactcgaggtgatccttttcctcgtgcccagaatacctacgggggttcttggaccccgggagtcgcacgcattgcataatgcatcgatgcgtataggtcgccttagatagacccggagaacgtgtgcctaaggctgtcagggggttcgatacgaaggtgccttctagttgcaagtaatcggcgtggctactcgtggaagctgacaaagcaacgtgcattaaa

SEQ ID NO: 613578 - DNA, 289 bp, Homo sapiens
  misc_feature (108)..(108): n is a, c, g, or t
  misc_feature (179)..(180): n is a, c, g, or t
ccagtgccgtgtagtggcaaagtcagccccatcaaaatctctctgtggacacaaattcttctggtatctccctcactcctgtctactcacaatatccttgctcttatntttttttattatactttaagttttagggtacattgtgcacagacatgcagtgtttgttacatattgtatanncatgtgccatgttggtgtgctgcacccattaaccccatcatttacatttaggtattatctcctaaatgctatcaaccccctcccccccatccacttgacaactgggcct

SEQ ID NO: 613579 - DNA, 107 bp, Homo sapiens
  misc_feature (6)..(6): n is a, c, g, or t
ggctgntcttgaactcctggctgtgatcgctgtcgtgtgtcaggcgtgagcatcgtgccgagccagatgtatgggttcattacagacttcagttatatccacgtgtc

SEQ ID NO: 613580 - DNA, 195 bp, Homo sapiens
ggtgtcctacgcattacggacgctggctcagattatctgtccaccatgtcgtccctccgcagctctacctgcgatggtgctgccaggtgcaatgacttcgggctgatgcagctcctggccctggggagtttgcgcctcctgtctctggcaggctgcccgctgctcaccaccaccgtgctgtcgggctagtcgggg

SEQ ID NO: 613581 - DNA, 674 bp, Homo sapiens
  misc_feature (12)..(13): n is a, c, g, or t
  misc_feature (20)..(20): n is a, c, g, or t
  misc_feature (23)..(23): n is a, c, g, or t
gcaagatggcgnntgtggtnctngcggcgacgcggttgctgcggggctcgggttcttggggctgttcgcggctgaggtttggacctcctgcgtaccgacggtttagtagtggtggtgcctatcccacatccccctctcttctcccttacctggagtacccgaatgcctagtgtattcgctcacaggttgcagtggcacgaggcaatagagtttcgaaagcctaaagtgagccacattggagtaatgggtcttcgcgtggtcatctcagaataacgttttggacagttttgtacagtaggaattcttatcaattcaggatcgagaatatgaagcgacaataccttagtggaattgctcactttctggaacattcggcatcttacgctctacatgctcgcatgttgacgagctaaacgcatgaacattctgcttcacgtcggcatacaagcatggggcgtatctgtgactgccagaccactcaatgatgacaacaccatgtatgctgtgtcttgctgatagccaaaggcttggacacggtggttgcctaagctggactgagtgtggttctgcagccccgggctaacagatgaacgaagtcgagatgacgcaggatggcggatccaggtttgagctggaggacctgtaacctgcggcctgagccagagccacttctc

SEQ ID NO: 613582 - DNA, 273 bp, Homo sapiens
  misc_feature (12)..(13): n is a, c, g, or t
  misc_feature (20)..(20): n is a, c, g, or t
  misc_feature (23)..(23): n is a, c, g, or t
gcaagatggcgnntgtggtnctngcggcgacgcggttgctgcggggctcgggttcttggggctgttcgcggctgaggtttggacctcctgcgtaccgacggtttagtagtccgaggtatagaaataggtaatgcgacctcgggaatccggaatcattttgacgtgatcaggcgcaccgtacatggccagccgagtattaaaactgccgatattgtcggggtcgtagggtgtgctcaggctggaaggctggttctgtagccgggccagtgtacc

SEQ ID NO: 613583 - DNA, 537 bp, Homo sapiens
  misc_feature (49)..(49): n is a, c, g, or t
  misc_feature (64)..(65): n is a, c, g, or t
  misc_feature (76)..(77): n is a, c, g, or t
  misc_feature (82)..(82): n is a, c, g, or t
  misc_feature (88)..(90): n is a, c, g, or t
  misc_feature (92)..(92): n is a, c, g, or t
  misc_feature (94)..(95): n is a, c, g, or t
  misc_feature (97)..(97): n is a, c, g, or t
  misc_feature (146)..(146): n is a, c, g, or t
  misc_feature (149)..(149): n is a, c, g, or t
  misc_feature (161)..(161): n is a, c, g, or t
  misc_feature (185)..(185): n is a, c, g, or t
  misc_feature (207)..(207): n is a, c, g, or t
  misc_feature (209)..(209): n is a, c, g, or t
  misc_feature (211)..(212): n is a, c, g, or t
  misc_feature (218)..(218): n is a, c, g, or t
  misc_feature (222)..(223): n is a, c, g, or t
  misc_feature (233)..(234): n is a, c, g, or t
  misc_feature (262)..(262): n is a, c, g, or t
  misc_feature (265)..(265): n is a, c, g, or t
  misc_feature (270)..(270): n is a, c, g, or t
  misc_feature (275)..(275): n is a, c, g, or t
  misc_feature (278)..(278): n is a, c, g, or t
  misc_feature (288)..(288): n is a, c, g, or t
  misc_feature (292)..(293): n is a, c, g, or t
  misc_feature (296)..(297): n is a, c, g, or t
  misc_feature (306)..(306): n is a, c, g, or t
  misc_feature (308)..(308): n is a, c, g, or t
  misc_feature (318)..(318): n is a, c, g, or t
  misc_feature (332)..(332): n is a, c, g, or t
  misc_feature (335)..(335): n is a, c, g, or t
  misc_feature (337)..(337): n is a, c, g, or t
  misc_feature (340)..(340): n is a, c, g, or t
  misc_feature (343)..(343): n is a, c, g, or t
  misc_feature (347)..(347): n is a, c, g, or t
  misc_feature (362)..(362): n is a, c, g, or t
  misc_feature (367)..(367): n is a, c, g, or t
  misc_feature (421)..(421): n is a, c, g, or t
  misc_feature (432)..(432): n is a, c, g, or t
  misc_feature (436)..(436): n is a, c, g, or t
  misc_feature (439)..(441): n is a, c, g, or t
  misc_feature (445)..(445): n is a, c, g, or t
  misc_feature (447)..(447): n is a, c, g, or t
  misc_feature (449)..(450): n is a, c, g, or t
  misc_feature (453)..(453): n is a, c, g, or t
  misc_feature (486)..(486): n is a, c, g, or t
ggggggggcgcggggcgtgcgctgcaacctccgcctcgtgggtccaagngattcttgtgcctgnncctccaaagtnnctggnattacnnncncnngncaccacaccaagccattttctgtatctttcgtcgagacgggtttttgcnatnttggccacactngtctcaatctcctggcctcaagtnatccacctgcctcagccacccnangnnctgggntttnnggcgtgggtnnccgcccccagcctagaccctttataaanatnttaantgcanggntggggggggngggnnagnnggggaatcncngcactccggngggccaaggcaggnggntngcntgnggtnagttcaagaagagcntgggnaatgtggtggaaactccatccctactcaaaatacaaaaatcagccaggtatggngggcgggtgcntggnttnnnagtnantnnggnggctgaggcaggagaatcgctcgaacctaagangtggaggctgaagcgggccaagactggtacactgcactccagcctgggtaa

SEQ ID NO: 613584 - DNA, 638 bp, Homo sapiens
gtcctgtgtggtgggtgccctcgggctggtggggtgtgtgttgcctatctgtgggccgcctgtcgctcccgctctttccatgtctctctgatgcgcttcttctctctcttcgccgttctaccctggcgatggttacctacttccctcgcgtcaggtcgccctgtcttccttgccccttgcattcttcctggctactgccccgggccctgccctgccccggccctggcgggcgtttgccctttggctcccccttccttgtcttgggccttcccctctatttcctaggatccgcattcgggtggactctgccccaggagcttgacagggttcagggcctcttctggcctctctcctctgctgtccatccactgtgccccttgggccatcgccgacgcgctcggtgccacgtgccgtgtggtgtctgtgcccgcagaccgggccatgctgcccgctcacttgtggactatgcagctcccggttgtgcgcgccctgtggtccacgagacagcagccccaccgtccacctccatcgcgccccgcttctcttacgcaccccgacccccgggcggtgactccatcgcgccctcggcctactacatgtcctgctcttttgtaagtagcgggccagggtcagtgaac

SEQ ID NO: 613585 - DNA, 350 bp, Homo sapiens
  misc_feature (165)..(165): n is a, c, g, or t
tttacctagtagggattgtagttgtcactggtctagagttccaatacattttatatcaggaacctcagtgagctacccagaattggaacttaacatggcccagcaactaggagaagaaggcaaaccttgagaaagctgagccctcaggatagcacagtctcaccnttgtttaaaatcaagtcaggctagcctttcagtcactctggttttgtaatgatttgccttttaggcctcaggccatttgatttctgcaatagttttctgttcttctcctacaggaatacatccctgtcctttcggttgtaactattactaaaactagggctatgcaaatgacctggttaccatgt

SEQ ID NO: 613586 - DNA, 568 bp, Homo sapiens
  misc_feature (295)..(295): n is a, c, g, or t
  misc_feature (497)..(497): n is a, c, g, or t
  misc_feature (527)..(527): n is a, c, g, or t
gtggcttgtgttcaccaggaggactactgagatcagggacatgttgctggcaataaggtgccagtgtgccgtgctgtgcattgcccatgtgaagtcactgtgcagccagaacactggtctggcccgagaagacctcttttcaggctagtatcaccactaaattaggccatgaatctgggagcagtgatcaagactgaacaagggagcacgaagcacctgtgaacatgctaacatctcccttctctttggctggcatcacaggtgtcgacaatggcagattacaaccctgagtgtngattacagggaaactctgattctgttctggagtgccgaatgtgcagtgctgctgagatggtccaactgtgatagacccattatataacgtcaacagctgctgctggagacgtcacctcactgtgaaggcaggctctgctgtcattgcttgtgtgtgcctgtgtgtgcacacagtgtctgtgtgtgagccagtaggtgagcangagatcgagatcgacagatatgatggcttngctatacgcacactagcagtattgcacaggatggctctctt

SEQ ID NO: 613587 - DNA, 109 bp, Homo sapiens
ggtttgctgaaccgttgcaatgaacctgcggtctggagtcaactttgcaaaagcccagtttgcagaaaggaatggtgaaagaggccattgattttttttatcaaggcgg

SEQ ID NO: 613588 - DNA, 412 bp, Homo sapiens
tgcttctttgctctctcggtgtccaactgagtctcatcgctctcccttctaatactccttctgtcatctattttgtcttttcttcttcagactgaaaatccctggtagtacctgtagtttccttccaggacacgatttttagtctgttccttcaattgccctgtaattccagcactttgggaggccaaggcaggcggatcacgaggtcaggagttcaaaaccagcctgtccaatatagtgaaaccccgtccctactaaaaaatacaaaaattagctgggtatgtggcatgtgccagctactcaggagactgaggcaggagaatcatgtgaacctgggaggcggaggctgcagtgagcccagattgcatcactgcactccagcctgggtgacagagtgagactctgtctcaga

SEQ ID NO: 613589 - DNA, 201 bp, Homo sapiens
cccctggcccccccccccccccaagggcccaggggggggggggagcccctcttttttggggggttcttcccccccttgttccccccccccattggttttcccctcctcccggttgccttgttgccccctttaagggggggggggctttggggcccccccctttttttgtccccccctttagggcccctgggttccccccca

SEQ ID NO: 613590 - DNA, 596 bp, Homo sapiens
agtttctgagctgaaggaaaagattggtccccccttctggtcaaaagctggaagatggcccttaattcttgaagtctggtgaaccggcccattgttgatatggttccctggcacagccccaagtgtgtctgagagcttttccagacgtatcccacccttgggtcgctttgctgttctgtgatatgagcaccagaccaattgcggtgggtgtcatccaagccgtggaccagaaggctgctggagctggcacaggtccacccagtctgccccgaaagctcaggaggcttaatgatattatcccttatacctgcccccccactcgttaatcagtggtggagagaacggtctcacgaatctgtttgctttccacttggccaatttaagtttagtagtaaaagactggttaatgagtaaccatgcatcgtcaaaccctcacgaaggaaaggagaatgttttgtggaccacctttggcttttcttttttgcgtgtggcacgttttaagttaattagtttttaaatcaggactttttaatggaaaccacttgacccaaaatttgtcacaggattttgagacccctttaaaaagtttaatgaga

SEQ ID NO: 613591 - DNA, 401 bp, Homo sapiens
atagccgttctagagtatacccgtcgcatcttctgaattccaggtgcttgaagatacctatatagctccatgatctcaagcactgtatgttggatacattgatttactcattcattattcataaagtatcaggcatcctctgagtgtcaggtccaaggcctaggctggaagtacggagataaatgattcacaatcactgtctccaatatcctcccagtctatgggcccaaggagaagcttcatcttgtcaaccatcttggcgttctggctgcatttgtatttgggcttcctcactcgttgttgacttacggaatcaatcttttccagtggattaggaccattaatatcttataagttgaatagaaaccaatgtaacctgcataaacaagagaacttagctt

SEQ ID NO: 613592 - DNA, 908 bp, Homo sapiens
gtgctgcatgatcacgtatgacctattcatgcctcgtgtagactactcccttataaggatccaccgagggttgctaccatggaacttcagaagactgagatagaagcattgtgctcgggaaagctcactagtcatagatactgttgcacacttccacccatggcattgtcgtggaacctatgggtggaagagatccttgtacaggatacgatatagagggagatacaggataacgcgagagtactggttcttacaccggtgactaaaggggcatagcattgcgtgtctttcgaggaaccttcgacctggacaatagcgggtgaaagaagacacagccaggttcatctgcaggttcgtggttagaaagtcaggtgccagggtccacatggagcttcgttatttttgcccccatgaagtcccccttctgtcatccctgatgattagatgacttaagccttgttgggttacgagccacgtacccagaagttatccgtaatgctaaattggggccagacaattgcattgacgctatttgctcttgcacccaagatccaattagaaagtactcgctaggctatccttatcttcttggctcacaggggctgagctcacaggtgggaatgcaaaacaacttcgcagcacggtgcgtgacccctgctgacagtgcttgatagaggtactaatacggaccgcagtggtgtcagcttgcacttgtacctcctgggactgagtgctcacagtgcatttcgggagcgctccgggggaagcctgattattaccttgatgaactctaattgaaatggcccttgactgtggcttgtctcaaacgccgatttctagcgcaagggactgtttttccccagagacttcaatcgctccaacgacccggcttgaaatgcggtctaaag

SEQ ID NO: 613593 - DNA, 126 bp, Homo sapiens
cgtcatcatatcgctaccctagctttactcaagggagggaagctgggagaagacagaatatgtctctggttggcctaaatgaaaaagtacggtcaggcatggtggcttacacctgtaattccagca

SEQ ID NO: 613594 - DNA, 413 bp, Homo sapiens
ctgagtgaacagctggcaagagatctttctaatagtgatgacttccagtgccggacaccgtggctcatgcctgtcatcccagcactttggaaagctcaaggcaggtggatcacgacatcaagaaatccagacccatcctggctagcacggtgaaatcctgtctccactaaaaatacacaattagctgggcgtggtggcatgtgcctgtggtcgcacctactcaggaggctgaggcaggaagatcgcttgaacccaggagttcaagcatgcagtgcgccatgattgtgccactgtactccagcttcggtgacagagtgagaccctgtcttccaaaaaaaaaagaacggaatgtactgcagatgtatttgataaccaaggtttgaggtaaatttccaccagtattagttctattt

SEQ ID NO: 613595 - DNA, 349 bp, Homo sapiens
tgcaggccatagatcgagagtacttcgcttgttattcttacattgttggccggcttgtgttgtcattctcagaccggccgcccggaactcacttatctccagcagcagtacctgtgccaggtagctgaggccacttgggagcaggaagccatcccggactcagcagcaagagagctcaatccatctgtcgctgtccagttcactttcctccagctgatccccaacccggtgcagcatgtagtcaccaaacagtccatcctcctcctccttgctcaaatctgtctggctgggccagccggaacaggcagtcatacacagggtcccctctgaccatcatgggcgtgttgta

SEQ ID NO: 613596 - DNA, 313 bp, Homo sapiens
  misc_feature (23)..(23): n is a, c, g, or t
  misc_feature (25)..(26): n is a, c, g, or t
  misc_feature (30)..(30): n is a, c, g, or t
  misc_feature (312)..(312): n is a, c, g, or t
cagtatagatgccggcattaggnannatgncgtcccttagtaaagatgccggcatctttactaatgagcggcatctttactaatgagcggcatctttactaatgagcggcatctttactaatgccggcatctttactaatgagcggcatctttactaatgagcggcatctttactaatgagcggcatctttactaatgaccggcatctttactaatgaccggcatctttactaatgaccggcatctttactaatgaccggcatctttactaatgagcggcatctttactaatgacggcatctttactaatgnc

SEQ ID NO: 613597 - DNA, 219 bp, Homo sapiens
  misc_feature (18)..(18): n is a, c, g, or t
  misc_feature (88)..(90): n is a, c, g, or t
  misc_feature (101)..(101): n is a, c, g, or t
  misc_feature (108)..(108): n is a, c, g, or t
  misc_feature (114)..(114): n is a, c, g, or t
  misc_feature (127)..(128): n is a, c, g, or t
  misc_feature (146)..(146): n is a, c, g, or t
  misc_feature (156)..(156): n is a, c, g, or t
  misc_feature (166)..(166): n is a, c, g, or t
  misc_feature (174)..(174): n is a, c, g, or t
  misc_feature (181)..(181): n is a, c, g, or t
  misc_feature (186)..(186): n is a, c, g, or t
  misc_feature (196)..(196): n is a, c, g, or t
  misc_feature (200)..(200): n is a, c, g, or t
ctcgtgcgcaagaatganactctgtctcaaaaaaaaaaaaaaaaaaaaaaaaactcgttgactcattaaaaaccttttttttttaaannnaaaaaaaaggnaaatctnattagngaacttatctttnnagctgagaactaaaattntttttaaaangatacccttnggattgancaaattntttgncccagtatgncttntagaaaggttagttataat

SEQ ID NO: 613598 - DNA, 280 bp, Homo sapiens
  misc_feature (27)..(27): n is a, c, g, or t
  misc_feature (279)..(279): n is a, c, g, or t
caggacttagtaagatgcgctcattgnaaagatgccggcatctttactaatgagcggcatctttactaatgagcggcatctttactaatgccggcatctttactaatgagcggcatctttactaatgagcggcatctttactaatgagcggcatctttactaatgaccggcatctttactaatgaccggcatctttactaatgaccggcatctttactaatgaccggcatctttactaatgagcggcatctttactaatgacggcatctttactaatgnc

SEQ ID NO: 613599 - DNA, 935 bp, Homo sapiens
cccagacatgacgcatgtcatccacaatgctctccgtttgggtgacacgctacagagtccagaacatccacggagcttgcaatgctctcggtgggagcagacagatctcacctccaatccccctggacctcccacgactacatcctgaagattgtgcccacggttttatgatggacaagaagtggcaacgctaggcgggtactctcataccagctacatcggttggccaacaatggtaatactgctcgcctactagctcatcactgggccgtatcatccctgctatctggttccgctactacctcagccccatcacggtcaagtacacagagagacggcagccgctgtacatgatttcatcagccacgatctgtgccactcattggacgggaccttcagccgtcgccgtgcatcctggaactcactgcatcttcacaggcctctgatggcctggaatgaacgatccagctgggcacagatgctatttgactgcctactacccagcctaatggccgatggaccctgggcatcgccagcacttgccatccagtgcccatgtctcctttggccctcaatctggtcccgaaatctggctagtgtcccaaagggtgtgtgggaagtggggggaacagtagcaggatggctcgatgtattgcagctacctcttttccccgtgtttctttttagacaaattacactgcctgaagttgcagttcccctttccctggggagccccaagaacagagtcaggcaaggggtggggagtccagggatcttggggacccctcctaggagaggctgcagtctcttccctcaggggaacatcccaggaatgcataatcgatcagctctcagccaggcttcgacaatctcgcagccccactaggtggacacattaatgatttgggtttctcccccggggcagcgaactgccc

SEQ ID NO: 613600 - DNA, 299 bp, Homo sapiens
  misc_feature (54)..(54): n is a, c, g, or t
  misc_feature (298)..(298): n is a, c, g, or t
cgaggattccctacgggcggcattttactaatgggcggcatctttactaatggncggcatctttactaatgagcggcatctttactaatgagcggcatctttactaatgccggcatctttactaatgagcggcatctttactaatgagcggcatctttactaatgagcggcatctttactaatgaccggcatctttactaatgaccggcatctttactaatgaccggcatctttactaatgaccggcatctttactaatgagcggcatctttactaatgacggcatctttactaatgnc

SEQ ID NO: 613601 - DNA, 307 bp, Homo sapiens
  misc_feature (7)..(7): n is a, c, g, or t
  misc_feature (306)..(306): n is a, c, g, or t
ggtcgtnagaggatcccgtaaagatgcggatctttactaatgaacggatctttactaatgaccggcatctttactaatgagcggcatctttactaatgagcggcatctttactaatgccggcatctttactaatgagcggcatctttactaatgagcggcatctttactaatgagcggcatctttactaatgaccggcatctttactaatgaccggcatctttactaatgaccggcatctttactaatgaccggcatctttactaatgagcggcatctttactaatgacggcatctttactaatgnc

SEQ ID NO: 613602 - DNA, 964 bp, Homo sapiens
gcaagatcatgtacattgggcgggggctacgacacagcaggcggactgtgtttgtccaatgacattcacaagctaggaatacgcagtcgaccatgacatggcactcttatctgtgacaaagggccagccctggcacgctggagggacttccactcagccagcaatgctgggaaagtctacatgtatgtctgtaggggagcacgtgtccgtagcgtgtattggggcgcactgttccgagtattccaagcaaatgaggattgtactgcgaacccgcaattcgagtcgtgttgacacccaagagaagcctgaggtcttggctggactcgtgtgcccccggatgtccagtggactagcgctgagggggcgcacgtgagcccacctcggaggcttggggctacaatggggagctgtacagtcttgggtgggttataagtgcaagggcctgaaggcggtagcttccatgaactcgtggaatgtttactcctgtgtccttgaccggtggaagccagattgaaccgaaggggaagggggccatgtcccctgccggctgcccagtgcgtgctgtattgttggtgacaagatcgtcgctctcttgggggtaccagtccatctccgtgaggaaggctggcgagatgaatttgaccttatagatcattctgaccttacagcattttggactctagcccctagtcttgaagactctgtgcaagactggcgtgacccagtaataactaagaccagccctggttggcgtcctgctatcaggggggagttgaatggcatgagcacaacaagagatccagtggcccaccgtgtccttcccagggtagaagaagtctgagcacccgtacgaggtgcggactcctgcccgccaatgaaacacggccataaccgaatgatacccgggcagggcacactccggcgcacacggaggagggccatgaacaggcagggcaccactagc

SEQ ID NO: 613603 - DNA, 896 bp, Homo sapiens
  misc_feature (46)..(46): n is a, c, g, or t
  misc_feature (64)..(64): n is a, c, g, or t
  misc_feature (98)..(98): n is a, c, g, or t
  misc_feature (100)..(100): n is a, c, g, or t
  misc_feature (127)..(127): n is a, c, g, or t
  misc_feature (146)..(146): n is a, c, g, or t
  misc_feature (206)..(206): n is a, c, g, or t
  misc_feature (217)..(217): n is a, c, g, or t
  misc_feature (297)..(297): n is a, c, g, or t
  misc_feature (309)..(309): n is a, c, g, or t
  misc_feature (318)..(318): n is a, c, g, or t
  misc_feature (324)..(326): n is a, c, g, or t
  misc_feature (333)..(333): n is a, c, g, or t
  misc_feature (337)..(337): n is a, c, g, or t
  misc_feature (346)..(346): n is a, c, g, or t
  misc_feature (384)..(384): n is a, c, g, or t
  misc_feature (405)..(406): n is a, c, g, or t
  misc_feature (414)..(414): n is a, c, g, or t
  misc_feature (416)..(416): n is a, c, g, or t
  misc_feature (418)..(418): n is a, c, g, or t
  misc_feature (423)..(423): n is a, c, g, or t
  misc_feature (431)..(431): n is a, c, g, or t
  misc_feature (433)..(433): n is a, c, g, or t
  misc_feature (464)..(464): n is a, c, g, or t
  misc_feature (470)..(470): n is a, c, g, or t
  misc_feature (478)..(478): n is a, c, g, or t
  misc_feature (507)..(507): n is a, c, g, or t
  misc_feature (524)..(524): n is a, c, g, or t
  misc_feature (555)..(555): n is a, c, g, or t
  misc_feature (557)..(557): n is a, c, g, or t
  misc_feature (591)..(591): n is a, c, g, or t
  misc_feature (595)..(595): n is a, c, g, or t
  misc_feature (602)..(602): n is a, c, g, or t
  misc_feature (625)..(625): n is a, c, g, or t
  misc_feature (670)..(670): n is a, c, g, or t
  misc_feature (714)..(714): n is a, c, g, or t
  misc_feature (762)..(762): n is a, c, g, or t
  misc_feature (774)..(774): n is a, c, g, or t
  misc_feature (777)..(777): n is a, c, g, or t
  misc_feature (782)..(782): n is a, c, g, or t
  misc_feature (798)..(798): n is a, c, g, or t
  misc_feature (810)..(810): n is a, c, g, or t
  misc_feature (835)..(835): n is a, c, g, or t
  misc_feature (863)..(863): n is a, c, g, or t
gccccccccccccccccccccccccccccccccccccccctccccnctcccacctttgccacanccttggctaaatcttgaactagtgcagaattcancngtggtagagtgctgatcttagcatgcntcgatgtggcatacttgtncttgacagtcatgtgctttgtaagtccttgatttaccatgactacattcttagccaggtnctgcataactngaagaagagattcttcagtatatgacaggtaatgttgtagagttggtgtccattcaccattatccaggtttttcagtgcnaagcaaaaagcncctgccgcnattttnnntggaggnaagngcaccacgncacagtccaacatagtcagtcccaccaggcatttggcnaaagtatgtcgcccgacaccnncccccccnancncagangccccccnangaagtgcaaaggtagaggccgacccagaccnaagtcnaaagcccncagaatccccattcccatccgtctgattnggtgcctagtataagtnttgtcagtcacaaaagccaagtcaccaatcncncgagggtacatttcttcatattttcttgcaatanacanggcagtnacaccaaccagctgcagcatctncttgggcacacaattattctgcatgaaccgatcaataatggaganagtcatgtacatggtctcctgcaacaacctgaatctcatttgancctgtactagcgagtcaatgaggatggctctcatgtgtccagtgactncccgacccagtnggnatttnggtctgactgcgtgcnctccctcaagtngtctcaagacaagcataaatatctntcacatattcactacaaaggtttgggtnagctccatctcctgcatccacatcattcactgc

SEQ ID NO: 613604 - DNA, 279 bp, Homo sapiens
gcatacacaacagcccagcagaactttcatcctagtgtagcccctgccatgtgcctggcttctggaaattcttccagtttgggtcggggtggaaggtctcagtgacgtgctgtggtttagcccgcccagggtcgctctgatccagcagggcgaaggtgccacggcgggcaaagggccactcaaggcgcttgtccaaggcaccaggcaacacacgaatgtacagtgagaggtgtgtgccctcaccactgccatagacattgaggaatgcagacacctgca

SEQ ID NO: 613605 - DNA, 934 bp, Homo sapiens
  misc_feature (94)..(94): n is a, c, g, or t
  misc_feature (109)..(109): n is a, c, g, or t
  misc_feature (169)..(169): n is a, c, g, or t
ccgggcccccatagtgagagtcccttctttttaaaataataggttattgcccgagtttggggcatttgggaagaagtgcattggagataaagcnaaagtaaaaaaaaanaaaaacaaaaaaaaacaagggggaagggttggttaggcaataattaattctagggcaggnagaagtacaggataggaagtaagagcatcatacgctgtttttctcaacaatgggcaatatgtacatagtcataatgatgtggtgactgactgcttagcccctaaatctggtaactactttgggacataatggggggaaaagtgaagatagtgatggtgtaagagctaaatcctcatctgtcatatcaagaaatcactatataatgtataacataatcaagaaatgactaagtagttatgtgaagaaaagaatggaacattgctagaagagttagaagtcattgctccagagaattaggagggatggggcaggggactgttaggatgcattataaactgaagaggcttttaaagattacatgtattaatatatgtattcacttgaaaaactaaaaaaatagtaattttttaaaacccatggaggtaactaccagaaggaaaaactaagagaatgaaaagtgctttcctctggaaagaacaagtcgcaggactgttttcattgtaagacttttggagccatttgattttacttaaccattttcatatatttctttaataaaaataattctatcttaataaaaagttacactcattcattaaaaaaagaattttaagactgtaataagaatcatagtttatttctgttagagaaaggcaatgtgttatacttggaaagaggtcatattaattttatcacatttttgggactcagcatctttatattttctgattttaaataaacaactttgcttatgaaaaaaaaaaa

SEQ ID NO: 613606 - DNA, 638 bp, Homo sapiens
cgccgcccgccagctccctgcgtccgtcccgcgtcccgcgttcccgcgttctgcgatccgccgccatggccagtgatggagctggcgtgcaagctggagcgccggctgcggcgcgaggaggccgaggagatgtggcccccagctggctcccctcggctgccccatgcccctggatgccctaagcccgatgccctgagctctccctgccctgtgctgcccactggccatgcgcctgacgctggagctgcagcgcccaggctgagcctggcgtgcttggacatcaacgatgggcgctgctgctggccccggctgctgcaggtggtcttcaagccacctacactggagttccctgatgttcaggcctgccgcctcatcaagtgacctggatgagcatgttcaaactgtatagaacagctgggcgggagtggcttcagtcggacctgatggagctgaagctgatgatggagaagctgggtggccccccagacccaccttgggcctgaaggagcatgatcaacggaggtggatgaggacttcgatggcaagctcatctttccgtgagttcctgctcatttccacaaggccgcggcagtgtgagctgcagagaggacagtgggctgaatgcggctggcaaaact

SEQ ID NO: 613607 - DNA, 854 bp, Homo sapiens
tcatgaggacatctgcagatgcttggtggagataccctcttggcataccgggccccatcaggcaccagtccgtggcaggtgcccatcgccagaggtgcgtcaagtgggcagaagaagtaccagattcacctgaagagggtgagtggtcccatgaggttctgtggtgaacaaggaggcatggagctcagcctctgtggtgtgcctgtgcaccactgaagatttgctccagagcccatctgctgtttctacacctccacctctgcccgaagcctgtcctagcccagtcccaggaagcctcacgtccaaatagtcctcagctcactcccactggtgtccctggcagtgcggaagtccaggaatggctggccagcaggtggagatcacagggagtggggccctgggactgatagcaaggccagggtgagctcagttcacgtcccacgtgggcccaaggaacgactggacacccggcactgcagtcttctgcctgtggacaagaagcagcagcagcagcgggagcagagaggagaagcaccagtaacaagcagcagttcggtccgggaccaaccttactagctcctttgaggccatcagggagaccccacaggtgtttgtggaactccccatggagctgtcagaaatctttgatcccccacgagagtggctgagctcggagcctgctggagcgttggtgtctcagaagtgtttgccctctgtgggttttccacccggggaccgggtattttcaactgggggaatgacgggtttgggcccattgtgggcctctcaagtcgggagggagggggggccgtttggtgggccaaggtgtcgggtgtggggctctcccactatat

SEQ ID NO: 613608 - DNA, 210 bp, Homo sapiens
  misc_feature (185)..(186): n is a, c, g, or t
gtctctctgattgaggccgggtgagcgcacactggaacactatgatgaggccggtgagcgcacactgggacactatgatgaggctaggtgagtggacactgggacactatgatgaggctaggtgagtgcacactgcggccactaatgatgagaggtgggtgagcgcacagtcttggacactatgnnatgaggctaggtgagtgcaccctg

SEQ ID NO: 613609 - DNA, 399 bp, Homo sapiens
  misc_feature (11)..(11): n is a, c, g, or t
  misc_feature (18)..(18): n is a, c, g, or t
  misc_feature (38)..(38): n is a, c, g, or t
  misc_feature (58)..(58): n is a, c, g, or t
  misc_feature (121)..(121): n is a, c, g, or t
  misc_feature (323)..(323): n is a, c, g, or t
  misc_feature (359)..(359): n is a, c, g, or t
cctaccaaggngggtaanagcccccttgtcccaagtgnggaatttttttttccacaangcaaacacattccctcccctaccttgtacttctgccctcaactgaatcattttaagaatttangccggacacagtggttcacatctgtaatcacagcactttgagaggctgaggcgggcagatcacccgaggtcaggagttcaagaccagcctggccaacatggtgaaaccccgtctctactaaaaatacaaattagctggggtgtggtggcacgcacctgtaatcccagttactccggaagctgaggtaggagaatcgtttgancctgggagatggaggttgcagtgagctgatattgcnccattgcacttcagcctgggtgacagagtgatactctgtc

SEQ ID NO: 613610 - DNA, 1008 bp, Homo sapiens
gcgctgtcccggtcggggcctaccggtgtgcgccgcctgatccggtgttcgacatgactgcgccagtcgcctctgctgtgcctgtggcgtggccggcctggtgcgcgccgacgcccccgcaggaggaggagctagcgttccgtggtgcctgccgtgaaaagacacatcttcgtctgggtaggccgcttggcggtccacaagtacctgctgggatggagattctactgccccatgtggtggtgagccattgacaaggcggcgtggcccccatgtagtatgccaaatccgactggggaacgctgaatacggcgagaaggttcctgcaaatcaagtttggacagaggatggacgctcaacgggaaagagtgcttgatccgtggctccagacgagttgacggaggtgcagcagagctattccccaccagtcaagatttcttcacggacatgagatgacacggcattccccctaacgggacactgatacttggcatggtcagagacgtgctgatgacatcgtgaaactggactgaaagaatgcgcacgggggcccggatagcagccaccctgtctgaacggcgcagttgccgagagtccttgggtggagtccaccgaggtgtggttgtcatcggggttcttcaaggacgtggagtcgagactctgccaaatcagttttttggaaggcagcagaggccatcgatgaccgtaccattttggggatcacttccaacagggaagttgtctccaagtatcaggctcgacacagatggggttgtcctctttaagaagttggtgaagggcggaaccagcttgaaggggacggtcccctgagaacccgtggacttatgaaaccacaggtgccgtgtcatgagttcgcggccaacgccgaagatttgggggcatccgagtctctggtttgccaagttttggatgggaaggcttcaacaccccagatggaacgctacttcggcccacgacagccgttggaaggaaggggcctcggggacccag

SEQ ID NO: 613611 - DNA, 254 bp, Homo sapiens
atcgagtcggtaccgactgatccgagttcatggccaactatcgcaccgtatcgccctgccgcaggtgccgggctatgaaggcgcaggcgtcatcgtcgatccgcagagggggcgctcgaccggccgacgcgcgctggcggtagcgggtgacggcagctggcaaaccttcgtcacgctgcctgaggatcgggtggtgtgggtgccggacgacatcgacgacaacgacgcggcacagatttacatcaacccgctca

SEQ ID NO: 613612 - DNA, 151 bp, Homo sapiens
gcgactacccaggctggagcgcatggatagacaccgcgcactgcatacctgagcgcgggaatacggaccgaggcgcgggaccggagagtttgtcacaacatcttcctcctctgccaccgccggtggccgcagggccggggactcgcggccg

SEQ ID NO: 613613 - DNA, 218 bp, Homo sapiens
aaaagtggtatgatcttgcaagttctcaggaacttgtattcaagagtccttaacatagtcttttccataaatctcctgaacagtcttcctagaaatacaaaaatgacatcacggctgctacgttggattattgaaagcacacgttcctaatcctgcgagtgagcaatgacatctgatagtcacaggatgtggagctctcctctgccactggcgaggct

SEQ ID NO: 613614 - DNA, 680 bp, Homo sapiens
gtcacgctgaccggcggcttccgcacgtaataaggcccgacgtgcccctctggcttggcttcagacccctccccagtgaagggacctgagtcggggaccctgaagcgggcccactcgttggaagggatgtggcctggggctggagtgagcaggccgtgtacctcgtgggagggggaggggccccctgggggaaagtggcggggccatgacgggacgtcctggtaccccacgcgaagggggtcaggaggcggggctgttgctaggatgatgtcccgctgcagaagcagggctgatcggggcgacgaggccgggcaggatggggagggcggtgcggaggggcgggggggggcatgacgctttggagaaggttggcagtgccggcgacgggagctcaaggcgtggtggggggggatcagaggggcgtgcaatgctgggggccgggagagtgggttggagtgtgacccgcgaccgaggccgtttgcctggttgggtggctgggtccaggcttgtgagggggaggttgcccgtgtaggccgaggggagggcctgggcttgaacagcggggctgggtaggccgagcggaagcagttgtcaggggggggaggggaggacggttgggaccgtgggtgggagagcggccgtcggggggggcgcctggcggggcgggtggcccggtgcgg

SEQ ID NO: 613615 - DNA, 297 bp, Homo sapiens
ggaggccgtggtgtgcggatcacttgagctcaggatttcgagaccagcctgtccaacatggtgaaaccctgtcctacaaaaattagccgggtgtggtgtcatgcctcgggaggctgaggcaggagaatggcgtgaacccgggagcctgtaatcccagggaggctgaagcaggagaattgcttgaacccagaagttgaggttgcagctgagattgcaccattgcactccaccctaggggacagagtgagtaagactccatctcaaaaaaatggaggaagggaaaaaaaaagtcgacgc

SEQ ID NO: 613616 - DNA, 329 bp, Homo sapiens
  misc_feature (204)..(204): n is a, c, g, or t
aagatcccttgaatcgacggttctctctgatagtctatctctcccctcaaaattaagtaattctttaacaaataactttaaccggtacagtcctacctcaggggtttagaaatagcccacatttattcagacaagttctagtgaaaatctaactgagcaaactcttgagcgggggataacttctgcagtaggtagataaccccncttatctgctccccctccgcaggaactcgcatagcaacatgtggtacaaaccgttaactttctaaaagaaggaaaatgacttttgtctaattcaaaggttataaaggtacagcggccatcctggt

SEQ ID NO: 613617 - DNA, 161 bp, Homo sapiens
gctccattaaccctcactaaactcgatgagcggctgacgtatatggtgcgtgctgtcgtatgtgcaaactgtcactatatgttgacgctgacagatatggggagtagcgtgattgaggtgtagtagattagacctagttcgaagtagagattaaggaggca

SEQ ID NO: 613618 - DNA, 411 bp, Homo sapiens
  misc_feature (1)..(1): n is a, c, g, or t
ntgtactcgcctgcaaggttcaacatagcgacgtcgtgctgctcctcaggagctatcggttatagttcacgggtatataaaaggtcgtgtgtgttcatctaatgttgaactcacctcagtgctgtccatgtcagcatcattcacgccatgtagatacgtgtcactgctaccagtgagctcgagcgcttgcgccggtgggagctgtgcctccacatccatcgagaagtctagtcctggcacaaccggcgcggagtttggcatagctcgagctataaaaccctcagacatactggatcatcctttgcgatcaagcttccatcataagcatcaggtagcaatttctctcgttctatagcctcctctgttgatagtcaggctaacagtgtctggagttaacttgcagcgagctcg

SEQ ID NO: 613619 - DNA, 317 bp, Homo sapiens
tagcaaaagcagcttggaataatgacagctgtttatttggctgtggtcagttactataataagatctttgagtgtgtaacagtaactcctttgtgcgtttcagtaagttactatgttcacttagcaaaatacgaatgttgaggtgccctaaagttttgtttcagcagtggttcaaaaaatttcagaacatacttttgtgatttgttgcaagtaaatgttcttatagtctgtcaattgtttaagcctgtgatctttcttttcccagttaagagttcttcattaaatttaagaaatacctggtaaaaacaattcaaata

SEQ ID NO: 613620 - DNA, 165 bp, Homo sapiens
cacgaggtataccgggatccttctaaatcatgcgggcctgatctaaatccctttatagaggtttagtttaatcatgaaactgttctacaggaaaaagctgcgaaactgagaaaacaattgcatgacatatgtcaccccttgtagcacaagcgacattaacacaat

SEQ ID NO: 613621 - DNA, 165 bp, Homo sapiens
gtggactgtctttcaactatgtctcatggtcttatatgattaacttatcattgctgtgtactctatgtattctcttctacaatacaacacattgagactgtatttactcgtcaatgttgtaatatatcgctgctgacgtatagggctacttatattactgcagga

SEQ ID NO: 613622 - DNA, 376 bp, Homo sapiens
tcttccgtgtaggtcccccgtgtaaattaggtgtattaagagtttgatatctcccttccaggatttgtgtaggatttaatataccttatcgcatatggtcccctcagaccggtccttgccattattaagtgcccttccatattttccgtgaattcccccatccagagtccccgtgtttaagtgtcctctccacttcgatttcccctttgagtcttctcttctctccacaaatttttgtgttaacccattctcttaatttctcacacatgttctctttctcacactatatgattctcatatatttaatatttctctcgacgcgtgcgcagtgttaaaaatctcgcgtaaagttttcgtacagcccggggtccacacg

SEQ ID NO: 613623 - DNA, 152 bp, Homo sapiens
  misc_feature (3)..(3): n is a, c, g, or t
  misc_feature (6)..(6): n is a, c, g, or t
  misc_feature (46)..(46): n is a, c, g, or t
  misc_feature (52)..(52): n is a, c, g, or t
  misc_feature (69)..(69): n is a, c, g, or t
  misc_feature (88)..(88): n is a, c, g, or t
  misc_feature (108)..(108): n is a, c, g, or t
  misc_feature (126)..(126): n is a, c, g, or t
ccncancatcacacacacgctctcaccctcacacacacacacgcangcacantcacaccatcgcaaaanaccgcccccagggtttcanctctcgcaaatcgtcttctntcatcaagatcaggaatnatatgtccttccaccatggggggggt

SEQ ID NO: 613624 - DNA, 111 bp, Homo sapiens
  misc_feature (46)..(46): n is a, c, g, or t
ccaaattccgggtccattagttaatagcccataaaaggagtttccncgtttaaaaaccctccgggtaaaaggctccgccgtgcttggccggcccaacgaaccccgggcaca

SEQ ID NO: 613625 - DNA, 294 bp, Homo sapiens
gctctagagatcccgtccacttctacaccgacctaattatattctaaatggatcccagccactgatgcatgtacttcagctacttctgctaaatcagcatataatttttccacatcagaccatcagatctgtgagaaccaatcagttatctagaattccgtgtctactagatgtttcacctagcatgcgaggcttcattgaatttcgtagcaaacatatagaagcgatcatatatgtatgcttctggtattgaaaaaaattttgtgtgtgatagttgcttatgtaaacgtgcag

SEQ ID NO: 613626 - DNA, 1412 bp, Homo sapiens
  misc_feature (1412)..(1412): n is a, c, g, or t
tcgtgcgtgtacgcagcaatgagcgaacggcgaacagcgagcaagaagtcctgtggcctctaccgcagacgattttcaggcttggtcgaaggaatactgagcatggcgatcattcatcgggcagatggatagaccctctatctagagagaaaaatcgagtacgagtactatgagtgaaggccaagaactgcgtgtgtctctggataagaaccaaagaagtctcactggacacaggactctaattcaaacagtgtaatagactgagatgcaacatgcccacgtgtattcgcaaactttggagctagtcattaccgagaggattgcgctatagctcgcaagggcgcatttctacatcatgtcgcgacccaaatgggcgccctttagccaccaactcgcgtgaggtgcctcgggagaaccttcccgaaaggtccagaggagaaagacgtgacgcgagacatctttgcgcaagatccgacgtagtactcgtccagtgatcgtcactgagtgcagagttttccgctaagtcctaggaagggaagacgctgtgtacctttctttgctaaactctgattgacgccgataactacgtttgacttggacaactgtagaaagcgcaggattcggcagagaagcgacctttcgtgtagaccttagtgggccaaagatagttccaacatcgttcatgtgcgttaaacaaccttccatccaaatgtgaattctccctccctgtatgagtgtcaacacgtttagactactccccttaggaagtattctccacgcaatcttttctctccctgagggtgggactgcgcatttatccccctaaagaagggtccatgggaccctttatcattacctccccttggcgaggccaccctcttgggacaaaccataacccgaggccctgttcacatcggagaagccgcggaagctatgcttaacaagaccgtcgccccacgcggcactctcgcgtatccccccgcaccttgtccagcgttatttcacaccgaaattttgcccacgtcccctgcgaaaagtaaaccgccgggggctctacaataaacctaattgttccaccccctctccacaaatttgtacaggcccttctctctcacgacaccaataccatcggcgtccaacacagactacccaaggagggtcggcctcatcggccatcccagcgccaccgcacacctccctaccactcctccatcgcacagcctactgaccgcctgaccgtctcatccacgagaagactgaccccaccagaatcctcctctaccatgctcatgacaaccacggggacagccagcgcagctgctcacacaacgcgacttaagcgtacaataaccaccggttgttgtagcatcttattttgtgattttcgtgcactcccacccgccaccgccaan

SEQ ID NO: 613627 - DNA, 786 bp, Homo sapiens
cccattggagaggggccccccctttgctgtcccccctaggagtgtgggtgggccccggccctgcccgaggcgcccatcggggccccttgctgccagatcttacctctgcctcagcgcacggcctcccgtgccctggaggcactctggcaaagggctcccggatagggctgactcaccgggcgctgactgcgtctaccaccgaacatggggatgccacctttagtttgctggggcccaagccaggttgtagggtggcctccttgtgtgacccgttgggcgcctccttgcctggtggcgctgtatagggtataggaccccaatggagcctgacccccgggaggggcccgtctccccctgtgccgcgtttgtgcggggcactcctcggcctggcttcctccccaggccccgggtttggggcccccgagcgtttcccctgcctcgcggccgggcgtcccctgctttgggtttcttggtttgggttttttaatagcccagttttccagtaccattaagggccttttgcaaagaggttcccagctatctaacttgtcaacccatatatatatcaccatatatattcgtatctcaccgaagtgtttatttgcgagatgtttcaacggtgcaattcgggccccgccccccttgtgaccctctgtccccggtcctcgtccccgccccgcgcctggtcccgaatggcctggggacgggccctccctgtatgtattaaaatgacctgtatccaaataaaaggtttattgatttttttcccaaaaaaagaaaaaataa

SEQ ID NO: 613628 - DNA, 89 bp, Homo sapiens
ggatttgctggtgcagtacaactaggcttaatagggactcgaattcgagcctcgaattcgaggctcgaattcaggcttctaacgttaga

SEQ ID NO: 613629 - DNA, 499 bp, Homo sapiens
gggtgtagggtgctagcagtatgggagtgaggacacggtgaaggctagcttcctttgctcctgtcattatgctccttcagcaggcagggacaggcctggcgacctcctttctgccttcgtgaggctgctgccaaggacagtgtgctcccctgaaccttgattaggggctcataagagtccctgacaaaagaccctgtcatgtatgagaggaaaacccatgtgttggaatggacagaggggctgcgtatcagattcaaagcctggattcataccctttgcccggctgagcagtcttatgtaagcctcagtggaacagatagccaatattgataccctccagcccagtctgttatttatttatttatttattttttgagacagagtcttgctctgtcgcccaggctagagtgcaatggcatgatcaaattgaggtccgggtggacctgttggatcatcggatgaccgaagtccaccgtagtgcctgtggagctctgagaaa

SEQ ID NO: 613630 - DNA, 826 bp, Homo sapiens
gcccagctggacagtgcctagaagccagggagttgagaatctccttatccacatcctatccttacttcaccaccaggcctcttgtgtccaggcaacgagcttacgaggatgtcaggcagaggtgggggtaacgaatctgtcaggcaaatactgtcactctgaagtagagccacgcagttacgggtctgagtaatagatagcagtcacctgaactaaacgtaaagcccaaggctggtgagcgaaaactggatggctcattcttcccaatgagcatgacatctcccaccattggtccagttggtggaaggggccaaggtatgtgaccgagccattgagaaggtgatgtaggtgagcattgaacgatctttattccttattcttatagtgcagcaaagtggaaacaagatctttcaggagaggaatggagcagggctgtgaggctcttacagcttgtcttgcaaaccatatagctagcctatgtctaagccgcaaagcctctctgtgcccctggtgtcttacatcgcttaccgttctggcccgaaataccgtgagatggacaaggaagactagcaccaggccatcctagacacgcactcactatttccttggttggacaggaacggaactggagacgtgaagaacgagagtaccgttcctccgaaggtcagaactgcctcgtgatcttggcagagtagggattgggccaataagcatcaggtatcttccctctacaagattcctaaagagctggggcattaccatatgggggacgacgtaggaatgaccagcctccctttgattaccagcaaatacagcacttggtgtg

SEQ ID NO: 613631 - DNA, 167 bp, Homo sapiens
  misc_feature (153)..(153): n is a, c, g, or t
ggaacaccagaggctgggagaggcagggcatcatcctcagcaggtttcagagagagccacagtcttcgcctgatccacagtcttcgccatcgaggcgctcgggatacggttccggtgtccattccatatgaccgatcccacagtcttcgcctngctgggtaccgagc

SEQ ID NO: 613632 - DNA, 758 bp, Homo sapiens
cgcagtggctcacgcctgtaatgccaggactttgggaggctgaggcaggtggatcacaaggtcaggagatccagaccatcctggctaacgcggtgaaaccccatctctactaaaaatacaaaaacaaaattagccaggcgtggtggctggcacctgtagtcccagctactcaggaggctgaggcgggagaatggcatgaaccagggaggcagagcctgcagtgagccgagatcaggccactgcactgcagcctgggcgacagtgagactccatcaaaaaaaaaaaagaaattttaattaacaaaaggtgcttctacatatctaatccttccagaaattcctaccagacacgggactataatatttcctgaggaagcattttttttggcagctagtaataaaaggtcactagtatttaacattaatcaagtacttactacacacgggggactatccttagacctttacttgttttaacttctgggagctacacaaccacccttggaatcaaatatggctatgattgctatactatgaaatgagcaattgaggcccaaggttaaagtacctacctgaggtccccaaggtacacacgtggccgaggaaggagttaccacaggaagtcggggctccttgggcctagtgtcttcccttaacttaaaaaaaaagaaagaaaaataaggcatagcctgtataccccaggaacttgggaacaggttaaggaagccaatacacttgagggcccgggaagctgaaaac

SEQ ID NO: 613633 - DNA, 223 bp, Homo sapiens
tgtcaccaggtcacagactgactgaggtgatggtaggatgaggaggaacaaatgcccttctttaattggttttcagttaacttttcagaggctttggagaacgggacagtggctttttagcctttgaatgttccaaataaaaatttttggttttggcccctgtactgttttacctttaaattttggcatttttttttccctgcaattaaagtgctgtacttta

SEQ ID NO: 613634 - DNA, 551 bp, Homo sapiens
atccctggaatccaaaattctccgtgccacctgcatcacaccccatcctatcaaaaaaaaacaaaaaaaaagaacaaaacaacacacacgtgtgtggggcggggcctgtcgagccccggggagagaagaggcctttcgtgagaaaccacatatgcgggtgagagggcgcgcgcgcgggcgcacccagagagagagagatatacgagcgatgaaacacgagggcacccatagcgcgcgtgatgtcccccaaagagagagagacacgcggcggggcccagagagcaaaaagaagaggcgcggaggaaatcttctctccacgcccaaatagacaacaaaaaaaaagcgcgcacgcgggagggaggcaaaaacaccacgaaaagcgcgctctctggcagaaacacaaaatatcgcccgcaaagagagagacgcgatatcacggggagagccacacaaatcaacgggggacatcatctatacacaaagagcggggggagaccaccaaagacgcaggaagaacccccgcgaaacatatcacccacacatctcgaccc

SEQ ID NO: 613635 - DNA, 408 bp, Homo sapiens
  misc_feature (144)..(144): n is a, c, g, or t
  misc_feature (298)..(298): n is a, c, g, or t
  misc_feature (400)..(400): n is a, c, g, or t
aggtgggctggataaagaaaaagtggtacgtatacactatagaatactatacagccataaaaagaacaaaatccatgtcctctgtagcaacatgaatggagctgaaggtcaatatcctaagcgaaataatgcaggagcagaaanccaaatattgcatgttctcacttatgagaaggtgctaaacatagagtacacatagacatgaagaagggaacaatatacacaagggcctatctgaggatggagagtaagaggagggtgaggattgaaaactacctattgtgtactatgctcattncctgggcaatgaaataatctgtacaccacatccccacaaaacacagtttacccatgtagcaaactggcatgtctaccactaaatctaaaataaaagttgatnagaaataa

SEQ ID NO: 613636 - DNA, 244 bp, Homo sapiens
gtcaggatactactcacagcagtgtactgagtactttatttttttcaggtttaaggttgtgtgtgttgtttttaactcaaatgacccaaagcaaaagttaaattacaaagaaagaacaaagtacattatgatataacacactaggagttacaggaaagcctcatctaaatgaatcagtgcaggaagttccctggtgatctagtggttaggacttggcactttcccttctgcagcccaggttcag

SEQ ID NO: 613637 - DNA, 1255 bp, Homo sapiens
  misc_feature (623)..(623): n is a, c, g, or t
cacgaatatctccctgtccttctgggcctaggactgggaacctgttggagcaaatcttcttaggggcgcaatccaaatgaaggccggccagaaatgtttttccctgtgaggggggctgccctaggggtgtatagaaccttcgcctgcctcgcgtagacaacgaactttctatgccgcagagggttgcattgtttcgcgagcgtatcttacactgggggggcccgcatgttagctcaaaggtgtgcctctccaaacgatggctactttgccaagttcgcaacgcgggccaacttcgaagtgtaaattgcttattcacgcgagggtcggtgccccttatctgtattctggggcacgatggataacctgatataagccgagtcccaaaaccgcggaggcaattagcttttcccccccgagaacgacctccctattatgtaaacttaaccgggcaagcctaacattcttgttctgggtgggaaatgcgatacgcgaatttggaaatcgggctcgctatagtacccatagctggcaccgcgggccacgagtagcagcacttgggacagattgggattggttctcgctgaccaccctcatctcttgaacaacaggggttcgatgcgcanggggctggctactcgattgaataatgcgtaagctccctgcggcaggtcaaaggaacgactgacgatgcattgctatgtactggggactacccgctcagaagctgattgtgacggaaacgaattcttgtttaggaagatgatacggcgaggtgacagaggccacgttctatacaagagagttcgacgctggctaactaaccggttccgtagctaggtgtcactagaggggggacgccttgtacgtagcctgtgctccgtgtacgagtgagcctccaaggaaggcgagtctaaaggcgacggacatcgtccaggacacaccacacaccactcaggaggaacgcaagaacgaacttcatcgctatgcaatcctgcagacacgtgcgagacctactctaacccttcgaagaaactatgccagattgtctctttccgcagccgacatgcactgcctgatagatggaccgggaaaggctgctagaaaatggggcgcactagcgatccaacaatcggcagcagattccgtgtcattgatcacggggtgggagggaaccgtggcgtccatgcgtggggcccatgggtgatacactccagtacctgagacatagagtaacagacgagggtacgagccccag

SEQ ID NO: 613638 - DNA, 101 bp, Homo sapiens
cgggtcaaataattctcctgcctcagcgtcccaagtagctagagactacatggtgcgcgccagcacgcgcatgtaatttatggtatttgttttatactttt

SEQ ID NO: 613639 - DNA, 131 bp, Homo sapiens
  misc_feature (83)..(83): n is a, c, g, or t
aggaaaaaaatcaatatgcatttatttgatacagtcattttaatacatacagtgatggcccgtccccacgccactcgtgatcnttgcgcggtgcggggacgaggaccggggacagatggtcacatggcggg

SEQ ID NO: 613640 - DNA, 216 bp, Homo sapiens
aacagcccatggtcttgccactggtgaaggctttcaagcccacaatgcccaagtaactgctgtatgtggcacctgcccctgtggatgcccttgttcacatggtctgccattgctgtccttgttctctacatggacccttttgttactttcacaatacacacatttttttacgtacctatatgcttaggccctatgaggctggcggtgtgttgtgag

SEQ ID NO: 613641 - DNA, 181 bp, Homo sapiens
aacattgaggaaatgtaaggaagtcagcacttacattaagagaataggctacaaccccgacacagtagcataagtgccaatttctggttgcaagtggtgacaacctgctggagccaagatgctaacatgccattggttcacagggatggaacagtcaccgcgtattggactggcaactgcc

SEQ ID NO: 613642 - DNA, 115 bp, Homo sapiens
cccgcgcccgcgaacaaaagagcggaaccaaagcgatgctttgaatttttaaaacggaattttttcacccaaatggaggactggggacttaaggggcttcgaagttttatttacc

SEQ ID NO: 613643 - DNA, 671 bp, Homo sapiens
cctaaaggccatgtcgaagcccccatcgttgggtcaatagtacctgccgcagtactctaaaactaggcgggtatggtataatacgcctcccattcattctcaaccccctgacaaaacacatagcctaccccttccttggactatccctatgaggcataattataacaagctccatctgcctacgacaaacagacctaaaatcggtcattggatacttttcaatcagccacatagcccttgtagtaacagccattttcatcccaaccccctgaaggttcaccggggcagtcattttcataatcggccacggggttacatcctcattactattttgcctagcaaactcaaactacggacgcactcacagttgcatcataatcctctttcaagggcttcaaactctcttcccccctaaaagctttttgatggcttttagcaagcctcgctaacctcgccttacccccccctattaacctactgggagaactctttggggtagtaaccccgttttcctgatcaaaaatccctttcctacttacaggactcaacaaactagtcccagccctatactccctttacatattttccccaacacaatgggggtcactcaccccccccattaacaacataaaaccctcattcccccgagaaaaccccctcatgaaaaaaaa

SEQ ID NO: 613644 - DNA, 347 bp, Homo sapiens
gatcgaccgccacggtgtacagtcggcgcaggtgccctaagttacgggtcccgttctccttcacttggtcgtgaatcttgcccatgtacaccgggttgacgtctcggcttggcggatacggacctccagctcccacagcttacccacgttcgtacagaggtcctgcacatgcacatgcgtctcggggctggagcacaggcggatgcactctcggatggcgatcaacgctgcaacgtcgaggggcagggcgcgtaaccatgagcggtacttcccaccgatgcctcgggtgcgggtctccaccacaaccttcaattcatcttggtacacgggcgcacatgctaccgatc

SEQ ID NO: 613645 - DNA, 181 bp, Homo sapiens
gggtcccctcctatctgaatccagatagagatcagaaagtgctgataagcagagaatggaacaaatgaaagtgaacattcttaggcaacagttctatcaagttatggcaaactgcccttctgtagcaatggttctgtctaaaagataagtgtctagcttggtctaagaattagagcactct

SEQ ID NO: 613646 - DNA, 228 bp, Homo sapiens
gtgaagagaagcagatgtcacctcagtatctggctctttacaggccccccgtattctaggaaactagataccacacctgcccccttgtggcctgttagagggctatcacctggttccaacctggccgagccatcttagtaacaggttgggagttaagcctctaggtactgctatgtaaggatccctgggtgcgctttggccagacatcctgtactggttatgtgagtc

SEQ ID NO: 613647 - DNA, 112 bp, Homo sapiens
gtaacacgattctccgacccttgcgttccagccgatttgttgaagacgaggaaacttagacagtttaaacgacccttggtgttacacaatgcgttgcgttaagctgttgacc

SEQ ID NO: 613648 - DNA, 484 bp, Homo sapiens
atggcacatgcagcgcaagtaggtctacaagatgctacttcccctatcatagaagagcttatcaccgtttgcatgatcacgccctgcataatgcagttttccttatctgcttcctagtcctgtatgcccttttcctaacagctcagcaagaaagctaactaatactaacatctcagacgctcaggggaatagagaccggtcggtgaacatgatccgtgcgcgcgccaattctaatccatagatcgctcgaatcgtccacgtctccaatcacggcgtatcgggcaattcactttttacaagtttaactatgaacggaagggttgcaaaggcggaatttcaccatcgcgcttaacgcattgcagatactccaattgttggccagccaagagtggctacctggaaatccttatcgatgtacgaccgagctacgggcgtgactaatcttcaaggtcctatcatacttcccccattattcctagaacca

SEQ ID NO: 613649 - DNA, 730 bp, Homo sapiens
  misc_feature (510)..(510): n is a, c, g, or t
  misc_feature (617)..(617): n is a, c, g, or t
gatacttaatcagcgcgctggcaagtgaagtgtctgtaatgttgggtgagtctgtgagggccccaaagatgttgaagctcctcgtactgatcaggttgagtctcattcgcttgatgcgaatatcactcatggatgatgccgagtgctcctcgtcactaatggttacttacgtacagccgaaggggaccaggataactctaatggggttaggtgcagaaagaaagatccgtcagagctggtgtcattgatgtaatccactatccatctaagcacaccattaatccactattgagtcaacgtcggggggaatctggtgaaggggttctgaaatagtctctgctcttcatgcaccttcgcgaacatctggaagtacttattctagttgagactagtctacagcacagtcttttaagcaaccttcctcgtgtcagtgtatctaagaaacacagaagagtagatattacaagtttgagaggcaagatagccttaattgttgaagacttagatggncaccaggtttgcaagacctttgtgcaatagacactatacaagcgttgtgacgcctttaaattagatcagtctaaatgtttcacggatgcatcttactttgtggcgtnggcatttgtaaccggctaatcgtgggtaaactctgcgatgaaatcccatctttgtgaccttgtgttaaagtgaaacataattataggacctgtgtacctttgttttgggcccg

SEQ ID NO: 613650 - DNA, 200 bp, Homo sapiens
agctgaagatgtttattacaatcactctctgtgggggttggccctgctgctctaagaatcctggtgcttaagttctctgtgaatctgtcatctcctatggcctggcagagctaagatggaaggggtttggtaggacgtaactgtcttttctgactggtttcagcctaaactgcaggaagcaagctaactgtgtgcctagt

SEQ ID NO: 613651 - DNA, 338 bp, Homo sapiens
ggacttacaatgtgtggtgttatgggctcggatctcccatttctttggcggacgaaatcctgaccgacctaccggatatcgtatcacggtagtaggatgccgtggtataacccggaccagtatctgaaatctgatatctgtaatctatgtatcatagaaaagtaagaacagcgaagtcccacataaagatgtgtgggaagaatgcaaccagtataaaatacggatgcagaatgcatgaatgcatgtatatgcaacctattcggagaagtgagccttccatttttgttcattaatcaacttatagttttaatcacaaaaacggtgttattattgagaat

SEQ ID NO: 613652 - DNA, 309 bp, Homo sapiens
ttgttttcacgaataagcctattgcttagtgcctgctcagagttcatgcagttcaggcaggtggtggtcggagcccttccatctccctgtgtgacattgtcctcaaatactctgcatacgtccgcgtcagcctagggggttccaaatccagcagagtggtaggattccctaagtccctgccaccacaccagaacacacctcgtgtgctactaggaggaccaaacatatccagtgctctgggacctgttggacaagagatggtcatctaccacccagccttggctcgctcaaagggtcaccatgtggccc

SEQ ID NO: 613653 - DNA, 862 bp, Homo sapiens
gtgggctgggctccatcctgagctccatggagaagccacccagcctcggtgagcaggagactcggcgcaatggtccgatgaactaggccgcccgtcctgagatgaaactacaagagcatgagaaagaacagaaagtggagtttcgtaaaaggatggagaaggaggtgtcagatttcattcaagacagtgggcagatcaagaaaaagtttcagccaatgagcaagatcgagaggagcatacatacaatgatgtggtggaagtggcctggggctgacagtccttcgtcctttggggaagagtgatgactgtcgctatgtcatgatcttcacaaccaaggagtttgctccctcagatgaagagctagactcttaccgtcgtggagaggaatgggacccccagaaggctgaggagaagcggaaaagttgaagggagcgtggcccagaggcaagaggaggaggctgcccagcaggggcctgtggtggtgatgccctgccagcgagtacaaggactagtacagccacctcatcggcaatggagcaggcgaaagacgcagccacatgctacaggcccaataagatctacggtgtgtgccgtggccaataaagagggacacacgctccatttgaacgaggctatgaattgaagatcagagccaagaaagcgtctgcggcagagggggaacgagttggcgccaagctcctaatggccccgccagtcctttgaccctggggcaggcaggggccaggaagacagggtggtggtttttaaagccatcccggaggcccatttgaaaccagtctaacaagtgtcccagtgggggaacacgggttgttgcccgggagtgaatttggggcagttgtgc

SEQ ID NO: 613654 - DNA, 883 bp, Homo sapiens
tgcagtgactcatgcctataatcccagcacttgggaggctgaggcgggtgaatcacctgaggtcaggagttttaagaccagctgggccaacatggtgaaaccccatctctactaaaaatacaaaaattagctggacatggtggcacgtgcctgcagtcccagctactcagaggctgaggcaggagaatcacttaacctgggaggcggacgttgcagtgagctgacatcgtatcgctgcactccagtgtgggagtcagagtgagactccgtctttaaaaaaaaaaaaagaatcataagattttcacttgaggggcgtattcaagaccagcccaggcaacagtggtctcttggtaacaggacacctgtctttacacaaatttaaaaaattagctgggaacacacctacagtaaactcattttggtaaaaggtggccaagaacatacactgggggaaaagatagtctcttggtcaggcacggaagctcaacgccgtgttattcccagcacttgggaggccaaaggtgggacggatccctttgaagtcaggagtccaagaaaagccgggctaaacatggtgaaatcccgtctctactaaacaacacaaaaaacattaagccgccgtggtgggccggaatcagtaacccccactaatcaaggagggcggcggacgggagaactcattgaacccacgggggccgaggttgaacggatcacatactgcaccaggaaccaggctcaggggccggagcagatccggggagacaaaaaacaaatgtcccacagggggggaaaacggctccctaacgaagaggatagccattggtcgcagttaacacagggagcacatcaaccatgaccaaacgggaccacgcgcgaattggac

SEQ ID NO: 613655 - DNA, 117 bp, Homo sapiens
tctacgatcctatagcagaggccacaactgtatctccatgttagctggggctctcagccgcccaagtgtaggacaacagaggtcagctgcagaggaaggctggcaccagcgcccaat

SEQ ID NO: 613656 - DNA, 143 bp, Homo sapiens
ggacgattctttgcatcacagggggttacctggtgatttaaacaattgaggacataactggtttcttatccctcactcattataaaaagatcaatttgcatctcaacattaatggaatacttaaaattattcttatctcttca

SEQ ID NO: 613657 - DNA, 118 bp, Homo sapiens
tctatgaggatccctgcacacgcgagtatcacactgcacacgccgaaggaccagactgcacacgccgaagatccaaaccgaaatcgccgatcttcacgcgtgaagatcggcgtgtgca

SEQ ID NO: 613658 - DNA, 882 bp, Homo sapiens
ggcgccagcgccccagcctgcctgggctcgctcagcctctggggggctcctccgggcgcgcagagcagctccccgcccgcccgccgtgctcgccagggcctcgacaggcccaggcgcgctccagcctgggcgggcattggaaggtgggcgcggatgccggccgccggaaggttgcccgcacttgccccgggaagcccgtgcccccggccggggccgggaaagggggcccacggggagggcctccctggggccacgggggggcgccggacaacaatttggaacggggcttacgggtgggggggcagagaaatggcgtccgggacctggggggaggtaggggggagcgccggcgtaagggggggacctggggtggttccccggcgcctggcgggcgaaggaggccaccagcgggacaacctccggggcaccccgaagggggcggtgggaacacgctggtgaagctccctcgggcattcataagaacccaaggcgcagcgcggcaccttggcggcaaacagaagaaattccttgggggggacatccgcctcaggggcgaaagagggggggtaaccttctgtggaacccggtgcgagaggggcacaacgggggatagttccattccaggagggcccccaaaggggagcgggggcactccacccacgggtagccatcccccagtgggacgccccctggggggtggccgcgcaaggacgacggcgaccccgaatgtttcccccttggtgcatgtggggcgaacaaccaagagggggccccaaaggggacaggggaaaggaaggacgacatagaaggggcgggagtgcagacacataacctggggtgaccacagaggggagaacgcggcggactccaggagacacaggg

SEQ ID NO: 613659 - DNA, 827 bp, Homo sapiens
cgaggctgcagttgcttgcggaggctggcaaagcctctctccataggaggagatagaggtggcacccccaagaggctcatggaagtgcgagagtcaagcatcattgccactgcggtcttgccacaccgatgcctataccctgagtggacgcctcggatcctgaaggcgttgttttccatgtgatccttggtgaccatgaatggatgcctcggacactttgtgcgaaatgtcgttgggtcgacgcggacgttagctaaagcatgcaaggcaggcgtgacacttgtcagtcccactcttaccaatccacacagctcgtgggaggcagattgactaacacttctctgtacttacaaatcctgagagacagcttagacccgtttgcccaaggataaggagttacaggtaggctacatcctccacatgggcagatacgtggacttcacaatcgcccaggaattgagtagccagggcgaagaatctatactgtcgcaagaagggaaacgcacaaatgtgttgtgccatctatccatcgtgggacacccatgctagccatgttatcgtctgcacactaacatcaacgtttcgattgggcttggattatactacattggtatgcctgaaaatataaccgactcccgtctctacaccagcctcttggcgactaaatgtccttgccttgtctacggtctggctggcatttttgcaaccccggggtgtatcggtgcctggccttcgtgaaaccaccttggccagaagttcggacggccctgggccttcctgatatcgtcgccggtctttggtctggggagcgagtccgggattggcag

SEQ ID NO: 613660 - DNA, 749 bp, Homo sapiens
gtttcgcttttcatgtttatagtacttcttgtggtatcttttgtttctatccttgtgccgtgttttcttttctctcgttagtccttatgggggtgtggatgttcatctagttgtgttacactttcaggttgttcattgtatttctgtctccctttttgttgttttgtgtttggggggttgggtcttcttttttgtgtgttctatgtttgtggtctctcatttttatcccgtgttcttttgtcttgcggttgcgggtatttgtctcccgggtgtgtgttcgttctgtgtcctattgtgtgtcttctcggtagccttctttgttggctcttctttgtgtcgagctccttttgtgtcggtttactcttatgttctttcaaggtgcttcctgtgtgtaattgtggtcgttttctagtgatgtcctgaagcaatttttacgccccaaggcctctgtcaaggaagcataaatatttttgttttgcctctcttatattagtgccagtttggtgcataatattacttaaaaaaaccaactggaaatcaccactcctcttaaaagttgaaataactgattttatagaatctgtctgttctttgtttaacacacggttctctgtaagccagcttgcaagtgtattttgtgtaacacttttattctgaggtggaaatgaaaatttctaaagagaaaatattttaaaagatattgtatttatgttgcttgtgttgtagaataaagattccaaatgccatta

SEQ ID NO: 613661 - DNA, 268 bp, Homo sapiens
tgataggcacggagacaccgtgtgtgacatcgacccccagaacgatctcaccttccttcgaagtcgggtccacgaaaaatgacattatggttgcaccagataaagactatctcacagatagtgattcagaatccacccgaataagccactctcttggctccctgtgtcattccttaatttaatgccccccaagaatgttaatgacaatcatgtcagtggactagaacatggcagacgcttggaacccactcacaccaatccagtgatc

SEQ ID NO: 613662 - DNA, 530 bp, Homo sapiens
  misc_feature (521)..(521): n is a, c, g, or t
cgctataaagatacctgaaaatgtggaagcaactttcaactgggtaatgggcggaggttggaagagtttagagggctcagaagacaggaagataagggaaagtttggaacttctcagagactggttcaatggttgtgaccaaaatactggtacccaggactgggtaatttgtaaaaaaaagaggtttaattgactcaccattcagcatggctggggaggcctccgaaacttacaatcatggtggaaggggaagcaaacacgtccttcatcacatggtggcaggaaggagaatgagaattcagcaaagcgggaagctccttatgcaaccatgagaccttgtgagcactaactcactattatgagaacaggatggggaaaactgcccccatgattcaattatctccaggttcctcccgtgacacgtggggactaaaattcaagatgagagttaggtgaggacatagccaaactgtatcattccacccctcacccctcctaggtctcatgtcctcacatttcanaaccgaatc

SEQ ID NO: 613663 - DNA, 308 bp, Homo sapiens
gactgtcgatcagtgttggattacactggcacgatctcggctcaccgcaacctccgtctccctagttcaacgcggttctcctgcctcagcctctagagtagctaagattacaggcatgcgccaccacgtcccagctaattttgtattttttggtagagacagggtttcaccatagtatggccaggctggtctcgaactctgaccttaggtgatctgcccgcctgggtctcccaaagtgctgggattactggcgtgagccaccaaagccagccccaacctttacaatttctaagagcagtcttgcccta

SEQ ID NO: 613664 - DNA, 362 bp, Homo sapiens
aaccccaggtgtcaccccagctgaatgaaatcaggagcccagggttttgaaatttttttactttgaagaaagcctgtgggcccaggcgcggtgtctcacacctataatcccagcactttgggaggctgaggcgggcagatcacttgaggtcaggagttcgagaccagcctggccaacgtggtgaaaccccatctctactaaaaatacaaaaaattagccaggcatggtggcgggtgcctgtggtcccagctactcgggaggctgaggcaggagaatggcgtgaacccaggaggcggagcttgcagtgagccgagatagcaccactgcactccagcctaggtgacagagcgaaactccgtctc

SEQ ID NO: 613665 - DNA, 1163 bp, Homo sapiens
  misc_feature (535)..(535): n is a, c, g, or t
tccaaagtgggtggttactggcaatcgtggttgttacttaattaggttgcctccatgttaaaactctaattctataattttaatttaaagcagcaaagtgaacacaaaatgtggccagtttaaagaatgggtgtggccgtgtaacacaaaagtgttcacgagaggtgtaggaaaagccttcttggattttgggttggggccctggcatataggcctgggtcaacgtcaaagggaaccgagtcacatctgggagctaaggaaaccaaagcaagtcttggtggaactctgggcacagtggtatagagaatggctggtgggaagaagtctataagagcaagagggaaggggtctcctttgaaggcctgtgcacgaggggtggtgttaagaggggtgttccaaattaagagggcgggttcctcacgagcgttacacatttcaaatgtggtgaacctcaaacaattctccgagaagctcttaacagaggggtccatagtggtgctactccaggtggtaaaatatgtgggtttttacccanccagattgggcctattccttgggtccctctaagttcgctggtgcaccaatattatttcgggactgcgaataggaggggtttacatacaacacttgcgggttaaaatccccagagaccaattaaatttaatcagcggtaaaggggtcctaatggtgaatctcaacattttataacatttttggagtgtaccctcttggttaagtgggtcaaggggaatccacatgcggcagtggggtttcaatttcgggagacccccagagaacaaaaaaacatgtgttggcccaattaaggacaagaacccccaaattaaaccctgggtgtaaacaggtcgagaaggcggactaaatctcctgggggaaccccctttttctcattataagaagggagcaataatttggggggggcatactttgggggcccctaccacgtttctgataatttacaacccttaagggggcaacgttgccgcacctgtgggggacaaattcttcaaaaccctcgtgggtataatcggcccttcggctgttctatatcaacaccccttgtggagtttctacacgttttaagacggacctttctataataacagggcataacggcttttaaagatatatacccacaggcaaaa

SEQ ID NO: 613666 - DNA, 457 bp, Homo sapiens
cgtcgatctgagggattgtcacagtggtgtgatatcaaactaagacctgcacagtgatccagctttattatttaggctaggtataatgttagtatgttagaatcattccaaacactgtacaagaatatttcaagctatgcaataaagtagaatgagtatttacctgagtattttgtatgaatcattatatgaggcaaggtgaacagcatgaagccgtcatgctttgcagtttgtattaattaaaccttagaacgtggggtagttaggttgagcctcccaaagtgctgggattacaagcgtgagccactgtgcctggcccttttttttttttttttttttaaaagaagatggcttctggctatgtcgtccaggcgggtcttgaactccgtgagttcaagcagtcctcctgtttcaacatacagctacaggtaccccccacgatacattttaaataagg

SEQ ID NO: 613667 - DNA, 412 bp, Homo sapiens
tctgcccctgctcccctggtttgaagtggtgtggtgaaatgtggctggaagtcagtctgctagcctgtggagggaccttcatccagggcatgctcagactcagctagaagcaagcacagcttcctcgcatgctgaggccaaggggctgaaggatgcagaatgcttcttgtactggaatgctgtgctcaccagtatgggtgccacatgggagggggggcaaatatagggtcctgggcctgaggacgaaatgacacctctgtattaaacctctcttttgcatatgtacaaattagattcttgcaagatgagctaacattaggaaaggtcctattatattgtgacttggggtgtggttttaaatagaaccagttttgcttggcctcggatgtatcagttctggataacttgaaag

SEQ ID NO: 613668 - DNA, 238 bp, Homo sapiens
ggctgctgagcagatatcaacgttctggctataaaagggctgaggagcagtaggcaggagatagaggtgggcagtgcattgtcccaccccaggaccctcctggaggggcttggacactgggaactaatgaacggctgtcatgggagctggcacggggtgtctgtatgtcagatgctgtctcatggaggtgactgacagcagctgatgaacatgccctagctcatctcttcctccgcgc

SEQ ID NO: 613669 - DNA, 207 bp, Homo sapiens
taattggtattccggaacgcaaaatacgagaggagagagaggcgtgccaactccctcccctctatccccaagcccttccctgagctctgcagtcctccctcacagagcccaatttctcggggagcccctccagtgaaagggggctgctcccccgagaatgcagccgcccccatgtactaaaggtgtacagtgaggatgggcctgcag

SEQ ID NO: 613670 - DNA, 502 bp, Homo sapiens
gttctttaatctggaaacatcatttttggtgtcaagaatgttcttttgtaggatcccagtgagagtggagagcggagagtggagagtggaaggcatcccttgttcatgccttcatacttggcaaccctagccccgcccagggactctgcagccatctggggggaggggcgtcctcctgacaggcccaggacagaagaccctaccccaacagtcccagagtccgccccccaggatgtcctaaccccacccaccctgtacgcagcagttttagggcagggtccttgagcctgtggccatgggatccagggcctcaactttcccctctgactcctgttgggtctcaggcgatgtaaagaactaaagtgcaagctgtgcctgcactgtggatcccagctacgtgggaggccgaggtgggaggatcactggagcccaggagttcgaatccagcctgggccacagagcaagcaagacccccaccccccaaccccccgccgctctctaa

SEQ ID NO: 613671 - DNA, 546 bp, Homo sapiens
caccgttccgatctctctctcctctccatctcgttcctcccccacctgcgcagccaagaagttcaaaccctagtccagcctgcgagcgccgacacgccgcgccgtgcggcttcccgcaagcaggtgctccggcggaccgcgggggatgagcggagcggcctacagggaccggggattcggcggcgccgcggagatggaccggaagcgcatcaaggaggcgctcgagaagcacacggagaggccgtccccgtccacctccaggggggcgtccagggagaaggagctgctcgccgccggcaagataaccactcagatcggcaaggtccccaaggtctccgacgtcgaggaattcgaaactgacagtgaagattctgatgttagtggttctgaaggagaggatacatcttggatttcatggttctgtagcttgcgaggcaatgaattcttctgtgagattgatgatgattatatacaggatgatttcaatctctgtggcctaagcagtcaggtgccatattatgattatgcacttgatctcatcctaga

SEQ ID NO: 613672 - DNA, 298 bp, Homo sapiens
  misc_feature (291)..(291): n is a, c, g, or t
ccattagattttcatgaagaacccaggagtgatggtctgtggtgggagcttcacccgggaggagtagagagggactgggagagaggtgatgtctaggtacctttgggccacctctcctataaaagatgtagaaaaaacttagagttatatgactgacatagcatatacagaatgatatgcatattcagtgctggacttccattattttgagatatcaattgtgtattaatgttactttctattctctcgtgattttgaaaaataaagttaaatattaaaacattttaaaanaaaaaaa

SEQ ID NO: 613673 - DNA, 1054 bp, Homo sapiens
ggcctgcccacagagccatgcccttcagatgtgcctcagaggtggatgaagatcgctcttagatttggagagtggtgtgccctcagaccatgtgtctatgcctcagagactgggtggacccagtgaagtggtgcgtgtcaggaccctgggtgaggcagtgcatgccgcatgaccgtcaacccctgtgttgagcctagtggtggacagtacaaaggtgaggtaagcggaggaaggtggatgaatgtggtgcgtaggggacgagatgcgtgctgtgttggcctagtgtggtggtgcccagaccatttgtgctcccatttgccgggtccccttgtcctcgcattcgaggagtcgaccccatatggctgaggaacaacagttgagaaagctgggtgctttgagggacgggaccaactataacacggtgtcccgacatcagggttggcgcccatagagaaggggtatcccacattgtgagaggacccctttcgagtaagaacacccaagggtgccaacggaccattcagagatcttgcagagagtggaagcagatagacactctctgatgtatgccccctacatcggaaggagtcgcgcatgtgctctccaatgtaacccggggagtggaccccttgcgaagggggggatttgataccacattgcacctgatggaaggccccaaattcgcgtttgaatgccctttgggccctctgggtcactgtggtccgtgaatggcgttcccaattagggcgagagtcgtattggccccataaggcacaagttgtgagtgccagcctataatctttggtacgaagatagacccatgtggggtcccaacccattgtcgctccatatactcgaggcagtacgcacattttatacagtagagtagagctcttcaaaaggctattcggcttaagatcagtatggacccgtacagtcaagggaaggggagcccagcacgtatgtcgaacctcacgagaaagcctacggtgcaaggttaattctttaaccatatggtgggaaaaccagaaggggctatggagcccagaatttg

SEQ ID NO: 613674 - DNA, 171 bp, Homo sapiens
taccctatccatatagtatatgaactcagctatcatcacatagctgcgagctacgtactatggcactatctgctaatgaggccctagatatcacatacttcctctaatatatctccattattatgaatcaaatgtgtgctatcagctgtagctggtaagtggacggctcga

SEQ ID NO: 613675 - DNA, 309 bp, Homo sapiens
tcacatgtggtacccacgtttgtggtgggaggacagacacacctcaccactctaatagcattctggttcgctgtctctaactggagccaaagctgtttgtgtagcctgtggcacaagttgactctttggggtggtgagttgtttaccagctacactgacccactcttgtctgcagacactggcaaaacttgcagagtgtgtctctactgtgcccagggctcagacgcaggtcgctgccagtgtgatgcacccaccaaaacctccagtgcacaaccaccatctctactctgatgcgtcctcccaccacaa

SEQ ID NO: 613676 - DNA, 1041 bp, Homo sapiens
  misc_feature (14)..(14): n is a, c, g, or t
  misc_feature (122)..(123): n is a, c, g, or t
  misc_feature (126)..(126): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (769)..(769): n is a, c, g, or t
atccaaacagcccngtagcactggtcaggctcctcgtgcttatgtgtgagcagaaattccaaatgcagccataagcatctcaaattcctttgggtttcaggagcccgtgtaatggccggtanngcngntncnccntcgcgtggactgcaaatcctgactggtgtcaccctgttgaatgtgggctgatgtcaacagagttacctaccagggctattctccctaccagctcactgggggccgcccaagcacccggatacagcagcagctgggccagctgacactagaaaaccttcagatgctgccagagagtgaggatgaggagagctatgacacagagtcagagttcacggagttcacagaggacgaggtgagtctgtgaactccttcggcgctctaactaatgaggtgccattcccttcaccctcccaggcccctagagctgctccttatcagaggggtatctacataatgagtctctcaaatttctgtgcataaccagtatcccaagaatgtacctgccccccccctttttttaatagcttactctttttttaaagagaagcattaaaggcaaactccctcagcctgtaaagttcattatatttgggctatggagaatggagtccaagagttatttccagtagtggcctccccatcccggtagcttggcagagctccgctccggaagcttaacgtgtcttttttccccttgttttcagctgccctatgatgactgtgtgtttggaggccagcgtctgacgttatgagngcaaaggggctgaaagaacatggacttgtatatttgtacaaaaaaaaagttttatttttctaaaaaaaaaaacaattcacgaaaaaattacatggaaggaccacattatatatttattgtgcttcgagtgactgacccctgtggtttcctgtgacatgtaacagccaggagtgtaaagcgttcagtgatgtggggtgaaaagttactacctgtcaaggtttgtgttaccctcctgtaaatggtgtacatcatgtatggtaggtaattattaa

SEQ ID NO: 613677 - DNA, 689 bp, Homo sapiens
  misc_feature (14)..(14): n is a, c, g, or t
  misc_feature (122)..(123): n is a, c, g, or t
  misc_feature (126)..(126): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (417)..(417): n is a, c, g, or t
atccaaacagcccngtagcactggtcaggctcctcgtgcttatgtgtgagcagaaattccaaatgcagccataagcatctcaaattcctttgggtttcaggagcccgtgtaatggccggtanngcngntncnccntcgcgtggactgcaaatcctgactggtgtcaccctgttgaatgtgggctgatgtcaacagagttacctaccagggctattctccctaccagctcactgggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagngcaaaggggctgaaagaacatggacttgtatatttgtacaaaaaaaaagttttatttttctaaaaaaaaaaacaattcacgaaaaaattacatggaaggaccacattatatatttattgtgcttcgagtgactgacccctgtggtttcctgtgacatgtaacagccaggagtgtaaagcgttcagtgatgtggggtgaaaagttactacctgtcaaggtttgtgttaccctcctgtaaatggtgtacatcatgtatggtaggtaattattaa

SEQ ID NO: 613678 - DNA, 128 bp, Homo sapiens
gcgagagaacgtgagtattcatccatgtctggactagtgacagaatctttaccccaaaattagagctgactcagatctcaggtcttcatcttattgggaatattcttcagaggttggacttatggcgg

SEQ ID NO: 613679 - DNA, 415 bp, Homo sapiens
gaattgacgccctcgaccctgatctacagatgtactacaatgaaggcaccaaatttcgtacgtggacccagagcacaggctgtgacagtttgctttggaacatggcaaggggccatggccttcctacacacactagagcccctacatcccacgacatgcactcaatagccgtagtgtaaatgattgatgagcgacatgacatgcccgaacttagcatggctgatgtcaagttctctttccaatgtcctggtcgcatgtatgcacctgcctgggtagcccccgaagctctggagaagaagcctgaaaacacaaacaggacgctcagcagacatgtgcacggttgcagtgcttctgtgggaactggtgacacgggaggataccttgctgacctctccaatatgggagattgaaatga

SEQ ID NO: 613680 - DNA, 101 bp, Homo sapiens
gtgatctagaggatccctcataacgtatcagaaccatggaaatggggacccagtcattagggcttttttttttttaactttaagttctgatacggttttga

SEQ ID NO: 613681 - DNA, 723 bp, Homo sapiens
catcaccggcagaacacagcagtgtcggagtgaaagtgcagcgtttcctatgttattcgagatgaacggtggcagaacgtacaaccgaaatgtgagtcaatgctctgcagcctggcatccagcactaaatagacttttcacagccggtcgagaccctactcataagaactactggagctgtcaactcagcacaacgcaagcatccactactatacgcactcctactggacacaccactactgacttggcgtaaacgaacacttgtactcctgctccgctacacctgcgcgacacccacactctacctactctgcctctctctctgcaccaccgacccagcctcacccccgcctatggacactgccaccaccacacggcgcactcctccgcactgctcacccactcaagcgcaccccccctcccaggacctctacgcctcccagccgccccttaccccccctactgccaccggcactaccgcacactacctacgccactccgccctggcctctgcgaccgcacccaactcattccctctgcggactgtgcactccctcctaacagccacttgacctgcccctccacacttaacccctgctccaccacaccttcttcctttccccctggcaacaccaccccacttccactttactacgccttggcccatgcccctcaacctgcgcacccctcactcgcttctcccggctccacctgaccccgcgt

SEQ ID NO: 613682 - DNA, 353 bp, Homo sapiens
tgtggtggtaaccatcgctgtaaacggttcatcataggcgcctacacggtatgcacctgatagacgcgcatgtcatctccagcggtgtcgaggactcctaaggttcttgaccatcagctttgaaaggtgatgccattctgactaagtgccattctgctcgatatcgtcgctcggtctctgggccttaatcggtgtgcagtgagctaccagtgaagacttttgagtgtcccatgttgcaaccgtcgtacagagaccgacccgccagcttctggccctacggctgtatcaggccatagtcggtgcgcacttatagctggctgcgcatctgcaaaacggtgcgcaggaggttagcg

SEQ ID NO: 613683 - DNA, 451 bp, Homo sapiens
  misc_feature (66)..(66): n is a, c, g, or t
  misc_feature (151)..(151): n is a, c, g, or t
  misc_feature (169)..(169): n is a, c, g, or t
  misc_feature (195)..(196): n is a, c, g, or t
  misc_feature (237)..(237): n is a, c, g, or t
  misc_feature (240)..(240): n is a, c, g, or t
  misc_feature (247)..(247): n is a, c, g, or t
  misc_feature (374)..(374): n is a, c, g, or t
  misc_feature (442)..(442): n is a, c, g, or t
  misc_feature (447)..(447): n is a, c, g, or t
ggcagcggcaacctctgacctggcctcttctggggtggtgtccttagatgaggatgaggcagacangacggaacagtgacccacatcatgcctggcagtggcatgcatcccccggctgctgcagggcagagcctctgtgcccaagtgtggntcaaggctcccagcagantccacagcctagagggctcctggganngctcgcttctccgttgtgtgttttgcatgaaagtgtttggngangaggcangggctgggctgggggcgcatgtcctgcccccactcccggggcttgccggggggtttgcccggggcctctggggaatggctacaagcttgtggcagacaagtgaatgttcatgttcttaaaaattgcnacacacacattttcctcctccggataaatggtgaaccactaaagggggttgtgactgggctgtgtgangtccnccct

SEQ ID NO: 613684 - DNA, 548 bp, Homo sapiens
  misc_feature (394)..(394): n is a, c, g, or t
  misc_feature (429)..(429): n is a, c, g, or t
  misc_feature (456)..(456): n is a, c, g, or t
  misc_feature (523)..(523): n is a, c, g, or t
gaaggccagaagtgcatgtgtgaggggggaaagggagaaattgaggaataaagtcatttactatggaggtacatgagaggtagagaagaggaggtggtgttgggagaacgcactttgctcgacactgggcttctggtgattcttagtattggtccatgaaagttatattcaaattctagctatgatggctctttcctgggattaaatgagctgacatacctctgtgaactgtagcagaagacaggggctcagcccatgccagcccagcccctcagggctctgtgctcttctagggatggatggttttggtaaagaacagacgcccagcagcccccggtcactcagcaccagtgtgacagtccctcctctctctgggggtgtgtaagaaaacggnccctatttttaggacaggaagagtagagggagggnctgcagcaagattccatgactggctgncttatctgggaaggagaataagctgagtgaaaacaggctgttcttgctgtcctcccttcaatcacantctccaaatcaggtctctaggggat

SEQ ID NO: 613685 - DNA, 461 bp, Homo sapiens
tgtaacaggtgccatcgaagagaaacggaaaacaatcaactggatgaagatattctctttgctatgtctacttcatgctttgacagttatgtggaacctctgaatttataccttcataaattctgataggctatgaaaggagaaaagcggcaattggctgtgagcagttctcagtctctgtattgctgtaattaaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctg

SEQ ID NO: 613686 - DNA, 179 bp, Homo sapiens
acctcctaccccacggggaattatagagtccctcgtattcatcacttgtgtatgtcttgagtgaaacatatgtgttatgccttattctaaaattgagtctcaagactggaatgccttggaagacagatgcttctatagaggttcttggacctaaatagttcagcatttgtatttttatt

SEQ ID NO: 613687 - DNA, 1334 bp, Homo sapiens
gtattaagcgcgtgtggggaaaatttgttctacaactctcgcgggtggagggaataatttgtgagtgaggctctccaatggggcgaccacctcttgtggtacagagatttttgcgttcgccctcttgtagaaaaaaggggttaaacgtagcgtcacaatttttcaacgtgtgtttgaccccctatttttggcccgcagtctatattcgaaggtcctttgggggtgttttggacaagggctttcaaacggggggccgctgggtacccctggaaatgtgggctacaacgaataatttggatattttggattttgcttgcggcgcagaaaaacgtgggaaatttgtgttaatgaccgtattttgtgggggagatctgttgtcaggacctttccttgtgtcccaaccaaatgacaccgatgggggcacagtgtaagagcccccgagaggagacacaagaaacgttgtggggaaaagttattcccgggatgttccacccacaaatttggggggaaaacttcttgccataaagtgctgtgggttgtttacgtggagcctttgtggtctcaattcccgagattgttgttccttggaggggtaagccccccctggagaagggttgttatgaaaaccattcatatagccacggtgggcccacgaacccccctggtaaaattataggaaaagaatttagaaagtgtggataaagagagcgtgtataatagaaaggaaatggtgtcccccacagatgaagaattgagcattttgggaatgagagttggaaaaggctatattctcacaaattaaagggcgcccggcctcacaaagttagaaatgtgttataatgtcccgggataaaccgccaatggaaggctgtctgaatagggccacctggtaagaaaagagggaatattgtttctttcactatgatatcccaagaagatgtaagaaggcgcttcactgctcgaaagatttcgcgtttattggacccactcaattttccggagagtcccgcccaaatgaatattaaacgcttctcacgctggaggaatcacaattttggaagacccttgggcccccccaggaacttggcgcgccacagcgggaggacgaaggtggaacgtgggccgtggtgggcgccccaaaccctggcacccacaggagccgacaccaagtcacacagtgcattcttgtctcctcgaatttggagttaacccacagaaggcacattcccacgctttggcttaactggaaccctaagaccacccgcggtgtcctattgtgaacccttctgttcaaagacttttgcaagccttaaggattccccaccatttatgta

SEQ ID NO: 613688 - DNA, 109 bp, Homo sapiens
cctccatgctcatcggtgccacgcccccctccgtccctccacgtagtagaatcttgggggcggaggcttggaccgggcccagacgactgatcggaagactcactttcct

SEQ ID NO: 613689 - DNA, 274 bp, Homo sapiens
ggggctcagttgatcctcaacaagtcatcttctctaaagataatagattttttttttctaaagacggacaatcctccagcctctgggacccaggtggtgaagttaattctcacgggggagatcaacaagcggggtaaacggcagaggtggatggcgggccgggtcatctagacacctcagggcaatcattagcaaggccttctttcaagggaacaaaaaagcggggggggggggcatatgccggtaatcttaccacttcaggaagcggaggcgg

SEQ ID NO: 613690 - DNA, 484 bp, Homo sapiens
tcactaggacatgaacgagaccttcaaggagaagtttcctcacataccgctgacatctcagcaaaattatggagtctgaaacgagagatgctgtgaagattgctgcggaggagtgtggccttgaggagcccacggtggccatggcctacggctacttggaaaagctctgcctcaaggggaaattcaacaaacagacccggacgctgtgtgctggggcatgtgtgctgttagcagccacaatcggaagtgacctcacaaaaacacgaagtcaagcacttacttgacaaactggactagaagtaccggctgaacaggcgagaactgattgcctttgaatacccggtgtccgtggcctaggaattctgcctccagtagcccgagcacacaaagtcttgccccaatacagacaggcggtccagagttcctaggcaatgccccagaaggacagccgagggcaattatctcctcaagcaggtgaacagga

SEQ ID NO: 613691 - DNA, 265 bp, Homo sapiens
aaagaatgcatggcagagtgctgtctttaacagctttaactgtggcaggaactgttatgtttttttgtttttcttttttatttctggagtcggagtcttgtcctataacccagactggggtgcagtggcacggtcatagctcactgcggcctcagactcaagctcaagcgatcctcttaccttgcctcccaaagtgctgggattacaagcatgagtcaccgcgcccggctcattttaaaatttttgtagatcagtgtactgttgt

SEQ ID NO: 613692 - DNA, 604 bp, Homo sapiens
agcttcgccaagctcgccaagagtcccccgcgcttgggccagggtttttagggccccacccaaaaggccatctcaaatggaacaccccatggaaaccatgatgtttccatttcccaaattcggtggggataagggctacttccaaaggaggccctgagggttctcatggaaaaggagttccctggatttttggaaaatcaaaaagcccctttggctgtggccaaaataatgaaggccctggcccagggtaaagatggcaaagtgggcttccagaggtttttttccctaattgggggcctccccattgcaggcaatgactattttgtgggacccatgaagcagaagggaaagaagtaggcagaaatgagcggttggctcccccctgataaaggttgtcccaaagggtgggttaaggaatttgccccccagcttcccccatagaagggtttcatgggcagatcggggcccttagcaaagggaaaaataaaatttaactttcttttgccaagcagagaaagaaaagttaaaacccagataagcttttgatttttgtattgttggcacccccctgcccccaaaaaaaaaagtttttttttagttccca

SEQ ID NO: 613693 - DNA, 237 bp, Homo sapiens
cacacccccactttccccctagggttccattggaatattgaaaaggattcccttccttggaatttttttttaaaaccaaccaaccaaccaaaaagcctgtccccccttgggattccttcctttccttgggaggtcaatgtttgggtagatgaacccttttcatgttttggggctccggggtttttgtttcttttttttgcccttgggggagggttttgaataaaagttggggcccca

SEQ ID NO: 613694 - DNA, 219 bp, Homo sapiens
tctagaggatcctctacactgggttcgagtcgaagaaagaaacatatgcttgccaggagagagctgggcttccaagttacctgaccttaaagatgctgaagctgtgcagaagttcttccatttggaaggaaaatacagcttggtgaagagttactaggcctcccaaaagggtgaatatggagaaaaggggggcgtagaccatcttgaccaaaattgcaa

SEQ ID NO: 613695 - DNA, 423 bp, Homo sapiens
tgaggatcccgcagctcgtgggtctgggacttacatggttagccacgtgcgcccggcgctgtgtttttaagatgcaaggttaaacaacctgagagtgtttaaaaactgtattggttggtttatacttcacttcatcctgaaagactattcaaggtagcttacagagatgtggagaagccaaatataaagagagacatctcgaacaaatgtgagcgtaagattgggaatgcgatgtcgtaatggtcattaaaagaaagctgcggtaactatgtgtatattgggcacagtagatatcatagtagagaatgtgaacagggatatagagggtgatatcatattgagacacaggtctacttactatgcagagatattaatcttaaaagtatctcatgtggggagatgtgcgtgtgatcttagaacttt

SEQ ID NO: 613696 - DNA, 256 bp, Homo sapiens
tataatagggactttagctttgtcgtccaggccagagggcagtgtcaggaactttgctccccgccttccgggttcagcctccaatgtagctgggactacaggtgcccaccaacacgctcgactaatttttggtatttttagaagagatggggtttcaccgtatcagccagaatggtcttgatctcctgacctggggatccacatgcctgggcctcccaaagtagctgcgattacaggcgctcaccaccacgctaag

SEQ ID NO: 613697 - DNA, 860 bp, Homo sapiens
acctactattcatattgaccatcataagaggcacaacaccaccacccacacacggaactttcatcgctctacatggaaggactattgtttccagcatgactggcagcactagctcatgtaccttatcgagtcgtactttctctctcttactcgccttggcaaatagctgggcgtcgtagatatatcatcaccattacctggagaattattcattcacatggacggcccggctcgccttctcctatgccccatcacaaccaccgatgatgtggatattattttatctattccaatgttcttaagactctatatgattgccacagtcatgcttttacataccaaacttttcactgatgcctcctctcagaaacatatggagctacttaataccaccaactttcattccccgtcccgttatgaagactcccactgactagatgacccgcaactgatcctcctgcatttccacaatcttattatacccacacttaacgcttcgagtgtcccgcgctcgtggcaccgctcctgatcaatccgccgtttccaccccctcccttgtatcgatgacaccccacatccctaaatccccccctccctgcgctatgcagccatgtactccacccaatcatgcggatcgcgaccctgttcactttctggcacccctgcagacggacgatactcaacccgggcagctgttctccatgcgcactcccccctaaccaaacgccaaaaaccaagcccactatttagatctctcaaccccacacaacgatgcgcatgccgtccccccaattttatgaaccaacccgaccacgacccaccccccaagccaaataaatcattcaccaatatcacaaacc

SEQ ID NO: 613698 - DNA, 160 bp, Homo sapiens
agctattctacctgctcggtggtgatgtttttttcctaagtagaaactgaagcactcctcttccaaaatacagagactcactgtgttagtctgttttggcgttactaataaaggcgtacctgagactcggtaatttgtaaagaaaagaggttaactggct

SEQ ID NO: 613699 - DNA, 283 bp, Homo sapiens
ttccaggcgctctcgacctcagaacaccatccacagagtcccaagtataccacgcaggcacagtaaactcaagagcaatgagaagcaccgaatgccagctcagatatcattctgtgcctatcatggaaaagacactaggaggaagggcctggggcttatattgggatgtgaaaaacagactctgaaagaatgtactgtcaaatatgcttgaatgttcattttcatgaaacaattcccctcaagtcgggtgccctgaaaagcttgtgtatcatctcagctcaac

SEQ ID NO: 613700 - DNA, 976 bp, Homo sapiens
gccccgcaggccctggggctctgtccgcgtgggcccgcgctgctcgccccgagccaggagaacgagctcgaggaggatgcctggtgccctgtccctgctgctgtgccctgtggtgatggcactgccctgctgctgccctgcctgtgctgccatgggaatggagctgtgtgctgcctgctgcttgtccccctgcctggcgcgcggcgacgaccttgcagacctgccactgggcggcccccgtgcctgctgggtccccgagtgacgctggctggcacctgagagtgtggcgctgggccctggggccacgcagcggagcccagtgtccagtgaaggcgtctgaggacccgccgcccgtgccgcgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagcggcagtctggccgggagcgccccgggccatggcgccagcgcagccaccaacacaccgatagccgccatggatggcgcctggcatcacgcgccactcgccattcgcacgttgcacgttgcaccccgatgcttgcaccacgggcccgcgcaagacggcacgcgcacggcgcaccccagacccggaaccaccagggcgctcccgcacccgacgctacgccaccgtgtcggatgacgacaacgggcgctggagcttaccccgcgcccacgctggaactcgtgcacattgttccaaaccacacgttgttaacgacacaggccggtgctgattggcagagcccgccgacgcctaatagcagaggtgctcacgcgacacgccgcgggcatctaccgcaggatcgtcaggccattcttgattgccgcgaagagc

SEQ ID NO: 613701 - DNA, 92 bp, Homo sapiens
  misc_feature (91)..(91): n is a, c, g, or t
acctttcatatgactaaatcttttgaaactatgtttttcctttaaattttaataaattttcttatgtttttattatggcaaaaaaaaaaana

SEQ ID NO: 613702 - DNA, 1019 bp, Homo sapiens
gaccctcatcaagaagatggagacatacagaaatagtactaaaccacatttacaaaatgccagtatcaggcggcggttctcgaagccaaagtgatgttgggatgtcaagtgaaatattagtagggcgggatgaacgcagagtagtgaggaaagttgagccaataatgacgtgaagtccgtggaagccgtggggctacaaaaaagtgttgagccgataaattgccgtcggaaatggtgaagggagactcgaagtactctgaggcttgtaggagggtaaactagatggagggccacatctgccagagcctggagttctgcaaaggccgggacccggttcccgggcccacaggtgggggtgttgcaaacccgagagaactgggttgcaaattcgggaagaatcagcatcaggttgggcagctgagtatgggagccaggagcctgccatgaggtttggggaacagagtgctgttttagagctggcagcagcatctcagccaagagaaggtaatattcccagaggatgtcagtcccaaggaccagtagttgccatcagttgggatcctgaaaactaactgggatccacacggggtgtagaaccatgcttgcctaatggtatcagcaggccatgctcagcaatcccagacgatatattgggcaactttttctagacaaggggccattggggtaacactcatcaccatttgggagtctcggggctcacatatacactatggtagaaccctgtggcgtaaattccccaggtgtacagtgtgtgcggacacacacacagctctaagtgctcccaaaaatacgcggggcgcatagagagattactcccccgttgttgggggaaaaatagtcacacaacacgcggtgggtaaaaaaatctcttgggtggaggacgcactatttaagtcaccagggtgcgacaactcctgtcggaaaaagatcgtgcttttgataaagagacgcaataataatagtcgttcagataacagatggtgatctcttcagaggta

SEQ ID NO: 613703 - DNA, 332 bp, Homo sapiens
  misc_feature (123)..(123): n is a, c, g, or t
  misc_feature (165)..(165): n is a, c, g, or t
cacagaaggtgggcaggctggggctgagcaggagatgatgaatttcatgtagacaggtgtgagtttgaggcgcctgtgggacattcatgagaggtgtctatgggctccagggctcgggctagngaaacgcatgtgggagacatcttacagctgatgtttgaaggntgggcttgcgtgaggctctctagaaacatgatgaacagcgagaaaggagaaggggtcatggacaccaccctggggtacactccactggagggaggctgggagcggagaagccaacaaaggaatgtaaagagggcttggatcatattcccgtcctacagccaaataat

SEQ ID NO: 613704 - DNA, 1390 bp, Homo sapiens
  misc_feature (62)..(62): n is a, c, g, or t
aggcttggtactgggccacgcgtaaataccaaaccccacatgttctccctccccccactaanaccccacatgttctcccaaacttgaatgatggacgctccctgtcagtgccctgcagatgtgatctccgcccctacctgaccgtggagcaaagaaggctgaaactgaagaactgaaaaaaaatggaactgagtaatacacgcacgcactatgtaacaagaaaacaaggagatacacatatggatgtgggataactaggatggagattagatatagataagtgaagaaacaaaaaaaagaaggaggatgaaaaaaaagaaagaaaaaaaaagaaaagataaaagaaaaagataccaaagaacacagaagaaaagcacacaacaaaagaaaacagaagaaagcgacaccaaagaacaaagcggacacgcagtcgaccatgaccaaagcaccacagagaaacgaacgacacaaaacaaaacaaaaacaatagacacgaacgcacgcgaaataacacaaaacagagacacaaaggacgaacacgaacaaaacacaaaccagccaaggcgagaaaaaaagaagaaaaacaacacaaaaaaacgacgaacaaaaaagagaacagaaacacgaaaagaaagagagcgaaccaaaagccaaggaacaacgagaaagacagcgcgagaaagataacaaacaaaaagcacaccaaagacgcgaaaacacgagagcgactaaacaaaaaaacaacacagacaggcgatacacaaagagagacaaaaaacaaagaaacgagcacagacaccaaaatcgaacacgagaacaagagagacaagacaacaagaaaacaacaccaaagacaaacgagagacgaagcaaaagaaagcgcgcacccaagacaaaacaccagaagaaaaacaggaaccacagaagaagacaaagacaaaccagacagaaaagacggaacacacagccacaaaaacgcgaacgaagaaacaagatcgacaaaccgatggacccaacgaagacaagcaacaccacaccaacgaacacaaaagccaacaggatacgacaggagaacagacacaagaagcacaaaagacacacgccgaaagacgggagaactaaccagcaacaagacggaagcgaccagacagaagaaccaaaacacaaccgcgacgaacagatacaaagagcagaagcaacagcactacaaggagcaaggcacagcagacaagccagacgaaaacaccaagcgaacaagcacgagacgcagacgaaagaacagaacaagccacagccaacgaatcgagaagaacaaaccaacacacgcagacccagcgagcgaaagcagaacgcacccaaagcagagcgacaacacccacagaccgaagag

SEQ ID NO: 613705 - DNA, 149 bp, Homo sapiens
caaggctggtctcgaactcctgggctcaagcactccgcccgtctcagcctcccaaaatgctgggattactggtgtgagccactatgcctaggtcctcttgcttaaaaaagttttgggcttcggtcatcaaacctaatttttgaaatgta

SEQ ID NO: 613706 - DNA, 642 bp, Homo sapiens
agcgagagaggcgcgcgggaggtcgtctagggaatcgaggtgccggctgctccttaccacacaatatacgagcagctgcaaggggagggtaaccatcatctagggacccagatggtgtaatggagctagacgggagattcagctcaatagacaatggcagcacagcacgcggcggaagtaccaagagggtagaggcaaccgcagacagccagagacacaagcaaactacggacagaacaggccagagagagagggaaggagcgaaagatgcgaaaacgaggaaccgtagcgagagcatcaggacacaccatacacagaccacaagacggcagacacgagggcccgagcgatatgcgcgaccagaccccgagcaacacgggcacacgaccaccgcaaacaacagaggcctcagaacgtgcaacaaaagtaagcacgataagacaccaggcgatgatccacaggatacaagaacgcgaccagcaccacaatgaaacaccagaaagcaaccagagcaaaagccaaacaacagagccatccaagccacacaaccgatatacacacacagaaggcgagactcacacgaagaaataacccaaagaaacgatgcgaggtagaagcacaccagcaccgcgcagcgacaac

SEQ ID NO: 613707 - DNA, 368 bp, Homo sapiens
gagcccctgggcccagctgattattttttttaaatggccccttatagttataggtgctcccccttttcagaattttttggtcctgttaggaaccaagaaatcatcccttgtggtttgccccccctaagaaggccatggctgggtaaagcctttgagttagagccctgtcctgatgtccttcagctaagtgggttgaagtaaaggaaaaaaattcccaaaagtccctttttgccccctgaagttttcctgaaattttagttccctttttttgggttgcatataggctggtttgggggcccccaactttatttctttccataacctgtttccctttaaaaccaaaccaaattaaaccattttccctttta

SEQ ID NO: 613708 - DNA, 459 bp, Homo sapiens
ggagacagggtctcactctatcacccaggcgggagtgcagtggtgtgatcatggctcactgcagccttggcctccgaggctcaagtgatcctcccacctcagcttcctgagtagttgggaacatggatacatgccactgagcctggctaattttttttttttctggtagagacagggtcctgctatgttgcccaagctggtctcgaactcctaggcacaagtgatccgtctgccttggcctccccaagtactgggattacaactgtaagccactgtgcccagcctcatctgttgttgttggtggtggtggtatttttgagacagggtctcgctctgttgcccaagctagagtgcagtgagctgagatcgtgccattgcactccaatctgggcgacagagcgagaatttatttaaaaaaaaaaaattaatgaaaactgataccttttcatggaaagcact

SEQ ID NO: 613709 - DNA, 617 bp, Homo sapiens
agcggggtgatccgccagcctcggctcccgaggtgccgggattgcagacggagtctcgttcactcagtgctcaatggtgcccaggctggagtgcagtggcgtgatcttggctcgctacaacctccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttccccgccgcatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggctccccgtctgagaagtgaggaaaccctctgcctggccaaccgccccgtctgacaagtgaggagccccttccgtccggcagcaccccgttgggaagtgaggagcgtctcagccggggcaccccg

SEQ ID NO: 613710 - DNA, 994 bp, Homo sapiens
gcgtatacgagttgcttcgggagcgagtcctcttgttatacgttatgtgtcctcccgtgtaaaatgccgcgcggaaagagtgggataacaccccagggggcccatttgctggaacccccgacggttccgcgttgttgaaccagagccacaaaggccgttttttggaggctgttccccacgggcacggggcctggattcttcaacttgggcacaagtgcccttcgagcagattctcacccttccagagctcaaggccaaccccttcaaggaccgaatcttcagggtcttctccacatccccagcccaagcaccccttagctttgaggacttcctggatctcctcagggtgttcagtgacacagccacgcccgacatcaagtccccttatgccttccgcatctttgaccttgatgatgacgggaccctggaccacgagaagagcctgagcccggctggtgaaactgcctcaccgggagaagggcgaggaacaccaccgggcttaagtgcgctctgaagatgaagcacgctcacatcgaacaaacgtgaggcacacctgaggcacggcctgggaacgggagggaagcacattggggctttggcccgaaaactttccctttcccacgagtcctcggaggaagtctgaacacttgaaccgggatggagaccactcaacctctttgagttccagcaacgtcatttcccgttttccagaactttgccagctcctttaagattgtcccgtgacacagcagccccacgcgtgtgtcctggcacaccctgtcccagaacctttttactgctgaagctgtggccaaaggtcaaagcctgtgttgccaagtgcgggccaaactggcccaagcctggagagctggcgctgtgcaagcctcaaccccgggcacaggggcggccctcgttgtcagggcctctcctcactgctgttgtcattgctccctttgtgtttgtactaatcagtaataaaggtttagaagtttga

SEQ ID NO: 613711 - DNA, 361 bp, Homo sapiens
ctcactccccgttggcacctggcgacagctggtcgctagaggactgaccaacaagttcgacgctttgaaagatgatgacatgtggggaccatgatcagaatgaagaaaacagctatcaacaagatggttcaagaagtccagacctgacatatacgactagaaaatgcccaaacccagactataggctaccagtgacgcctattccagtgaaaggcaacgggaaagtgggtcgccccacagcttctaaggcatcccaggaaaagactccttctcccatagaagaacatgaggaaccggatagcccgccagaaaagaatacatctactagccccccacccgagaaatctggggatgaagggtc

SEQ ID NO: 613712 - DNA, 172 bp, Homo sapiens
tagtataatgatgccagcagctaggacttggagagataggagaggtagcctgctgtgattaggaaagatcagacgaagaggggcgtttggtattgggttatggcagggggttttatattgataattgttgtgatgaaattgatgtgcccctcatagatagtagtgagtacac

SEQ ID NO: 613713 - DNA, 474 bp, Homo sapiens
tcgttaggccagagtgacggtatccacccactatcggggaactatcagaatatacacggaatatgctgaggaaggctgccagagctctgacgaactcctgcaggttcacgtcttgaacagtaactccaggcatcgctgcggcctccgtgctgccagccaggggacagggctgaattccctctaagtgggacagacgagctcaggatgtgcttcccagcttctctggattaatttgacctgaacctatatacagatcccttctgcccctgaagacctatccgcactcaacttctaacatgacgaactctactcgaatgcatcctttactttgcctgagctctattcgtgttgcatgtactaatgttgattccttcctcccaacatgtctccactgagcgcacccacagtctcccctagtcttcctctgtgggtgtgactaatgtgattataaccaacaaaacccttgactgttct

SEQ ID NO: 613714 - DNA, 410 bp, Homo sapiens
cccgtgatgtgtcacgtagaaaggagaagactgctctgagcacgactgaaactttgaaaaggaaggaataggttatcatcaggcagaaatttgattaaggcagttcaatgttgcgagcaacatgtacgacatacgctgagtcagagaaaatgttaactggctcaggaaaatcttcaagggacaggcataacagcaggcagttcagctcgttgtgctgaaatagcccctgtgttaagaacacgttctctgggtcctgtatatgctgctcggccatcagaggaagcatcagtgaaaacagtgacagcttcaggtaatggggtgtttctagtaatgttacgtaaagtccaagacgtgagtttaaggaactgaaataattttacatgaggatagtgattatcaattatacctgg

SEQ ID NO: 613715 - DNA, 527 bp, Homo sapiens
tatggagccagggatttgaaccgcgctgccaggaagttcggtgatccagctgccgagtagtcgcctgtattcgaatcgcgatgatcatcccctctctagagaggagctgggatccctcaagtacagtgagctgctgaacttagccaagagtctgggtctccgggcaacctgagggcaaccaagtgtggtgaacagccttgatcggctacattaaacatgaggccaaggaaagggaaatgagaatcaggatgacgggtcaaacttctgcatcctcttgtgatgagactgagataccagatcagcaaccaggaagaagctgagagacagacacttgggccatgtcagcaaaaccaggagaaggtgcaagactgtccgtggtggaccctgactcacagcagaatcattcagagataaaaataagtaatccccactgaaattccagaatcatgacagcaggaaagccaggatctcaagagctactgcaaaaagttccttctccaccagaggagcacaaagaagctgagaat

SEQ ID NO: 613716 - DNA, 649 bp, Homo sapiens
  misc_feature (12)..(12): n is a, c, g, or t
ggttctctcttnccggacctggtccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgac

SEQ ID NO: 613717 - DNA, 803 bp, Homo sapiens
gtgcccggaggtaacggcacttggactccaggcggacttgaagccaggtgttgttccctgagccttcgattcctggctcttttgggacaccccaacctggcggcggccaggctcagacgcatccctggagactccctggacctagatcccgcagatctgcccgaccccccaggccgaccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgac

SEQ ID NO: 613718 - DNA, 901 bp, Homo sapiens
  misc_feature (68)..(68): n is a, c, g, or t
  misc_feature (320)..(320): n is a, c, g, or t
  misc_feature (347)..(348): n is a, c, g, or t
  misc_feature (374)..(374): n is a, c, g, or t
  misc_feature (418)..(418): n is a, c, g, or t
  misc_feature (433)..(433): n is a, c, g, or t
  misc_feature (435)..(435): n is a, c, g, or t
  misc_feature (438)..(438): n is a, c, g, or t
  misc_feature (447)..(448): n is a, c, g, or t
  misc_feature (463)..(463): n is a, c, g, or t
  misc_feature (488)..(488): n is a, c, g, or t
  misc_feature (531)..(531): n is a, c, g, or t
  misc_feature (538)..(538): n is a, c, g, or t
  misc_feature (543)..(543): n is a, c, g, or t
  misc_feature (569)..(569): n is a, c, g, or t
  misc_feature (600)..(600): n is a, c, g, or t
  misc_feature (603)..(603): n is a, c, g, or t
  misc_feature (607)..(607): n is a, c, g, or t
  misc_feature (610)..(610): n is a, c, g, or t
  misc_feature (613)..(613): n is a, c, g, or t
  misc_feature (683)..(683): n is a, c, g, or t
  misc_feature (701)..(702): n is a, c, g, or t
agcggacagtgcaggcgcccaagccgccgccgccagatcggtgccgattcctgccctgccccgaccgncagcagctgaccatgtcccatcactgggggtatcggcaatagacaacggatcctgcagcactggcagtaaggacttccccattgccaagggagagcgccagatcccctgttgacagtcgacactcatacagccaagtatgacccttccctgaagcccctgtctgtttcctatgatcaagcaacttccctgaggatcctcaagcaattggtcagtgctttcaagcgtggagtctgatgactctcaggacaacngcagtgctcaagggatggacccctggnntggcacttacagattgattcacgttncactttcactggggttcacttgcatggcacaaggttcagagcantactgtggtatacancngantatatgctnncagaacttcacttgnttcactggaacaccaaatatgggcnattttgggacagctgtgcatcaacctgatggactgtgccgctnctaggtnatcancgtgaaggttggcagcgctaaaccgngccttcagaaagtcgtcgatgtgctggtatnccntttncgnacnagggcaagagtgctgacttcactaacttcgatcctcgtggcctccttcctgaatccttggattactgganctacccaggctcactganncaccctcctcttctggaatgtgtgacctggattgtgctcaaggaacccatcagcgtccagcagcgaagcaggtgttgaaattccgtaaacttaacttcaatggggagggtgaacccgaagaactgattggtggaccactgggcgccaggtccagacactgaagaacaggcaatccaaggtttccttcaatagatggtcc

SEQ ID NO: 613719 - DNA, 126 bp, Homo sapiens
cagacaaacagtgcctcctgagtaatttgtgactataggcacattctaccatgcctggctaatttttaaattctttggtagggggtcttgctatgttactcagtgttggtctcaaacctctttggg

SEQ ID NO: 613720 - DNA, 921 bp, Homo sapiens
ggtgcgtctgtccgggccattgttgtgtgttgtctgattatagttcaccaatccttgtcacttggtcgcgcttcgtgtgtgtatacttgcactgtattccctgggccccatttggatgttttcacgttcagctaaacgtcctctggcgactgtattctcgcccggaggcctaatgccctgggccatgcccccggacccttcgttcccggatcccttctcccaccttccggggccaacatcatctgtctctttacgcggtccggcgtctgaaacacaactatgacacgcgacttctggaacaaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgac

SEQ ID NO: 613721 - DNA, 103 bp, Homo sapiens
aaattcgcggccgcgtcgactaggtgcgagaagacgacagaagggcgaggctacaaaaactaaccctggatcctactctcttattaaaaagatttttgctgac

SEQ ID NO: 613722 - DNA, 561 bp, Homo sapiens
tgctttacataagcacagctgatttactcgtatagagaggatcataatataaccggtacatatttctcttgttttatgtaagtggatgtatatcctcattgtgtcatacgagaccagttcccgacttaagtgaggcgtactaatatctaggttgcgcgggctctaatattgttgtcatggtcaattgaggcccatttattacattattatttctcgtccacaagagatgcattgtgacggttcaccgtttgctgcacgtgaatttggggtgatgagacatagatgacgccataggtgtcgtttacgaagacacgccttcagtgagatcgaagctgtcctgagatttatggagagcgaaagcacggtatctacctgcttttccaagaacacaagtgctgcataaacccaagtgaagaagaatacattgactttgctttgcaagacaactaaacacagagtatatggctagtgctaaaggtcgtcctgcttattgtgggtgtgaacaattgtaatcgggcaagagtatggtcatcattggtgatacacagcacctgaaaacgg

SEQ ID NO: 613723 - DNA, 722 bp, Homo sapiens
gcgggatcgtcgagtcgctacggtgacccgttatggtgcctccctccgatgaagaacactggtagagttacagagattcgaaagtacagcccaggcaacgccagaagtatcattcattgtcgtactgtttcgtgtgggtcaaagatcatagcattgattatacgagcgacgctagtgaaggcatcttgcgccacctgtggttccctgtcgtgatgacgatgtctggtgttgcctttggacgtacacgtaccacttccggtctgttacgggcggaatgtactcggcatcgaataagaactgtaacggagttggaagaagaccaggtaggagcgcgtcgcgtctgatgtcgtgtatgccatacatcactggatctatgggtaaacatggagttaatctctatgctgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagtccgaagtcgcttttcccaaagggcgacgggccagcgaggctacaaaaactaaccctggatcctactctcttattaaaaagatttttgctgac

SEQ ID NO: 613724 - DNA, 290 bp, Homo sapiens
ctcatcctacctatacgtcttgtgatgtccaatcgtaccgtggcatagtatagtgctcgtcactagatgactcgtcagcgcgggatctcgagcgatctcatcgacagctgctgactcctaggctgtgacgttcgtctctcgtctgaggcgggtgtcgcattcgcagccagaccgacgcacacaacctacgtcgctcaaggagttcgagcgtgccagaggccgacgggccagccgaggctacaaaaactaaccctggatcctactctcttattaaaaagatttttgctgac

SEQ ID NO: 613725 - DNA, 703 bp, Homo sapiens
  misc_feature (12)..(12): n is a, c, g, or t
ggttctctcttnccggacctggtccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacaaaaaaaaagagaagtcggtatgcaggcgagaaagaggagaaaaaaaagaaaaa

SEQ ID NO: 613726 - DNA, 993 bp, Homo sapiens
  misc_feature (12)..(12): n is a, c, g, or t
ggttctctcttnccggacctggtccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaccaaaaaaaaaaaaaaaaaaaaaaaaaaaaatttgtgggcggccgggccggaaaagtttaaaacctctcggtggggccgggcggcggcgcccaggatgggtacggtgagaacctggccaaataaggtgctccaaaggagaaaccgtggcgcatgagactaagggctgtggttttctccaccaaataaaaaacggcgcgcggggggacaccgggagctggttttagaaccaaacctcaaaaaggaggcgtccaggacgcacaaaacgggtcctcttacacacacaggagggccacaaggggggacgccgagatattaaaatttaccgcgcgcgcgtggggaaaaat

SEQ ID NO: 613727 - DNA, 575 bp, Homo sapiens
  misc_feature (12)..(12): n is a, c, g, or t
ggttctctcttnccggacctggtccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgac

SEQ ID NO: 613728 - DNA, 634 bp, Homo sapiens
  misc_feature (12)..(12): n is a, c, g, or t
ggttctctcttnccggacctggtccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagagttacgattcgcagccagtacgcattcggcaagcccaggaacccgcacagcacacaactagctcgtcaggcgagtgcagctgcaggacagcagcgcagtacaaactactgatctatctctataagttgtcgaacaaaaagtgcaggcgcgat

SEQ ID NO: 613729 - DNA, 295 bp, Homo sapiens
atcgctggtgctgctgtaatgggggctgaagagtctgaggcaaagcattagaggttgccctgtagatccaaaattaggcaaggaaagctgggatgctggtaaaggtactgtaacctgctggtaaatcactctggtgactgagcacgtgttataaaaatctgtctgatcaggctgttgtacttctccataatatagatttgaggcctgggtaagatttgctctggtctgatataactatggtgtgtgcaatcagctgtgtaatcctctctagttcctgatgcctgtccccacttga

SEQ ID NO: 613730 - DNA, 230 bp, Homo sapiens
gtggctcacaccctgtaatccccagcaaactttaggggaggcagagaaagggcagatcacgaggcccaggagttcgagaccagccctggccaacatggtggaaccccatcctctactaaaaatacaaaaactagcctggccatggttgtggcacacctgtagtcccaggcctacttcagaaggctgaggccaggagaatcacttgaaaccctggaggtgaaggttgcagt

SEQ ID NO: 613731 - DNA, 284 bp, Homo sapiens
ggtcgacgattaattggatgttacgtgaacttcgtgttattaaaaaaatgaagtccatcccagcactttgggaggccgaggcaggtggatcacttgaggtcaggagttcgagaccagcctaaccaagatggagtctcgctctgtctcccaggctggagtgcagtggtgcgatctctgctcactgcaacgtctgcctcccgggtccaagcaattctccggcttcagccccctgagtagctgggattacaggtgtggtcgacgcggccgcgaatttagtagtagta

SEQ ID NO: 613732 - DNA, 1347 bp, Homo sapiens
  misc_feature (505)..(505): n is a, c, g, or t
tatactacacacacttatttacgatatcatacacacaggggagacacacatacgagatacgagacgactcggcggtggacacagcgggacacacgcagacgtgtgtgtgggagacagagacacgtgtggggtggcgttttgagagtactgtgttctcacaacacagcgtggctcacatatacactatataatcacgcgttgtgttcacagcacatactgttgtgagcacgactacggtgtgtgacctgaagagcggtgtggcacgcacacacacttacacgtgcgcgtaatacgagtacacagcacacgcactacgcacgcgtgtaccacagcgagcagcggtgagtagcacgtgagagagagacactaccgagacacgagaggtgtggagagcaccgtagcacatagcgacggcgcccacaacgatgtgtggtttacacgcgagagaagcaacacatacccatcgcgcaccaaacaacgagtggcctccccaccatgtagcganggggcacacacaccacaacgcccgcgggaaaaacacgacgccagggagcgccgccacgggatccaccccctcacaacggggacacgacacgcgcacgccgtgggagcgcacgtgcggcacaccataaacaacgatgagtagtgtataaaaccgcaaccagtgtattaacaccgcccatagtgaagaataccaccagcagagggtagcagcaccaacaaccaccaataccgtcgataccactctcgccgacgatgcccacccgcagacggagacggacgacgcggcagggagaaacgagtctaaacccaccaccaggagagaagaacacaacacaaacagaacaacagcagcaaccacgatcgagcagcccgtaaacccaacacaacagcaatacaacagcaggcgaccaaccacaccgccaccctaacaccaacaccgacacgcgagaaaaccaaaacaaaacataacaacacacaaccagcaaagtggagccaccatctctacgtcggcctcaaccaagaggcagccatagtagacaccaccgcggagtcaacaagaccacccggcgtggcacaacaaatcacaaataacccccactaccaccaaaacaaaagacgaaagtgcacagacaaccacacacagaaggccacagacgccaagaaacacagatggactaccccccacaccccactagacatcacgagcgaagcaaacacacccagacgaggcgccacacggagcggggacacataacccaacaccccacacccccccaccccccaccacacggtacgctccccccggccaaccaaccagccaacggcggccacacccccactccg

SEQ ID NO: 613733 - DNA, 117 bp, Homo sapiens
gttcatgggcaacgcagggctgggctgaattaaaggaatcggtgggctagttaactgcagcaggagcatgtctttaaggcacagatcgctcatgctattgaaacttctaaaactagg

SEQ ID NO: 613734 - DNA, 84 bp, Homo sapiens
acatctgtgtacttctgtgccagcagccagcactcgggggggccagttgagcagttcttcgggccagggacgctcacgcgtcta

SEQ ID NO: 613735 - DNA, 1655 bp, Homo sapiens
  misc_feature (1405)..(1405): n is a, c, g, or t
  misc_feature (1600)..(1600): n is a, c, g, or t
  misc_feature (1603)..(1603): n is a, c, g, or t
ggacttgtatttaaaaaaaaaaaaaaaaaagctgggacttggttggcagctttcataccccaagcagattgactggataaaaccgtgggagataaggataagacaaaatgtggcaacacaatttttaatctcttaaaaatttcctgtgtgtcaccacaagaagggcattcagctgtgcctccatttggcaagcgaaaacggtgggcgctactggggcactgtgtggccagtgttgttccaattgcacaattataatgtgacagagagttatatattttaacaatatattattcgggcgtctttaaacacaatttttaacacaacaacttttgtgcacaatctataaaggctataacatttatacaattttttacacccgcctatatttttctacacaccatttattgtgtatcataacaccaaacacacgcacacatgtgcgccaccgtgtgtctaacaacaccccgggaaacggtggtctacaatataataccgcgttcacaaattaaagggtgtgccaatatatattatcataggcgctcctccggcacacaatacgacagacagggcgcccatttctacacaaccacacgcagacactgtgtcgcgacagatctcccattatttatcaagccgccaaacgtggcgatcttacaacacactcttcaattttcgcgaccctttttggttgtgtcttaccccagcaagaatttctccacaggctcttggggctatgagcacagcagcagtggtataattatcccccacagtcttatatctccatggggtgtggttacatcatccccaagcaatttgtaggggcgctataccaccgtagaggtcgaaaacgggcgttatcacaaaacccccaaactgtcggcgccacctcatctgggggtccacattaatccaatttcactacccaacaaggggcggcgcaacaccactcgacccgcaattataatttatattacaccctattcacacgccccacctaatcgttcacctgattcaacactttcctccgttgtcacacattttataccacgcggcggccaacaccagcgtgtggtctatcaccctcgtaaagcaaactgttgtttgggtggtgccccacccgacaggatcaacaaagcaaccagaaggcctcgaaagaaagaaggctcccaaagtcgggcaaacacatgtggctcgttgacacaaaacatcctcgtcataaaaactcgatgggggccatgtccaccaaactaaaaggccggagccatttctacccacgtgtgcaacagcagctatcttccagaccgacgtgctgctatttcatgccacaccaacacgactttgtggctgtgtgtcgcgagccagccggcaacgactatcacttatcaatacaccgcagcggcgacgnggcgctctcacgacatacacgctactcatcagaaaggcaagacccattctctcgatcacactaagacagggccagcctgtaggaggaacacactctcattcgtctccccaacatgtctccatccgctgttcagggtccggcagacagacttctttgaagacagaccctcctcagctctatcttcgacacgcacgnggncgtgcacactccaccttgactaaacaggaagagcgcacgtgtgtgctggtca

SEQ ID NO: 613736 - DNA, 162 bp, Homo sapiens
aggggggtctttaagggtttttttttggggaaaaggttcccaggggtttaatttttcccccccttgggggggtaaacaagggtttttttccccgggggggcccctttttttcccttaaattgggttttttttcccccccaaaaaatttggggggttgcccca

SEQ ID NO: 613737 - DNA, 287 bp, Homo sapiens
  misc_feature (111)..(111): n is a, c, g, or t
  misc_feature (131)..(131): n is a, c, g, or t
  misc_feature (273)..(273): n is a, c, g, or t
ggcggatctcaaattcctaggctcatgctatcttcctgcctctgcctccctaagtgctggtttataggtgtgagccaccacacctggcctgcaactctatttttaattttnattttaattaattatttttntttgagatggagtcttgctctgtcacccgagatcgtgccactgcacttccagcctgagcgacagagccagactccgtcttcaaaaaagaaagagtttttgctttcaggggatcttcatagggctaatcataattgatagggncataattaggatat

SEQ ID NO: 613738 - DNA, 392 bp, Homo sapiens
  misc_feature (156)..(156): n is a, c, g, or t
  misc_feature (161)..(161): n is a, c, g, or t
  misc_feature (246)..(247): n is a, c, g, or t
gctctctctgtggggctagtcgcgcccacctggactccgttagcctgtcctgctacagatcgagctgctcgcctcacacctgggaagcgagcggtggtaatggtgcgtcgtggctcggtccccgctcgtgccaggacctgaacgcgccttctgatnggganagccgtgggaaggacagttatgaaacgagtcagctggatgaccagagtgctgaaacccacagccacaagcagtccagattatatnngcggaaagccaatgatgagagcaatgagcattccgatgtgattgatagtcaggaactttccaaagtcagccgtgaattccacagccatgaatttcacagccatgaagatatgctggttgtagaccccaccccacagagagagcgt

SEQ ID NO: 613739 - DNA, 172 bp, Homo sapiens
tctctgttgtacggttcccccaatcaaatcctcattttcccatccagcatttttcccatggggttcaagcagcctcatgccacagcaaccagttcaagcacagtcagtggttgctcctcaccccattccagtggcctgagccagtgggcagctgcagcacagtcttccgtgg

SEQ ID NO: 613740 - DNA, 356 bp, Homo sapiens
  misc_feature (121)..(122): n is a, c, g, or t
cagtatttggaggtggggctaatgggaggtatttaggtcataagggtccactctcagaatggatcaatgacaaaataaaaagagctcgacctctcaggctcaaacagtcctcttgcctcannctcctgagtagctgggaccacaggcacacaccacaacacccagctaatattttaaatgttttgtagagacgaggtctcactatgtttcccaggctggtctcgaactcctgagctcaagtaatcttcccgcctcggcctcccaaaggctgggattacaggtgtgagccatcgcacctgtcctgggttttgtttttttttttctagatttttcagtgagagatactttcttccttg

SEQ ID NO: 613741 - DNA, 181 bp, Homo sapiens
actacttacacagggaaaggcatgtgaagacacagcaagaggtctgcaagacaaggagagtagacatactagtaactaaccctgtaagcatattcatctatggacttccagcctccagaactgtgagaaaataaatttctgttcagccacccataagtccatggtactctgtaatgacagg

SEQ ID NO: 613742 - DNA, 974 bp, Homo sapiens
  misc_feature (32)..(32): n is a, c, g, or t
  misc_feature (62)..(62): n is a, c, g, or t
  misc_feature (67)..(67): n is a, c, g, or t
  misc_feature (72)..(72): n is a, c, g, or t
  misc_feature (76)..(76): n is a, c, g, or t
  misc_feature (93)..(93): n is a, c, g, or t
  misc_feature (97)..(97): n is a, c, g, or t
  misc_feature (122)..(122): n is a, c, g, or t
  misc_feature (131)..(131): n is a, c, g, or t
  misc_feature (138)..(138): n is a, c, g, or t
  misc_feature (147)..(147): n is a, c, g, or t
  misc_feature (149)..(150): n is a, c, g, or t
  misc_feature (159)..(159): n is a, c, g, or t
  misc_feature (174)..(174): n is a, c, g, or t
  misc_feature (227)..(227): n is a, c, g, or t
  misc_feature (278)..(278): n is a, c, g, or t
  misc_feature (289)..(289): n is a, c, g, or t
  misc_feature (314)..(314): n is a, c, g, or t
  misc_feature (316)..(316): n is a, c, g, or t
  misc_feature (329)..(329): n is a, c, g, or t
  misc_feature (363)..(363): n is a, c, g, or t
  misc_feature (365)..(365): n is a, c, g, or t
  misc_feature (367)..(367): n is a, c, g, or t
  misc_feature (370)..(370): n is a, c, g, or t
  misc_feature (375)..(375): n is a, c, g, or t
  misc_feature (391)..(391): n is a, c, g, or t
  misc_feature (419)..(419): n is a, c, g, or t
  misc_feature (437)..(437): n is a, c, g, or t
  misc_feature (463)..(463): n is a, c, g, or t
  misc_feature (504)..(504): n is a, c, g, or t
  misc_feature (508)..(508): n is a, c, g, or t
  misc_feature (512)..(512): n is a, c, g, or t
  misc_feature (515)..(515): n is a, c, g, or t
  misc_feature (531)..(531): n is a, c, g, or t
  misc_feature (535)..(535): n is a, c, g, or t
  misc_feature (537)..(537): n is a, c, g, or t
  misc_feature (610)..(610): n is a, c, g, or t
  misc_feature (617)..(617): n is a, c, g, or t
  misc_feature (737)..(737): n is a, c, g, or t
  misc_feature (770)..(770): n is a, c, g, or t
  misc_feature (772)..(772): n is a, c, g, or t
  misc_feature (844)..(844): n is a, c, g, or t
tcccctgacagggcgatacccacaaacactanactacaaactagcatctagacctgtgttgnccaanacacnaagnacatatatggctagtgnaatnaaaaaattggattttaaagtttcantcaatttanacttaanccgaagcantnnaaaatgttnaaatatatatatatnccttgtgggggtttttattagggcagaatggaaaatgggaactagagtgcttncttggttctgataggaaagtgaattatttatatacttacaatacaggatgntgattttcagntatagttcctgaattttatggtaananttttgtagtcatntcaatagctgtctttcccaaaggcactttagtgncngntcntattnccttaatcattgttcncactgtatcatcttgtaatttattcatntcttgtaatctgcccatncccttttaataagtttaggtcagccnctcagaaccatttctttttcatgggatggggtagggggagntaangctngcntgcccacaactgagtnactnanaaaaaaaaaagcaactctggttgagaaatcagatgcatgagattgtatgtctaattctgcaagaccctgaagncatggcncttaaaggatgccatcatgtagtttagaagccactaatttccgaggagtaatctaatgttggttagatctttggattgactgcagcaaagtattggtagagcagtctatctcagtataantctttctaggaaaatttgggaagcgactttaananaaaaacgaggcagatttacttatttgccattttctatgttaacatgcttaattatgttggaaactgaatctntctttccagtaccacttccgctgtcacggtaaagtccgccatcagaagactgaaggagttgaaagaccagtagacgctcctctactctttgagacatcactggcctataataaatgggttaatttatgta

SEQ ID NO: 613743 - DNA, 366 bp, Homo sapiens
  misc_feature (32)..(32): n is a, c, g, or t
  misc_feature (35)..(35): n is a, c, g, or t
acacgcgttgtcggtgtgtctgggctcggacntangtcgcggcgacatggccaaacgtaccaagaaagtcgggatcgtcggtaaatacgggacccgctatggggggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgta

SEQ ID NO: 613744 - DNA, 249 bp, Homo sapiens
tggtaccaatttcacctaaccatgtttaatcatcagtaccctgtaaactgaactgtcctttttttcttttttcaagtcatcagggttcttcgagtaaacgactctggccatgttaagcagcctctgctttatgataatacataaacataatacaaaactaaaacaaaaacaaaaccaccattactatatcctaggctgtcaaacctgatgttttctgttgccaggagaaggttgtttttgctgtgtatg

SEQ ID NO: 613745 - DNA, 814 bp, Homo sapiens
gtggagtgacggtcatgctgcggcgtggacacttggcatgcagggacgtggccatagaattccctcaggaggagtggaaatgtctggaccctgctcacaggactttatgcagggaagctgatggtggagaactacaaggaacctggtctttcctgggaatctgtattcctgacctgtagtgttatctccatgtctgcgagactgaaggagagatccccggatatctgcgagaggtgaagtgtacaaattgagctaaacaatccaggtggctagggagctgcgatcaaaggtgtgagacgcagagtcatcggtctgtacaccacaggcttggacgtgacaatgacccgcgaatctccggattcaattggcaatcgcttcgctgtcctggattcaagcaacttcttctgacattcggactccccaaagtgctagagattacagggctgtgagccgtccgtggcctggcgctcaacttctgtctaacttttatgtggtaagaggacagggtttcaggtctgctgtccaggctaaatggcagctggtgcagttgacggtcgctgcatccttgaacttggaggggcagagagctgctcttcccagactcaggtgaatccaacccgacttcaggactacccaagagtttctgggaattcacaggacatgagttcagtgtacccgggtctgatatttctaataatgcttcacggcacattgagtttctagaaatccactaaaagcggcaacctaatacaatggaaattacccgaattgagatcgtcgcgatacgcaaaataattggactaggagaaagcaa

SEQ ID NO: 613746 - DNA, 613 bp, Homo sapiens
  misc_feature (32)..(32): n is a, c, g, or t
  misc_feature (35)..(35): n is a, c, g, or t
acacgcgttgtcggtgtgtctgggctcggacntangtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagtaacctaagcaagaccctaatggaaccgaaagtgcgacgctgatggaatctaagtgctctagaccaatggaacggcgactggaaataacagtggatagtcacatggctatggatcctaagtcagattgatgccctggaaagatcatcccatggcaagatctcatgttagattacacttcctgttcatcatcctcattgcaagatccaagatcatgcctcattaccttcatgccgtgtaaaacctgccccatgcccccagctcctaggagacagatttgagccaggctcctgtctttctctggcagccgttgcgatgaacttcttctttctactaaaaaaaaaaatataata

SEQ ID NO: 613747 - DNA, 271 bp, Homo sapiens
  misc_feature (32)..(32): n is a, c, g, or t
  misc_feature (35)..(35): n is a, c, g, or t
  misc_feature (239)..(240): n is a, c, g, or t
acacgcgttgtcggtgtgtctgggctcggacntangtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtcttcatgcaggaaccacagtgnnagatccccacagctcgtctctttcatcttgg

SEQ ID NO: 613748 - DNA, 732 bp, Homo sapiens
  misc_feature (449)..(449): n is a, c, g, or t
  misc_feature (464)..(464): n is a, c, g, or t
cagaagatggcagtctgctccataaccagagcaagtgcagtgggaaagctggactctcatacccactcacattcatgccttatataagcctctcctcctggttaaccttaacaggggagtgattcctctgctggttgctggttttccttttctcttaccctattccttctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggctggactgcttccctcactcggactgcttgacagtcttctagcagtgagtaggaggaacagaagctgttcctgatgttacaaatgaacaaggatctcccaggtaacccagctccncacacccaattttgntactaatttctcaaacagaaatttctggttacccttctttcttatcactgagtgaaagggacaggcatgcacattgtgccatacatgccatcagaatagagtgtgggggcaggggcggcaggtcaattctgttattccaagacttttgggagctgaagtaaggggatcatttgtgggtcaggagatcaagactaagcctgtgcaacataattggcctgtctttactttacacgtgggccgggaattcactttaacgggagaccggttg

SEQ ID NO: 613749 - DNA, 142 bp, Homo sapiens
tcccttaaaaattattcattaaaatcaaaaaggcccacaaccttttaaactttcccccccccctaaatttttttaaaagaaaaaccttttttttttattccccccaaacccggccaaaacctttttcaaaactttgaaaaaa

SEQ ID NO: 613750 - DNA, 179 bp, Homo sapiens
gatccaaagaattcgaccaagcagggctctcggcagaacccgcaacgcgaacccccgcccaacgcaaggttgttaacttccccgctaaagccgcaagtgaattaaggaggggttcttcggggtccgcaaccgcactcctaaaaccctaatttctaaaaacctttataaacatcgccaaa

SEQ ID NO: 613751 - DNA, 351 bp, Homo sapiens
  misc_feature (3)..(3): n is a, c, g, or t
  misc_feature (8)..(8): n is a, c, g, or t
aanaccanaagccaatacacctgtggtattaaaattaaaaagaatcccaattatgtttaccctcaaaagaacctgtttttgccttcttgggagcaatattgcccctgtgagactgcatgcctataaggtaaggttgtgcttgttaaagacccaagacatgactgggttccacagtctccaaaggaagagggtgggctagtctgtttttattattattttaaaattgtataattggggtctttcttagagttcagaaaaggtatagcttactcttttttaattgtttatttagttgtaagcttggtgattgttttctgatccacattgtgtgtgttcttcaataaaatcttt

SEQ ID NO: 613752 - DNA, 843 bp, Homo sapiens
aatgtgtaggagccggagcaggagaccaggagacccacggacacgcggagatagcgccataccattcccagcgccacagtcatgcatgacatcctggttaccccgacatcgtccccacccggtgttagcaggcaagcaggatagtcaacaggtatcatgtcatgaccagatacaccaccatcaacaggtactcccatccgtcccggcgaaggcaccgctttcgttcaggtgggtctccagtatctgtcctagggtactgcaagcaagcaagcatgcaagcatgcaggcagtcatgcaatacagtgaacctggcaggcagcaagggcaaacagtccccaccatcgatccccactaggaccaagttgcccttgacaggaggctggcgttcatgagatacaatgggcatgataggaggtcagaacctcatgtgccttcatctggggacaggcacacaggagttggaccaggtgcgcagcctggttacgcacatacaatgggcgccaacatgggcaggggccaccaaacattcccaagcaatgaacgacgctacatgccagctcatcactcgcacttccgggccaaaccgacgactggcacacctcggtccctggcgcgccgctcgactccatcgcaagggccatggaggggaaacctgaccccagagacaatcctgcgagcacacgcgggatacaacgacaagacaggcatgcacaaaagcatagatacacagaggacccactgagaaccgcttccagggaccaccaccaaaggagcccccagaacggacccacggcttagcaacaccactgataaggagagaggcctgcaagaacggcaagccaa

SEQ ID NO: 613753 - DNA, 116 bp, Homo sapiens
  misc_feature (85)..(85): n is a, c, g, or t
ttgtccaacttatacactgtatactgttatctctaaagcacaggtgaataatgttctgcatatttttaaataatcacatgtaccnctgttgaaaatgtaacctcgtgcctgcgact

SEQ ID NO: 613754 - DNA, 165 bp, Homo sapiens
ggcaagtaaagcacactttttttttctcctcaaaatgtttttccctgtgtatcctattatggatactggttttgtcaatcatgatccttaatttcctctccttttttagggatatagcagaaatgctattactgaaatggatttcctttttctgaaatgtaatca

SEQ ID NO: 613755 - DNA, 855 bp, Homo sapiens
gactatctcttttgcctaataaatacagagggctgtgtaaagctcagggcccttgttcactagagacaaggtgtcccctgacccttcttccaaacatattcttttgtctcttgtctttattcctgcattcatccccctttgttcagtccaccagggatcctggcaggctgcaagtggtgcctcgaacagcaacagaatctggtgctttacaagtggcgtccaaacacaggggcttcgaggatgtgaatgaagaatgtctgctagagcagaggaactgaaattgacaaggcgaatggggaccccgggatgagtctgctggcagcggatataaggtcagtgccctaaaaaggtactaggagcagtgctttaaagaagtactgggaatgggaagttttctgaatcagggtaacatggagcagaatttgtctattgaaggaaaacattatgtgcagttgcttaaagtttcgttgaaacaaactggtgctcggggttctcagacattcattaagatgctacaggaggttattacgcataacccatggtttccaccggttataaaattctggatgtggcaagattgggacagagcaggagaacgattacaaacagcgctcatgaacaaaaggtcttaagagtgggatctcttcgggttttcccactgtggagttcaattgggtacgtggtacttctaccatttagcctccttattattcctgtgggacagcaaggctggagtctaaaaatctgaaagatcctgtggtcccacccacaagttcccgctgaacattacaacaacaggcccaggcatggggggctcacgcctggtaatccccagcactttggagaggccaaggg

SEQ ID NO: 613756 - DNA, 243 bp, Homo sapiens
  misc_feature (12)..(13): n is a, c, g, or t
  misc_feature (20)..(20): n is a, c, g, or t
ttgggccgtgannaaaaggnggagaactcttaatttcaccgctcagcttcaatccactgtatgaagacagacaacagtttaataacaactgatcaggaggtgagctggatctatctgcacatgcacctaggccacaggaagactgaaatagaggagatctcgatagagcacgtgagaggactagaaccaaaccataccagtcagcccgcactggtttttcacaggggcagaagatgtagccgc

SEQ ID NO: 613757 - DNA, 504 bp, Homo sapiens
tgggcttccttttggtatagttggaatgtccacagtgaggaggataaaaactaaaaatgaactatctctaaaagacaaaacattttttctttcctagatcagtaaggtaacggtgacaagaatacccagccataaaaagaacaggggggaaagcaaagatctgtgtctcatggctcacctaatagcaccggtaattaatacagaaccaccaggaggatatgtcaggacaacaatgacatggatcatgagggcagcatccagaatggagtgcaggcctctcgggcccacagtctcggtatctgcggtgaagggggtatagataagcggcccatccttcggggtataaaagcggacggacttaagggtagccaagacaacaaccaggcagagagtcacagggccaaggagcatgatcacatgcttggggccatatttcaaggtcagctcctcatcttcttcctcatctggctcaaccaccggcggtgagtaccctggggtcgtcca

SEQ ID NO: 613758 - DNA, 327 bp, Homo sapiens
cagcctttagctcctgtctggattacctcctgggagtgtcatgtgtaaattcatcgtggtcttcacacgagataaagagcaatgggtattaagtctaactgtgggagctgggtgcagtggctcatgcctgtaatccccgcactttgtggaagctgaggcaggaggatcgcttgtaggccaggagttggagatcatgccctgggcaacatgggcgaagcctatcctctggaaaaaaaatacaagaattagctggtcgtgacggtgagtgcctgtactcccagcactttgggagcccaaggcgggcagatcacgacgtcaggagatcga

SEQ ID NO: 613759 - DNA, 194 bp, Homo sapiens
  misc_feature (161)..(161): n is a, c, g, or t
cctgtgggcatcacggtctgaattccgggctcaagccatcgcctgccgcacctcccaaagtgatgggattacaggcctgggccactgtgcctggccccaacatctccacttctgatctcatttttcgtgttttctcaccatactgatatattttacgtttngtcacatttactggtctctcactagacacattc

SEQ ID NO: 613760 - DNA, 677 bp, Homo sapiens
cgtgatctcggctcgctgcgacctccgcctcccgggttcgggcgattctctgcctcagcctcctgagttgctgggattgcaggcgcccgccaccacgcccggctgatttttgtatttttagtacagatggggtttcgccatcttggccaggctggtcttgaactcctgacctcatgacccgcctgtctcggcttcccaaggtgctgggattgtaggtgtgagccaccgcgcctggctgaacatttttacttttttagaaatgttccaagtcagccaggcgcgggggctcgcgcctgtagtcccagcactttgggaggccggggtaggcggatcacttgaggtcaggagttcgagtccagcctggccggcctggcgaagccccgtctctactaataatgcaggggttagccgggcctggtggtgggcgcctgtatttccagctacaggcataaggctgagacaggggaatcgcttgggcccggaatgtggaggttgcagtagccgagattgcgccactgcactccagcctgggtgacggagtgaaactgtctcaaaaaaaaaagaaagacaagaaagaaaaagaaatatcccaggtcaaagctttgatatctaggagtttgaggctttggtggatattttgggatttagataagtgttattaacagcttttaaatata

SEQ ID NO: 613761 - DNA, 892 bp, Homo sapiens
  misc_feature (18)..(18): n is a, c, g, or t
  misc_feature (79)..(79): n is a, c, g, or t
  misc_feature (84)..(84): n is a, c, g, or t
  misc_feature (148)..(148): n is a, c, g, or t
  misc_feature (163)..(164): n is a, c, g, or t
  misc_feature (172)..(172): n is a, c, g, or t
  misc_feature (175)..(175): n is a, c, g, or t
  misc_feature (177)..(177): n is a, c, g, or t
  misc_feature (181)..(182): n is a, c, g, or t
  misc_feature (185)..(186): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (202)..(202): n is a, c, g, or t
  misc_feature (205)..(206): n is a, c, g, or t
  misc_feature (208)..(208): n is a, c, g, or t
  misc_feature (210)..(210): n is a, c, g, or t
  misc_feature (217)..(217): n is a, c, g, or t
  misc_feature (232)..(232): n is a, c, g, or t
  misc_feature (235)..(236): n is a, c, g, or t
  misc_feature (253)..(253): n is a, c, g, or t
  misc_feature (268)..(268): n is a, c, g, or t
  misc_feature (283)..(283): n is a, c, g, or t
  misc_feature (289)..(289): n is a, c, g, or t
  misc_feature (365)..(365): n is a, c, g, or t
  misc_feature (368)..(368): n is a, c, g, or t
  misc_feature (395)..(395): n is a, c, g, or t
  misc_feature (404)..(404): n is a, c, g, or t
  misc_feature (590)..(590): n is a, c, g, or t
  misc_feature (600)..(600): n is a, c, g, or t
  misc_feature (602)..(602): n is a, c, g, or t
ccgcagtgggtgtgtgangggaggacggacagacccagacgccgccggaccaggaggacgctgacgaggcaccatgcgngagancgtgcacatccaggcgggccagtgcggcaaccagatcggcgccaagttttgggaggtcatcagngatgagcatgggatnnaccccacnggnanttannatnnananantnatttncanctnnananaatcaangtttactacaatgangcnnctggtaacaaatatgtncctcgggccatcctngtggatctggagccnggcacnatggattcggttaggtctggctcgggccatcctcgtggatctggagccaggcacgatggattcggttaggtctggnccnttcggccagatcttcagaccagacaanttcgtgttnggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaanatccgggaanantacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaactggcggtg

SEQ ID NO: 613762 - DNA, 103 bp, Homo sapiens
  misc_feature (91)..(91): n is a, c, g, or t
cctcagaggatccctttctctgatcgcttttctctgatcgctctttctcttgatcgcgtatctcttgatcgactcccccccgatacgaggncaaggtgtaccg

SEQ ID NO: 613763 - DNA, 392 bp, Homo sapiens
gagctccccctactggagaagggattcgtgagaagaaatgaagtcagcccgtcagtaaatgaagttgatctgcctgctggctttctgttgactggcccggaggctgtactgcgagaccctgtgagacttccctagtcgtaagagtaggatgtctgtctgaaggtcactccatcaggtggaaggaatgcactggagtacaggatgagaaggagatgctgctcttttagtggccgggatgtggctatagatgtggtgtccgcctaagtgtcagggaccttctggtatattttacgggaaagaggtaagctgtctgtcggggacttggttgaagtgttactacaggagtgaggcgatttgacctgctcaaaggtgatcttgaagatggacagaat

SEQ ID NO: 613764 - DNA, 830 bp, Homo sapiens
  misc_feature (18)..(18): n is a, c, g, or t
  misc_feature (79)..(79): n is a, c, g, or t
  misc_feature (84)..(84): n is a, c, g, or t
  misc_feature (148)..(148): n is a, c, g, or t
  misc_feature (163)..(164): n is a, c, g, or t
  misc_feature (172)..(172): n is a, c, g, or t
  misc_feature (175)..(175): n is a, c, g, or t
  misc_feature (177)..(177): n is a, c, g, or t
  misc_feature (181)..(182): n is a, c, g, or t
  misc_feature (185)..(186): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (202)..(202): n is a, c, g, or t
  misc_feature (205)..(206): n is a, c, g, or t
  misc_feature (208)..(208): n is a, c, g, or t
  misc_feature (210)..(210): n is a, c, g, or t
  misc_feature (217)..(217): n is a, c, g, or t
  misc_feature (232)..(232): n is a, c, g, or t
  misc_feature (235)..(236): n is a, c, g, or t
  misc_feature (253)..(253): n is a, c, g, or t
  misc_feature (268)..(268): n is a, c, g, or t
  misc_feature (283)..(283): n is a, c, g, or t
  misc_feature (289)..(289): n is a, c, g, or t
  misc_feature (303)..(303): n is a, c, g, or t
  misc_feature (306)..(306): n is a, c, g, or t
  misc_feature (333)..(333): n is a, c, g, or t
  misc_feature (342)..(342): n is a, c, g, or t
  misc_feature (528)..(528): n is a, c, g, or t
  misc_feature (538)..(538): n is a, c, g, or t
  misc_feature (540)..(540): n is a, c, g, or t
ccgcagtgggtgtgtgangggaggacggacagacccagacgccgccggaccaggaggacgctgacgaggcaccatgcgngagancgtgcacatccaggcgggccagtgcggcaaccagatcggcgccaagttttgggaggtcatcagngatgagcatgggatnnaccccacnggnanttannatnnananantnatttncanctnnananaatcaangtttactacaatgangcnnctggtaacaaatatgtncctcgggccatcctngtggatctggagccnggcacnatggaaggtctggnccnttcggccagatcttcagaccagacaanttcgtgttnggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaanatccgggaanantacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaactggcggtg

SEQ ID NO: 613765 - DNA, 1014 bp, Homo sapiens
  misc_feature (516)..(516): n is a, c, g, or t
acttaaacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtacccatattttattactgtttattacttccatgaattttaaaatctgagggaaatgttttgtaaacatcnattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaaaaaaaa

SEQ ID NO: 613766 - DNA, 430 bp, Homo sapiens
  misc_feature (14)..(14): n is a, c, g, or t
cacccccaatgctnattgtaaattagttgttttttattttccccggccaaaaaataggggccaacccctcttttgtgtgggacgaggaaaacaagcccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaaaaaaaa

SEQ ID NO: 613767 - DNA, 115 bp, Homo sapiens
gtgtgctgagaccagtcttaccgtggcgggaactgagcgctccagtcttcactagggaattgctgaataggcacagagggcaccatgtacacctttcagaccagtctgcaacctc

SEQ ID NO: 613768 - DNA, 126 bp, Homo sapiens
cccctgtacaggctgatgcagcgcctcaacagcaggacatgtaggcaacacgagcaggcacagcgcggctaccactgtccacacgcttacacaagccaggcccgcagtggccttcggagagctagc

SEQ ID NO: 613769 - DNA, 230 bp, Homo sapiens
ctcatagtctcagctacacttttctcaagtccttctcttgccctccatggtccagttccagcaatcgcactgctcacttcatacagggagtccagtaacggctttgttgttcttagcttccttttacacgttcctttggtctcattagtgcttgacttgcttcttctcctttcagaacctgagtaacatataaaagaaaaaccacctccacttagaacagccagagatac

SEQ ID NO: 613770 - DNA, 397 bp, Homo sapiens
gaatctggggtagactcagtaacgggtcaactgtcgtacttcaacattgaattatcgacgtggtctagatgccatcaccttgcactgtatcgctggtctgtacaagacatcactacatgatcattcctgactgttgcttctccattactcaatcagtggattcataaagttagaaggaagccagctctacaccagcagttcacccttctggagtgtccattaacttacaatcactggccgtcgtataacactgagggtacagaatcggccacgtacttcaatcacaggcttccggacagcctgcttttctgtttcttccaataagagatacttatcattgacatcttggagagcactgtccaactgaggctggatatcacctctcccagcacaagaa

SEQ ID NO: 613771 - DNA, 121 bp, Homo sapiens
gcagtgtacttcaagactgaataaacataatgaaaatatatactaggagatacaacctacaaatgtgaatgaaatagtcttcaaacctgactatacataagattattcattgggtacctga

SEQ ID NO: 613772 - DNA, 178 bp, Homo sapiens
tcagccggaccgccaagcactcttttcttcatgtatttaggcatctagttgatcccatatctattgtgaacagtgctgcagtaaacatgggtgtgtaatgtttcttcaatactgacttcctttccttttgataaatacccagtaaggagacagctggctcatacagtagttctatttg

SEQ ID NO: 613773 - DNA, 694 bp, Homo sapiens
  misc_feature (56)..(56): n is a, c, g, or t
  misc_feature (63)..(63): n is a, c, g, or t
  misc_feature (75)..(75): n is a, c, g, or t
  misc_feature (87)..(87): n is a, c, g, or t
  misc_feature (104)..(105): n is a, c, g, or t
  misc_feature (108)..(108): n is a, c, g, or t
  misc_feature (114)..(115): n is a, c, g, or t
  misc_feature (117)..(121): n is a, c, g, or t
  misc_feature (123)..(123): n is a, c, g, or t
  misc_feature (139)..(139): n is a, c, g, or t
  misc_feature (182)..(182): n is a, c, g, or t
  misc_feature (564)..(564): n is a, c, g, or t
  misc_feature (639)..(639): n is a, c, g, or t
  misc_feature (666)..(666): n is a, c, g, or t
caaactacaaccacataaaacacaaaaaaaacacaaaaataaaaaacaatgaaatnatatagnaattatatattntaatttcatccncccaaccaccactcctnntanctcctnncnnnnnanttatttttatcatttnctcatttttttttccagatataacttatgaattcacaattatntacttaccatttttctcctttttatatacaaatggcagttactgttctcaaccttatttttcctacctaataacataaactgaaggttatcccacatcactacataaatggtttccaagtcctccttatttattcattgttgtttacccaggagtaggctgtatgaatataccacaatttagggaaccagaaccctgaaatggtgtcatttaaacagcttccaatcttttgttttcacaaacgctgcattaatgaatacttctgtatgttcatcattttgtacatgttttagtatgtacattcctagaagtggaattgctggcccaaaaaccaaatgcatttgtggttttgattacttttgaataattcctctttgaatganaagagtttttcctggacttgctatttgctggaggttcatgtgggaaaagaaaccagggccacattctaagcagancagttttttttttttttgacaactganaattttttccccccacagctgttcgttc

SEQ ID NO: 613774 - DNA, 788 bp, Homo sapiens
  misc_feature (572)..(572): n is a, c, g, or t
  misc_feature (684)..(684): n is a, c, g, or t
cctctaaccatggtcatgtcgtggggcaaggaacctgagctgacttgcactaccaacctgatgagctgtattacacgaattaattgaccaaccctggctaatggaaatacagctgatgcggtgcctacccctactccaccatcaaagagtggctttttactggattcagatgattttataggacagagggcctttgctatctagcctttcgtatagtagcatacgcactatgactaatggccatggatacaagctatccctggcagaaagtgacagtgaaatcctgtgagatacaactaccattgatccacagggatgaagaagatggacagccttatcaagctgtagactacaacaaagacggagtgcatgatagctactccttattacaccagatgctctgaaaggatggcttgctcaatcatgaagacggctaaaaagctggtactgcggtgatgctcgactaagagcatgatcagcctagtggcacctgtggggtcaaggatccgttcagctcggattggcttccgctttacatctccacccttaggagctcaacttggctaaccagncgacacttccactaaacctgtgatggacagagacagcactgggacttacagaggtcttattctacgagagcacatttacctttacaggctgaattaactaatataattcagncaatcctttgcaacgtctgaattggtcaaatgttcttaaacaaggggggcaggaatatccccggtccgagaggcattttgttaagagagctaccatgtgtggga

SEQ ID NO: 613775 - DNA, 300 bp, Homo sapiens
  misc_feature (22)..(22): n is a, c, g, or t
  misc_feature (125)..(125): n is a, c, g, or t
  misc_feature (152)..(152): n is a, c, g, or t
  misc_feature (157)..(157): n is a, c, g, or t
  misc_feature (174)..(174): n is a, c, g, or t
  misc_feature (224)..(224): n is a, c, g, or t
  misc_feature (236)..(236): n is a, c, g, or t
  misc_feature (265)..(265): n is a, c, g, or t
  misc_feature (294)..(294): n is a, c, g, or t
gcctacttggcaggttgaggtnggaggattgcttgagcctgaaaggtggaggttgcagtgagatgaggtcatgctactgcactacagcctgagaggcagagtgagaccctgtttcaaaaaaaaanaaaatcaactactcaactggctgcagnatagntgttacatcagcaggcntgaaaacaacattaaggttgggcacaggggctcatgtctgtaatcccagnactttgggaggnaaaggtaggaggattgcttgagcctaggnattccaggccggcctgagcaacacagtgnccccat

SEQ ID NO: 613776 - DNA, 383 bp, Homo sapiens
  misc_feature (27)..(27): n is a, c, g, or t
  misc_feature (158)..(158): n is a, c, g, or t
  misc_feature (295)..(295): n is a, c, g, or t
  misc_feature (307)..(307): n is a, c, g, or t
  misc_feature (373)..(373): n is a, c, g, or t
gaaatatgaaaagacaaaaagcatgtncttgaggaggagtttggtgtggctaattttcagaacttgctgatgatccaaggacagaggaaaatctaggagggaagcatctgagaatccacgatgctgacttttaggctggttagggtatatgttttgtntggtacctacttctgcagatgctctctcttggaaatgttaatgccttgcaggtatttcattccagagaatgaaagtgatatgtgttaggttgaagcctataaatgaggcagggcacagtgtttcacgttggtaattnccagcggctttngggaggccgaggccggcggatcacggaggtcgggagtttcaagaccagccttggccaacatggtgnaaccccgtct

SEQ ID NO: 613777 - DNA, 872 bp, Homo sapiens
cacttaggctaggtactgaggccctgggtgttacatctggcactgaggcgctgtctgccccgtgatgcacagatgcctcgcctttgcctgatcctgccgccctgtccacaccctgccgccagctcaccatggatgatgatatctgccgcgctcgtctgtcgacaacgtgctccgtgcatgtgcaatgtgcctgtgtcttctgctgtgggctgactgatgcccccctgtgtgcctgtcttcccctccatctgtgtgtgtgctgccccatgtgcaacctatgtggctgtgattggttgtgtgcattgtgtgtcatgaatgtgattccttagttgttgtgtgctgactgatgtgcccatgatgcaaatgatgatgtgcagtcctccaccctttgaatgtaccccccattctgatgcactgtgcatctgtcaccagagcttgtggactgacattgtgatgacaaatcttgtgcaccagcacctatactacagatgatgcattgctgtgttgtgctccctgatgtgagcacccctgtgcttgcttgacctgatgtgcccccccgtgaaccccactgtgccaaaccactgcggaaggagagacttgagcgccaggagtacagtagtctttggacgagctctttacagacacccccaggtccactagtaactgtatgcttactccccacggtgcctgtgcttactccctcttggtgcctgccctccttgtgcccgtgtaacccactatgtgccattcggtgcattgtgccctccccgggtagaaccgtggggttcacccccacacatgttgcccccgtcttaccgactcgggtgttatgcccctccccccaatgccatcctgcgtctggaccccttgga

SEQ ID NO: 613778 - DNA, 186 bp, Homo sapiens
cgagcacgccatcgctatatagcctcaatgctgagaaattactcctgggcccagaaggtgtcacataggtggcttgggttacttggtgctcaggcaacaacttggcacagggcccaggttgatgaacaacaacaatttctttaaatatgtgtggactcaagatggaggcctctgggcagagggaac

SEQ ID NO: 613779 - DNA, 546 bp, Homo sapiens
gcagaggaactaaaacactcccttctcattaggacctggctgtggataaaaatttctccccaggtccatcccatctaatgcagtgacaatgacctgtaatgctatcctgacaccaactggtaacatactgcagaataattcccgggctaaccaccccagagtcagcacagaccacacaagttccagggcatagtcctcaaaaagatgcccttacttcatacgccaactgcttttttgggggaccccaggccactcataacttttggaccaaataggaacaaatacagggggtaccatcatccctacaggttggataattcactagaatgactcacagaaatcacagggagcacagaaccttgccatttacaggtttatttattaaaggacacagatcaggaaccagccaaattgaaaaagacacagggggcaaagatctgagtggggtttggaacgcaagggcttcagggcccctgtctttgggggaaactgggaacatcacaccttctggtccggggggagtggttaacccaaccaggaaagctc

SEQ ID NO: 613780 - DNA, 492 bp, Homo sapiens
  misc_feature (307)..(307): n is a, c, g, or t
tacgcgatctagaggaccccggcccatgcacagttcaaatgacagcacagatatctgctctgcagtagttcaaatgaagtctcaggagtttagaaactgtctgaggtgcttggacttctaatttaatacttttagggtattttggttttcgtgttggtgttgactctctgtgtattcattcgttgaaatagttcgtatggtcatggttatgagagaataaaattcaacttagtgtacaacaaaatatggattccaggaagcttagagggtggctaccagtgagacaatgagcagtatccccccaggntgggcagcatgtcgcacatctaaaatttgtggggttacttagttaatttaagacggattctcgctgtgtcgcccaggctggagtgcagtggcgtgatctcggttcacgtgcaagctctgcctcccggggtcatgccattctcctgcctcaggctcccgagtagctgggactataggggaacacca

SEQ ID NO: 613781 - DNA, 295 bp, Homo sapiens
aggcaaagcaagcaaatccctggatgatgaagtgaatgctttcaagcaaatgaaagacggcggtgagctgctccagtcccagggatcccaggctggaggctcacagagtctgaagagcgacaccgagaagaaaacttaactctgctgtttgctgcatgctgaatgagagccagggtcctgtttgggcttcctgtagacagccttttcctgcgcaacagagctgggactccctttctctaatttcccccttaacatgcctagggaagcatacaatccaacccgcgcccatcaattt

SEQ ID NO: 613782 - DNA, 551 bp, Homo sapiens
  misc_feature (105)..(105): n is a, c, g, or t
ttgtcacttgcttttgaaatgtgcatttgtacttaggcagttaacagttagccacaactcctcatctattcttcctagtagcgcaggggtggggcagacttttcntacaaagagccagctagtacacactggaggccctgtggtctctgtagcagctctcgcctttgtagtgcaaaagcagccaaaacaatatgccagccaatggcatggccagccaaccagtgtggctatgttccaataaaactaggaggctagctggatttgacccactggctgtcgttggctgactcctgtgttagaccctccatggtcttatatgcgttatgtgcagttattctcccatctctctcaaaagggaaacgtcagtgacctgaacattgtgctcagagtaccagagttcttgcttaagttgcaggtaactgactaggctgtatgaaccacatagtgggtagactaggtaagaataatgtggcaataaattagtatgacatgtttaatagtaattatgtctatatggcattttggaataaatggcaaattgtttacaagtt

SEQ ID NO: 613783 - DNA, 901 bp, Homo sapiens
gccgcccttttggatgtttttttttttccccatctgcatcacattaatttttaaagggaagggattttcgaaaaaaaacaccgtggccagaattatggaataaaaactaaatacaaatgtaggtctattctgtattggtttaaatacccacaaaaacctattacagaaaatgcccgtgttacaaaacacaacaaaggttcaaccatcgagaatgtccccatcagccagggctgaaaattccagtctcgggtatacgggaattaaggcatgcagtcctggtctggggatggatcacggggtgtgtggcacagccagtgctttcacccaaatttgaccagaaaattggccactgggccaggtaaaccctacatgacgtgttgggttcatgtgtcacataactaccgaagttcctcccacacgatgcaatgccgggtgggatcgtacttctggtaaaatcccttcgtcgatatagagccgaaatgtccttctctatgtggtatcctcatccagcgcatgagaaggcactccaccaagtcctgtggcatcatcttcagacatgtccgcattttggaccacggcttcggtcgcacatggtcccgtgcaaaggggctgccgcttgcacggcccccgggggcggggtcaacacacgccaggccggtaaaaaaccgaggaaacgaaaactagttctaaaacgggagcggcgcccagcaaatactcccgcgcaagcacaccactgcgtgccggtgaaaaaagaaacctaagcagataactcatagaaacacggcatgcgcgacaaataccaaaatcgcccgagcgcgccacagcccaggcgacaccaccaccaggaccggtacagcgcaagccacacaaacaacggaaacacacagggtcgctgtcgctc

SEQ ID NO: 613784 - DNA, 1022 bp, Homo sapiens
gtgatggcggtgatgtctcacagaaagttctccgactcccacagatgggtccctcggcttcctgcctcgcgaagcgcaggagcaggcatcgtgggacggtgagggagcttccctttaggatgatcccatcgcacatgctcggtccagctcacatgcttcctgggataccaaggctggcatgactcacatcgtgcgggaattcgacaggccgggatccaatggtgaacaatgaaggagtgtgcgttgagagtgctgtgaccattgtggagcatcatcacccatgggtggttgtgggcattgtgggctacgtggaagatgcctcgtacgactccggaggcttctgtgactgctctttggtgcacgcgcatcagtgatgaatgctatgagtgcgtgtgctttaataattggggtcaatctcagaccgaaggtctattaccagagttactgggataacatcgcgctcggatgatagatcggttgccgccatcgaggtgaatagaggacttcggtgacagtgttgataaagtgaggtgccaaagtctagtcctggttgtgattggccgggcaaccagatgctgcactgctttcctctgcgccagaaagaaaggccctagctgatcgggagatccagagtgaaggggagggactgggggcggagaagctggaccttgggccccgtcagacgcttgatcagcgaggtatcctgtggaagcaccgagtccgggcagcgatgaagatgatctgaggttattgggggtgagcatggcaaagttacaaaggtgtgaccaggtgttgggcaacaaggaagtgcgggcagaaccacgaaggctgcgctaggtgctgcatggggcatggatctgtgggtgtacgcttgggagggctagaggagggatacacacggttggagaacaaaggttaaatgaggggaatttagagggagcgtgaaatggccaggtgtacattataagagaagtggggtgcttgcacggacggctgagttggagaaggccaaatataaaagg

SEQ ID NO: 613785 - DNA, 371 bp, Homo sapiens
  misc_feature (362)..(362): n is a, c, g, or t
caaaacaactttagtcttcctttcaaacatatatatatttagacttccttattttatatatataggtgtccctcggtatcagtgggagattggttccaagacctcccacagacagaaaaatttgcagatgctcaagtcccttatataaaatggtggagtatttgcatataaggtatacacatcctccagttacctaaaatcagctctagattacttataatacttaatacaatgtaaatagctgttatattgtattgttcagagaataatgacagggaaaagtctttttttataaagacttataagacttaaaagccagccacgtgcgatggtggctcatgcctgtaatcccagcacttggngccgctcgg

SEQ ID NO: 613786 - DNA, 136 bp, Homo sapiens
ttctccccacgggcagtgactcataatcttccccatgcttttccatcttgacaggtggctgtaaagaaattctcttggccagaagggtggctcacgcctgtaagcccaacactttcacaggccaaatcgggaggac

SEQ ID NO: 613787 - DNA, 128 bp, Homo sapiens
gcaagcaacaaacactaagtgtgtctgttctgggccctgctcaccaacactgccagtgtcagcagtggcatgttccctggtcttgcagcagcttgcagtgtgcatcctctcagcagtctgcacctcga

SEQ ID NO: 613788 - DNA, 492 bp, Homo sapiens
tctgagttaagatgagtgggaaaccatctcaataaacacattttggataaaaaaaaaaaaaaaaaaaaaaaaaaaaaaaaaaaaaaaaaaaaaaaaaaaaaaaaaaaaaggggggaaaaaaaaaaataatatcttaaaaaagggaaaaaaaatataaaaaaaaaggggggttttttttaattgggtctggggggtttttttatagatccgaagggtaattgtgtgtacgtgatgggtgtaaaacacacattgttatgatgagggtgaaaacaatctgtgcacagggggggacactgttggatgaagaagaacaccatatttgctggtgggggaaagagacacattcagtggggggacaattttccacgaaggaggacttctatatgcctgtgggggggaaatttataaggttcgaagctaattactaaggggtgttaaacagacgggataaagtagttattggcgtagagaaacgttgttgtgttgtgatac

SEQ ID NO: 613789 - DNA, 357 bp, Homo sapiens
tggatgaaaaaggacaccctgtgaaaaggtcctagctggagtcagacccctctgtgacctatctcctcaggcctctagaggacatatggccaggcccgggcacacaccagcccaccctgagagacccctttgggaccaaccacctgtgagtcctgcgatgcgtttaagcaccctgtgcccctaccctatctgtatttcctgatggcgtagtttgagcctctgtggatgagatgacagcttgctatcacccgtgaatcaaggaagctgtcacgtcagtctcacttctgtggtttgcacaaacctgtttttagacttccaaagccagattaagatttttatctttgaggcccaactaat

SEQ ID NO: 613790 - DNA, 242 bp, Homo sapiens
atataagagacaaagatgatagaacatgaatatagaagcattagacagaatgaaaagagattcgagaattacagtataggtcctcaccccgtacgtgatcaagctcgccatcaacataggggcggtcgatcggccgaacgggagcaaagtgcataacaaagtcatgccaaggctcggaggattggccattatttatcggtgtcgccgtcggctatttagtcggcgggggccgagcagagttt

SEQ ID NO: 613791 - DNA, 285 bp, Homo sapiens
agtgatattttaaaagccagtagttggaccaaaaagtggtggcgcatgccttgtaatccccacacttttggaggctaaggcaggagggtcacttgaagccaggagtttgagaccaaacttgggcaacatagcaagacccccattctacaaaaagtaaaaaataaaaattagctgggcatgttgacatgtgcctgtagtcctagctactcaggaggctgaggtagaaggattgcttgagcctaggagtttgaggctgcagtgatcaccactgcactacagcctggg

SEQ ID NO: 613792 - DNA, 252 bp, Homo sapiens
tttttttcagcagccctttggaagtggattctccccaggccccctttgcaggggggccacatcacctgttttgaatttttaaaagcacccctgctttcagaactccttatttatttgacttgtttgcatccctgaactaaaatgtaagctccatgagggcaaggccttcctttgttttgtttccctgctgtatccccagggcctggaatagtgcttggtgtgtagcaggccctcaataaactgtggaaagga

SEQ ID NO: 613793 - DNA, 119 bp, Homo sapiens
agtcccttctaccgattaacaactccctgcaacccgggaatcagagtatttcagctcaacctcgatagcgtcactcgctaccgcatcccgttgttacatattgttctccgaataagtcc

SEQ ID NO: 613794 - DNA, 774 bp, Homo sapiens
  misc_feature (399)..(399): n is a, c, g, or t
  misc_feature (403)..(403): n is a, c, g, or t
agacaggtgttaatgtgcctagaaatttgaaactaatttgaggaaaccggtgtattaccgtgtgtgtactcagggaagagacagcgtcactgtcgccaaaaagaacgggataaaaaaggggggacatagcaaaaccagaggtccgagcttattagaccaacagggatacaagggaaagttgcgggcggggaagaaagtggaaaaggcgggaaaaacattgtcattattttcgtacgggtttaaaaaggaccgttatatccaatgcacggttgtggttagagcaccattaaggagatggatgaaatacgtcagaatgttatattgcagcccatcggctaaatccacggggggataaccggtaatttttgggccaaaaggggccaggcttgtaagatgtcnaaanaaagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagaggtctgcagcaaaagtctttaatatttttaatgaatatatacattattatattaagataattgctgaatattggatcgatcttatttaataaagatctagacata

SEQ ID NO: 613795 - DNA, 806 bp, Homo sapiens
cggtatctcaaggataatgaaccgatagtaaccgtgaattactagaaaattcatcaacatagatagtgaacggcgccgggggaaaaattggacatgaacgtcaaacgtagtaaggaagtctataggatggaacggagaacaaaatacaatatagatgtaagactcactgatgtagttataaagcacaaaaacagcgctaataaaagacaaaagagtagaagaaacgatagagaaccgaatgtcatatattatcgtgaaagtaaaaaaagttagatgaaataacttcatgaaaaagggtatggtgataataaattgatgcggagaaaatataggccctcaacagaattacagcgctgacgagagggagtatacaagcagggggaaaaacagtaaatttttgtgccaaaaaggaagtaacatgttaactgtcaagagaaagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagaggtctgcagcaaaagtctttaatatttttaatgaatatatacattattatattaagataattgctgaatattggatcgatcttatttaataaagatctagacata

SEQ ID NO: 613796 - DNA, 836 bp, Homo sapiens
  misc_feature (558)..(558): n is a, c, g, or t
  misc_feature (563)..(563): n is a, c, g, or t
  misc_feature (566)..(566): n is a, c, g, or t
  misc_feature (570)..(570): n is a, c, g, or t
cgatataaatcccaaataatatcttaggataatgtgagatatggcatgagtaaccgaaaacagccatatagtgcttaaatagatatataaaagctatacacgcaaaaatagtaatatacaaggaaaaaatgaaggaaaaataaataaaatatctaaaacatataaacatacaatataactagataaacatcaccaaatatgagaagtaaagaaaaatattcacattgcacaataaaagaaagggtgagtagggagacaacattgcaaaaaaaacaaagtattacgatatataatctacaatacgcaaataataaatagattataaaataggggcggacaaataaaggtaaatacagacctgaagaacagtagaggaaggagatttgtagaaggtctcaggaacaggaagactataccgtactcagcgggtcttagattgtataaactttaacgaacggacttgaactacctagaaatgttccttgaaaagccctttttaaaatatcgaaggtggtaaatccagtaaatattttggcaataaaggtcaaagcctgtaanctgtncanaganagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagg

SEQ ID NO: 613797 - DNA, 107 bp, Homo sapiens
cacagcatggccttacaaccagttcatcaagagctggacagcttcagcgggaagccacgggctcggggccacccgctggcacggcgctgcccatcgagggcgttatc

SEQ ID NO: 613798 - DNA, 96 bp, Homo sapiens
gccagcaccaaccagacatctatgtacctctgtgccagcagtttgactagcgcggccggggagctgttttttggagaaggctctaggctgaccgta

SEQ ID NO: 613799 - DNA, 1745 bp, Homo sapiens
acaccgtggtgtagagtggctgtgtcgcggacggtgcagtgcgctgtgcagaatgttgtgctaccagggctatttagccatagttggcaagcgagcaaagtttccaccatctgtcgtgtgtacgagctcatgaaatgtgtttgtgaatgacgcgagagacattttcggctcaccgagcgttatagtgtgatctggctgtgagccaccccattgcctggatgtgtgtgcccattgtcaaggcaaccttgtcttgaccatgccatgaacgtgcacttgaacgtgatgaatgtgatgacatgtgccatccttggaatgacaagccctcatccacttggaatgagaaacgtcagatgtatgtactctgcaatataaggttatcagatgtgcacgatgcttttggcattgcagcattgtagacatgtggtgactctgaaaacggtatgttggcaatgcaggggtattggtaggcgcctgtgttggccaattcgtatacttttcgatacagtcgttatacaccgtgactgactcttgttttcatcgaataggttgaagccgaaggagactgcaagcagtaattgattggtaaccgaggggagccacacattcacccagtgacacgaatgcacatctatggagcaaacaccggaacgttggagctgagttgggcaacaaaaacgacacacggaaccccaacacacgacgccgaatcggcgattggggacacaaaattgacaacgtgtgttggcaaaaccgcccgcaaattccccaataggggacacttctcatgcaccatatacacaaacagaggctgtgggggtgacgatttaaagtagcagagacagcatcggaaaagctggactgatcttggggacacgaaagacagattggacggaaatgaattggcatatgggagcacgcttaggcgatgccgcatatggaaataccgcgttggcggtggcaccattgttggcagtcatgttgagtatcaatcctgtgacccaattggcaagagcattcaactcagattgggcagtttaattgtttaagcgttgtgtgagaagacgagacttaggtatataattggcacacaacacacaggaatggatacaccaaccattggactacagtcaagagatggacgcccagagtaaacacccttggaaacaagagagaaacaacgacacaacgagacagccaaaccacacaagcaacagacagcacacaaactcagcaccacgaaccacctacaaagaacaaaagccggaggcagacggacacgaacatcacgtaagcagaaacataccaagacagtgggcaggcccaacaaacgaatcaaaatagcaagcgacgcacgacacatcgagctgtgcaagaagagcggcgggacaccccacgcagcgcttgacccaccatcacacagcgacgaaccagcccccacacaacccaccaagcgcacgagcccgcgaacacgccaccgccagcagcacacacccacgccgcacgcacaccaccactgacgcgcgccggctccgaccgcaggccaccacaccaaacagaaaaacacgcccaggcggacaccacaccactgcccccgtccacccaccccccgcgaccgcaccgcccccgcagccgatcaacaccaccacacacgacaccccacacacaccagcccgccaccaagacgcaacaccgcatacacaccaccacaacacacatccacactcacgacagccacccacgccaca

SEQ ID NO: 613800 - DNA, 329 bp, Homo sapiens
attttttttggcagccttatccaagtctggtacaacatagcaaagagaacaggctatgaaataagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagg

SEQ ID NO: 613801 - DNA, 235 bp, Homo sapiens
  misc_feature (101)..(101): n is a, c, g, or t
cggcgatctctctctattatctcaaaccagtctgtagcatatgttctggatgctctgagagatacttgccttctctgcttttctcatgtctttctgatatnactgtgatcactttctgtatgctctcaccagatcacatttctgtgatgccacacaatttatcccaactcctgatacacaagcactcctcttacagcagacattctggaagaagtggttttcacagtcatatcag

SEQ ID NO: 613802 - DNA, 793 bp, Homo sapiens
  misc_feature (747)..(747): n is a, c, g, or t
  misc_feature (756)..(756): n is a, c, g, or t
ctccgagactaagcaaccccctcagaaatttaaatggctctttccacgacgagcaaaacttaagtgtcttcatgaaactgagtaaaaactggaactaacacctgtctcccacgatcccagtttctgatagagaccggcatccgcaaaacattctccagccgcccaacattccaaacagcccgtccaacactcgcgcacgttcaccaccggttctcccaagcccgccatcccaccgccacggccgactcaaggctgcttatccccccacccccaggcatctaaaagttccacctcaaccccattgggcgaaccctcgcaggcaactccagtattcttctgccaacaaaggcccgagcctgtcaccttccacccctcagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagaggtctgcagcaaaagtctttaatatttttaatgaatatatacattattatattaagataattgctgaatattggatcgatcttatttaataaagatctagacatacgngcaggtgancccaccatgatcataatactggtagaagtagagaaaa

SEQ ID NO: 613803 - DNA, 2013 bp, Homo sapiens
  misc_feature (1)..(1): n is a, c, g, or t
  misc_feature (1962)..(1962): n is a, c, g, or t
nagggatggaattgctccgctctccctttgctcaaaggaccaaaaaggcatcgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataaaagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccntaattctgacggatatgaacatcaggatcctgcattttttgggcagaattc

SEQ ID NO: 613804 - DNA, 790 bp, Homo sapiens
gatagggaataggaccaataatttaaaggactctaatcggggatgtttttatatggcgtggtaacgaacaatatggcttgtccaggttgttttgatttgccaatcggaatatttccctttcagaggggaaatttggataattacacagaattccatattatgcaaattgttctccccttaccaatatgtttttcatgactcacagggtcgcatccttttttaaggtataaaaacaaagttgtgaatccggaagaaaggtacatgttgttaccttatgaatacacaccaagccctttggtaaatagagtttggatttcttcagggcgagtcaataggattctacactgtcaattttaaaagtatgattggatcttttccttttgatgaatagggcttgaaattgtgggtctttttaaatgcaaaatttattttaaaattttcattttataagaattcatgtattctttcaaaaagtacttattacttgataattctgagaaaattaatttaatgtcatgttttattttattgagttttttcctcccccagaaattagtgattctacttcaactccagctactactcgtgtgactacaaatccttctgattcaggaaaatgtccaaatgtgttaaatgatcctgtcaatgtgagaataaactgcattccagaacaattcccaacagaggtctgcagcaaaagtctttaatatttttaatgaatatatacattattatattaagataattgctgaatattggatcgatcttatttaataaagatctagacata

SEQ ID NO: 613805 - DNA, 322 bp, Homo sapiens
atctagaggatcccgtaagcgtcagggtcagggccgatcaggctctggggagtgaggtattggaatctgaggctcagggtcagggcccgcgtcaggctctaggagtgaagctattggaattgaggtcagtgtggagtgcaggctcaggaataggtattagaatccaggtatgaagttcaggtttggggaattagagccgtgagtatttggggaagagcacggagcgctgctagcacggggcttgggtgttggaacactgggcctcctgcctggggtctgagatgacagagtagggggttaaaaattttgtggggcccccccc

SEQ ID NO: 613806 - DNA, 313 bp, Homo sapiens
acccgcggcgtgttcatgcagaaagttagaggggtttaaaagctaaatccaagtcctggtgacagagtgagaaccgatgcaccttgtggaagccagacagcagagtgagccttcagtcagtcctgtctgcagctgctttttataaacttggcataaatatgtgcttgggaacaccaggacagtgtgtcttggatatacctctaccattagaaaacacacacatacatcacacataacacacatgcacataacacacatacatacatcacacacatacacgcacacatagcacacacaaacacaacacacacag

SEQ ID NO: 613807 - DNA, 826 bp, Homo sapiens
gggagggtgtcctaacgaataaaaggaaatgaatcccacacccggcagggttgtcccacaacagcaaaccactcggctatgtttgtccattatagatgtatatacagcaacgcgaaaggcatacataacatctcaaacttcacattgttgtaaaagccacaagaactataaggtaaaaaagcagtgcataatatggcaaatgaattgggaagagaggacggcgtaaaacacaattgagaaattttatttggagaattattggaaaggaagcgtaatatatagcaaaaatggtgcaggcataagtaacaaataaagccgtatctgcagaggcggccacgaagttgctttccgatgccattagagatattccaccggtggcaatgtacagtaaattttttgacacaatagggtccgaatcaagttaggtgtccagaaaaaagggatccagatggcaagaaagaaatttagtggattggaaatctctctgattttcctttttgtcatagttactataatagctattggccttaattgttgatttaacacataaaacaccgcgggtaaatgttttttcttcccccggggaaattagtgattctacttcaactccagctactactcgtgtgactacaaatccttctgattcaggaaaatgtccaaatgtgttaaatgatcctgtcaatgtgagaataaactgcattccagaacaattcccaacagaggtctgcagcaaaagtctttaatatttttaatgaatatatacattattatattaagataattgctgaatattggatcgatcttatttaataaagatctagacata

SEQ ID NO: 613808 - DNA, 801 bp, Homo sapiens
ccggacatattctacggtataacggttaacacataatcatgggattatgggggaaaatgcataggtaattgtcgtatatgctgagagtagtaaagtacatatttgtgaatataatttatgtgaaaaaattaggaagacagaatagtaacttttaagcgttaacgatgataataaggatatagaggagctataataaggacttgaacaaaaggaaatataaccgctacaaaatgtggggaaagtgttattttatgtcattatacaggcaataaaacctcctagtacgggaatgttaaagggagaatgactcgaaatgcggaaaaccccacataagttctttctcaaacctataagaaaaaaaacaagttggaatatccagtgactatatgggcccagagaagccccaacctttcaaattgtccagatatagggattcaaaagggcaggaaagtaatgttggggagcggaaaaactccataaatttcctttttgtcatagtcacaagaaaagcaatatccttcattgttgtttaaaaaagataaacacacctgcggttgatgaaattagtgattctacttcaactccagctactactcgtgtgactacaaatccttctgattcaggaaaatgtccaaatgtgttaaatgatcctgtcaatgtgagaataaactgcattccagaacaattcccaacagaggtctgcagcaaaagtctttaatatttttaatgaatatatacattattatattaagataattgctgaatattggatcgatcttatttaataaagatctagacata

SEQ ID NO: 613809 - DNA, 118 bp, Homo sapiens
ggttttttgggggggggccaaaatttttggttttttagcccccccatttgtttaatttaggatttttcgcccttggcctgggccccaataaggggggtttagggcttttggaaattta

SEQ ID NO: 613810 - DNA, 2420 bp, Homo sapiens
  misc_feature (2369)..(2369): n is a, c, g, or t
ctctgtcgcacctatagcgccacataccgtaccgagttcacgatgcgcacgagccatgatgcccgctgccaatctttagtgttgcgctcccacacttttcatacatagcatttcaaattacttccgctcgcgcacgctgcgcatctctgcggacgcgatccacgcgtacgctatccatcgccattttactgtcgcgtggccgcagattgcgcactccgtcactagttccgctgttatagtccgcttgaagcccctgaggtgtgaagcctcgggaatgatcttctccgaggcctaatgaaaaatatgagacggtgtaatatccggtggtgttattttgccataatggctctaggcctgtcaggtttctcgggaacagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataaaagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccntaattctgacggatatgaacatcaggatcctgcattttttgggcagaattc

SEQ ID NO: 613811 - DNA, 963 bp, Homo sapiens
aagaagtggaaggctgaccatgatgagcagtagatgaatgtgtatgtctaaacaaggactgctctgtgtcctcacagatgaatgaggtcatgctgggaattccctctgcagggaactttcttttcggagcatgcagttccataaatgcagatgtttgtctcattaccttggtggggattttattaaggtattattatagttttaataagtaaatatttttaggttgcagaatggactcctcatctttatattcacgaaaaagcaatctgaagaaaacaaataaaagcctgtgtatttagcaaaaaaaaaaaaaaaaaaaaaaaaaaaaaaaaaaaaaaaaaaaaggagaagaaaaagagaaaaaaagaaaaaaaaaaacaaaaaaaaaaaatagtaatataaagaagaggggcagctagatatttgggggtgagtatatgcatacgactgctagtaggaggcgcagtgtatttaacaaaggaatgaaggtagtggaaataaaacacaagacgtagtgagaaaagaactattgataacaagcgagacctatttatagtaagagaggggagagaaaaatagatggccagaaacaacctcgatacagcacgatatgtggaagaaccctccaagcagggctaacaaaggaaaactatcacgaaggggtattaaaagagggaagaaaaaaccaaaatgcgggcgacagtacgtgaaaggcggggccacataaaagtccctactccgacacccacgaagaccaacactacccatataatcaggacaccaaaagatattatacacagccaaccacagaccatcaaggcacaacaacccaagacataccaaaacaaaaacagagaagccaaaacagaccaggcacaagcccacaccaaacagacacgacacacccgaccgcgccccacaagtaccagagcacagaacgcacccccagcgagccgcagaggc

SEQ ID NO: 613812 - DNA, 227 bp, Homo sapiens
ggcgtcaagtggcccaatctaacagctccagggtagccacaaccatcgtgatgattgccattattgtgtgctagtggctagaggtagacccaatagaactctgccccaacagggcaacagccaagctcaattctccaagccccctgaacagaccttccacatccaggagaagctgttgttgtctagagctacttagtgtcaaatccaggccagcttggctgcttgat

SEQ ID NO: 613813 - DNA, 282 bp, Homo sapiens
gtcgatctctagcaggatcccctaacatgtatgtcggaaagaatctgtcatttaatctagatcacattgagatttgctgattgaagcttaagaacatctgttaactgcgactcagcatgcagaaggtgcggattgatgagtacgattactccaagcccattccaggggcaatagaagaagccctttgaggatcactggaggaagcacaccctgtcctatgtggacgttggcactgggaaggtcactctggaactatagacccttgatcgacattcattgtta

SEQ ID NO: 613814 - DNA, 93 bp, Homo sapiens
gtaagaaagcgctctatttagcctaggcttgacaatacttatatgaacatttaaactaaaggcttactccctaatcttgggtggctttccttt

SEQ ID NO: 613815 - DNA, 1193 bp, Homo sapiens
acccacgtcgtccgcaggaacgtgctgggttaagccgatgggtgcgaccggtgccaggaatgacggatgatatcatccttcttcttctctggatgtagcgagtccgaggctcgagagagctcttgtcctgcagccatggagatgtggaccgccagaggctaaggaagcgtgcgtgggtggagtgaccgttagtgctgaggtgaggcaagctggctaaaggcctggatgcgcgtcaaggcagaaggctctcggagcgaatccggagtaactgggtatgcactcagggcgtactcacgggatgacacccatgacaggcatggatgcatgctcacctgcggggatagtgacatgtgatgcccctggccacggggaagttttcacgaaagaacgcgatttcggatgagagagtgggaagccgtctctacgacatcgagagcactatggcagggctcgacatcctctagcgttaacgctagtggacaaaacttcgcgaggcgacgagtactcgagcacgctaagcgaagaagtaagaggcgaagtcgcgtctatgcgtccataggggaagggacccccaactcgcggtaatgattaaatttcgagttccctccaaaatgcccctcgaaaacattttgaccatgaatttatttctacacataggctctttgggtcgggaaaagtgcaatttgtgctcgtgaacgagttcagttaatcgtttcccagtggggctgcgctatagggaagataggagggcgcggaaacaggcgagcagacgcagccttcgccgttatagcggagaaccgtggacaaggcgcgtggaggtggcgaacgggaaagcaagacctgcaatgggcggaggtacccccattaggggttcccccctacggggacaagggcagtctctgccgtgggaaaacctggtggaactgttgcaaaggcaatttgtctctggtcctttccgccataagggccccttggattcagaacgggcgcgggggcaggaacaagcataagagaaactcacaccgaagagcgggtttggggaacacagggtgtcagcttcggggtggcaattcatacacccaacagttcgcaatagggggtgccacaagagacctttgggcggttgccgccccttgtagtgaaggggcctctcaaaggggacagtcccactgcgcacttctcacacatggagg

SEQ ID NO: 613816 - DNA, 155 bp, Homo sapiens
gctcgaccctccccactctcttcacccccaaagaataagcacagccgaggccgacatcacaccccctctctcgctgacagttaccccattccactcatttcctgctgcaactaagtcagcaacacagtttctctgatgtcggcctcggtgtgttc

SEQ ID NO: 613817 - DNA, 528 bp, Homo sapiens
gcttttcgctcaggcccgtgtgccgacagagatgggcaacgtgtcgtggcattcgataatgctaggaagctccgtagtcaccgatgagaccagaacgtggcatgaggggggtataagaaagctcattggggcacagccctaaaggccaacccttttggaggtgcttctcatgccacaggaatccgtgctgccacaaagtcaggagtgaagccaaaacaaggccaaattcctgccatctaggaagtgtggtaagggtccagctgtatcacggaaatgcgcaaggaaaaatcaccagcctttggttaccccaactgaccgagttggcttgacacctttcactgcgacggaaaactgatgaagttctggatggctcgggattcagggtcgcaaagggacagtggctgtggggtgattattcctggaaggtccggattccaaggttgtccaagtagccaggggtatcatctttggaccctactccacaggcacggcaaggaaggcccagattcatacgtatcactggcgaca

SEQ ID NO: 613818 - DNA, 157 bp, Homo sapiens
aactcccccttcccccatatgaggacgtggcaagaagatgacatggattagaaccaaaaaacagctgtcgccaaaccccgactctgtcgttgccttgattttgaacttccagcctccagaactatgaaaaataaaattttgttgtttgtaaaaaaaa

SEQ ID NO: 613819 - DNA, 228 bp, Homo sapiens
gacgcgctgtatgatgatgcccatcgtgggtaacatagtacttgccgactctcgactcttacaactaggcggctatggtataatacgcctcacactcattctcaaaccccctgacaaaacacacattagcctaacacctataccttgtacctataccctgatgacggccatacattatacacaacgcttccatactgccctaccgataacacagcaccctaaaaattc

SEQ ID NO: 613820 - DNA, 188 bp, Homo sapiens
aacaggggatcatgtgcaggtttgttgcatgggtaaattgtgtgttgcaggggtttggtatataaataatcttgtcacccatttaatcagcatagtacccaatagagtagtttttcagtcctcaccctcctctcactctccaacactaatttcccatctttcaattttcttgttatagtgctttcctt

SEQ ID NO: 613821 - DNA, 297 bp, Homo sapiens
caaagctgagagtttcaaagttcttcaaagaaataaagctgggattcttccgggcccatacatgatctccccagaaatgtccagctagatgagcccccaaatccccttaattgttccccccagtgatgccccccccagactcaaaatgatttgaggggcttgtttaaatattagatataccagggttaagatatttcagaagtatgtaaaataaacccgttttaatttaaaatttgagataaggatttttaaactattaaatccatttttgtcccatagaaatatgtttaattatta

SEQ ID NO: 613822 - DNA, 413 bp, Homo sapiens
ttttttttttaaaaaaaaaagggttttttttaaaaaaaggggtttccccccccaccaaaagtgggaaggggttttttcccccaaaaaacccctttttttttggttaccaaaaaaaaggcttttttggccctttcccttttccccaaaaaggggccccaaaaagggggttttccccttccaagttttaaccggttaaaatttttttgggtccccagggggcatttttaaggaaaaaggggtttttttttttggggggccaagggggaaacccccaaaaatttttccacgccttttgggcaccccccaattttaaagaaagggggggggggccttccccccccggggtttttattccccaaaaaaaaggggccccccgggaaaaaaaccaaaaaaaaatttttgttttccttgga

SEQ ID NO: 613823 - DNA, 262 bp, Homo sapiens
  misc_feature (6)..(6): n is a, c, g, or t
gctcantttcagttctgggctcggacacagaaccactttttcctcctgggattccaggcttgaaatgggaggaacttccacaaaagtctctgacatgccctggagacattttcttcattgtcttggtgattaacatttggctccttgttacttatggaaatttctgcagtgggcttgaatctctcctcagaaaatgggattttcttttctattgcattgtcaggctgcaaattttccaaacttttttgctgttttccttttg

SEQ ID NO: 613824 - DNA, 230 bp, Homo sapiens
gggcacctgggagtgctgcgttccagtggcacgttaccacctgccacagagcaaggggttgggctgttttgataaggccgatggtattgatgataaagccccatggttcatggttttggatattgtaagtaaatcttctagccaaagtctaaaaatcctgtttcttatagaatcatttacagtgtttgtggaacagcgggtggcttctctagttttccatatttgaaggg

SEQ ID NO: 613825 - DNA, 211 bp, Homo sapiens
  misc_feature (66)..(66): n is a, c, g, or t
aacccaggaggcggaggtagcagtaagctgagatggcaccaccacactccagcctgagcgacagangggactctgtctcaaaaaaaaaaaaaaaaaaaaagtcccctgggttccgggccttaagaaaaaaaaccggttatacaacttgggggtttaaaatttttttttttccccgccaaaaaaagtttttgaagggaaccattccttacat

SEQ ID NO: 613826 - DNA, 750 bp, Homo sapiens
  misc_feature (3)..(3): n is a, c, g, or t
  misc_feature (19)..(19): n is a, c, g, or t
  misc_feature (23)..(23): n is a, c, g, or t
  misc_feature (26)..(26): n is a, c, g, or t
  misc_feature (41)..(41): n is a, c, g, or t
  misc_feature (43)..(43): n is a, c, g, or t
  misc_feature (51)..(53): n is a, c, g, or t
  misc_feature (84)..(84): n is a, c, g, or t
ccnagttccttgtattccntacnccnctctccccccaaggncncagcgggnnngtcattatggccgggggaggtggggagaatnaattttttttggtggttattggaggatagataaagggggggtattaggaaggagtgtgggggcaagaatgataacatgggggatgaatggcagaaggtagattgatgttgaaatttaggagggatgctgaggagtgatgatgaaaaggaggtactaagaggggtatgtttgtgggtaaagtggaaaagtttgaggttagagttaaagaggagtatagttaaagaggggggtaattggcttggggaaaatgggatatgttaattggggttagagaaataaaggagagtttgggctgttttgttaatgcaggtgttaaagaatagaaaaggggaaggaagataatgaatgaacaggggtatagaggttataaaaaagagagggggaaagggctaaagaggggtgtatttggtggggattgtagatgaacgaaattgtatgcataaatagaaattggggtttagaagagcttttttattagagtaatttggtgagaagaataaaagggttggaagggggggtaggctctgaggggaagaagataaagtgtatgggaaggtaaaagtattatgattgctaatatggggtgggagtagaataaattcgggtagagggggggggaataaataaaaatagggaagaaagggagaaaaatttggatgttgagaa

SEQ ID NO: 613827 - DNA, 1173 bp, Homo sapiens
gcagtactctgtgcattggtatgaactggccggtcgtttcacagtccgaggtcactagttcccggtagttcagctgccacatgaatagaacagcaatgagagccagtcattatggcactttgaagagattctaatcgtaatcaatgtgaacacgtcttgaaaaaggatccgagagtaaactgaagtgtaagctaacaactctacgcagctatataatgcaggccactgaagtgaccttgtaacatgcccaaaccatggtgtatttgacttgatcaacaatggccaagatggtgactgtcatgtgaatgtcccttgagcgatgccttgcctcatagtgacagcttgccgaggcagaacttatgttgcgattttggttgtccatgtttgagtccttcattggaatcctctagtcacggtggagcctggaacagacaggaaatcaactggtgtttgaaactctggtggtgacctccgaagatggcatcacaaagatcatgttcaaccggaccaaaaagaaaaatgccatagacactgagatgtatcatgaaattatgcgtgcacttaacagctgccagcaaggatgactcaatcatcactgtattaacaggaaatggtgactattacagtactgggaactgatctgactaacttcactgcatattccccctggtggaacgtagaggagcaaagctagacaataatgccgttcacttgagggactctgtgggctgataatagattttacttaagcctcttgattgcagttggtcaatggtccagctgtgggcatctcccgtacccttcctttgggctattcgatgcggtgtatgcatctgaacagggcacaattttattacaccagttagtcccgctaaggccaaggtccggaaaggattgtcctcttaccctttccggagataattgagccccggccaacggccaccacgagaatggtaatttttggaaacgaagttaacgcggggaggacgcctcatgtccaaggacgtgatctcggaagttatacgtaatagcgctattcgaaacaagttgtgacgcactgaagagatttgaaggaccccaagcctagagctatcaagacaagtagacgaacagaaacaactcagagctcgcacaagtctcggaggcgaatagaagatgatggcatgtcccaga

SEQ ID NO: 613828 - DNA, 907 bp, Homo sapiens
ggcctcggtgacaatgagcgctcttcctagtgtgctgggattcagtccccaaacacagcgggaggggtccctggggcagatggggcttgtaccagcgtcgggtggtttagttcgagtccctttatgtggagaaatgggagatgaaagactgaccacgtgccaggtgtggccgaagcccccgggagggccacattcgggggagctggggggtcgaggggaggagccaccgactggcatctgcttgccagcgacatggccccatccctggaagtcctcgggagcggagcgctggatcggcaggcgggctcgtgggcgtccccgatggaggagaagctgtagttattttaccaaaagttgtgtacatctgtggcagatgtatagatttctgtgactaatcactgaactagatgaatgttaaatttgtttatggtctgaagcctgagtctattgttggatctgtagaataatcattgccagggtgacttttgttcaagagaaaaggattgtactgtattaagaaccgatgaaaaaaaaattctcctgtaacatattttgaaggaaaacttgggttgtgtgagaagaaaaagtagttggtacttaacacttcattccatttttgcacttttaaagtaagacccttagggacggctttgaggcctaaagagaatccgctcgaccggtcacttacagcataccagcacgatgcacagaaggagcggggcccgccaaataatagcacacccaggggggggacaacagttaggtcaacgccaggatgtccgtataggcagggggcccacaagggagacagagaagaataacgcagcgcgacggcgttaacaaaggtgtcgtgcgtgagacagacgagccgggcactttggaagcacaccaacgtggggggggacac

SEQ ID NO: 613829 - DNA, 819 bp, Homo sapiens
agcgggttccgcgtccccgccgccgggaggaggtgcccactcgctcgcggcgcgcgccggccggcagactcgggctgtgggcgattgcctccgtgaccgcgatggctccctcgccacgaggaggaagatgcagacgcttgtctgaaagggtaagagagtcggctactggctgagtcgagaagaaaactcaagaatgctgaatttccaggtcttcgccgagctgtgcaagctgaatccttagtcggccgatcgaggagcagggcccccgtggacgtcatcatgccacaagctgactgacgttatccttgaagccgaccagaatgatagccagatcgctggagctgggtgcacacggttccaggatgtacatcgatgcccagcactgagaccgatctgtccgggactacgctcgccgtgccatcggaaccctgcttgaccgttccaagtcgcgtatgaggctcatgccggaagattgaggcctacatggaagacgagcaggatctgtctcggcacccttcatggagctcacgagccgtgtgcggggatgacaaccatgcggctgtcgggacgaaagaacggcttgagcttgtcccgattcatttgcaaaaccagaggtgggtcatggcaccaagtctcacgagatggctatcgtgttcaaccaggagggcctgaaggccatcgagtcagcctgcgttggtccagaatttcatcgaacacaacgccgtcctgtaccaagtgtaccgggttggcgaatctacgcggtggtccagaggcccttactcaagaacttctcggcagggacattagaccgtggattca

SEQ ID NO: 613830 - DNA, 722 bp, Homo sapiens
cccaccaggttttagatgcgtgtagagcgggatgtacctgaatgtcactgacccagctgcgagggggggaacagagcacaactacggtgatgatcatcaaatgtgctgatgacgaaaaactagggcactcatggagcgactaagctcaccagtatgctgtaaaccgaatggattatcatatatagtgagctaacgcacccaaatgtcttccattgaaaggcctgtctgcaaggaggagccagagccaggatttaagcgccatggcattggggccagcctgtgggcctgaggcatacaggctacgtcattgagctgcactttgttgccaagggccccagtggttgtttagagagtctgaaggtgacctgcagcacgggcaaatgctggatagaagccaaaggcctccattcactgggtgtcacagcctttgatgggcgaggtttgcctatatgagcgactgttaaagcacaagaaccctgaagatctactgaggtgcctggaggatttttaagcgacctgaacctgtcatcaatacacctgaaggatgcagctttacaagactgctctgaggccctgggagacagccatcaggttaagctcgaattgtaccgaactggcacactgcatgaagactcaagaaaggtgccggctgggagcactgggcttacctcattctgcagcagggtgcggttacaatgagcggcgcaattacatgtaagaag

SEQ ID NO: 613831 - DNA, 603 bp, Homo sapiens
  misc_feature (38)..(38): n is a, c, g, or t
  misc_feature (75)..(75): n is a, c, g, or t
  misc_feature (169)..(169): n is a, c, g, or t
  misc_feature (262)..(263): n is a, c, g, or t
  misc_feature (500)..(500): n is a, c, g, or t
ccctctcctatgggggaggagtgggtgggcctcttttnaaaccgcggggggggggggtgctcccccaaatttgtncccccccgccgcgccccggggtgtgtgtttggcgcggggggggtactctccccccgtgtggccccccccttttcccccaaggggggcgctctcnggggggtctccccccaggggggggggtgtggggggggggggtgtttttcataaaaaactcccccccccccccccccccccctttctccccccnngtgaggggaggggggggggggggggggggggggggggggtttttttttttcccccccgcgggggggggttttttttaaaacccccctttggggggggggggggggcccccccccgggggggggggttttttttttcccccccccccccccccccgggggggggggggggggcccccccaagggggggccttttttttttggccccccggcccccccccccccccccggggggggggngggggggggttttttcccccccccccccccccgggggggtttttttttttttttttttttggggggggcccccttttttttgtggggggggccccccccccca

SEQ ID NO: 613832 - DNA, 781 bp, Homo sapiens
cgaccgccgcggctaactggtgctacgcaaccgtcgcgccccgtgcccgctcctccaccatcgtcgccagcctcggcacccccgcgccctccaactcctcctccttccgccccaagctcatcaggaacaccccagtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgtgccgactcccgtgtgtgcccctcggtcaccctgggcctggagcccggcgaggccttcaccatccgcaacatcgccaacatggtcccgtcctactgcaagaacaagtacgctggtgttggatcggccatcgaatacgccgtctgtgctctcaaggttgaggtcatcgtggtgattggccacagccgctgcggtggaatcaaggctctcctctcactcaaggatggcgcagacgactccttccacttcgtcgaggactgggtcaggatcggcttcccggccaagaagaaggtgcagactgagtgcgcctcaatgcctttcgatgaccagtgcaccgtcctcgaaaaggaggccgtgaacgtgtccctccagaacctcttgacctacccgttcgtcaaggagggtgtgtccaacggaaccctcaagctcgttggcggcactacgacttcgtctccggcaagttcgagacatgggagtagtaaatcttcccc

SEQ ID NO: 613833 - DNA, 977 bp, Homo sapiens
ggagctcttagagataagacatagaggtgtctggttctgagacaaggaagttccgctaagtgagagacacaactgactcagactgactcagagaacgtgattatattcctggtccctagaacgaacctatatgagacactccagtccctgacgtccaccttgcctccaggtgcccagaacagcccatcgtggggacttcaccctcagcaagtggacgccgcttggtcctgccagggcaggatgtgtgtctgccttggggatgtacaagcgacaataggcctctcatgtgccaggcttcccgtgtgctcaaagtcctcaggaaggagcccaccactggttggagggactggagactggatgggcgacccagtagtaacctgcactgcccagggtggcaaaggcatagtatcactcattactaaagtatcgagcagggcacaccgtagctgggtgcacgcatgtggtacttggtggcatgagcagcgttgatgtcagaccaaatatcgatccagaataatcctccgagatccgtgcatgaagatggcagctgccccacgtcagtgccctggaggtgaagcaaacgacggctgggaaagtaaacgtaacaacaagtggcgacaggatgctatgcacgactgggacataggatatagcgaccgctcccacggaagctcgtctccatagagtatacaaagtcatttcccctggcggttacggggccggatcgtgggtcgcttatgactactagtattgacagaatcaagttgcatgaaccccaggcaagtacaaaggtccttaaggagaagggcgcgagggtcctccaaaatcaatccactgtgcatccagctagatgtcatgccacccctgcagaagcgctgatgtcctcaaagatcggagtcaaccgcaggatttgtgacctctcgggctatgtgaaataacccggggggcaacacacgacaaccgtcctgcattctctc

SEQ ID NO: 613834 - DNA, 358 bp, Homo sapiens
  misc_feature (9)..(9): n is a, c, g, or t
  misc_feature (142)..(142): n is a, c, g, or t
  misc_feature (159)..(159): n is a, c, g, or t
  misc_feature (168)..(168): n is a, c, g, or t
  misc_feature (175)..(175): n is a, c, g, or t
  misc_feature (201)..(201): n is a, c, g, or t
  misc_feature (219)..(219): n is a, c, g, or t
  misc_feature (247)..(247): n is a, c, g, or t
  misc_feature (293)..(293): n is a, c, g, or t
  misc_feature (339)..(339): n is a, c, g, or t
gtgattgtnccactgcactccaggttgggtaatgcagcgagactgcgtctcaaaaaataaataaaataaaaaaaaaaaaaaaaaaaaaaaaaaaaaaaagcaccaccgcactccagcctgggcaatagagtgagaacctgtnttccaaaaagaaaaatnttaaaagantgatctnggccaggcgtggaggctcatgcttgnaatcccagcactttgggnggccaagaacaggtggttcacttgaggncaggagttcgagaccagcctggccaacatagcaaaacccccatctntactaaaattacaaaaagttaactgggcatggtggtacatgccctngtaatcccagttacttccg

SEQ ID NO: 613835 - DNA, 426 bp, Homo sapiens
  misc_feature (34)..(34): n is a, c, g, or t
  misc_feature (397)..(398): n is a, c, g, or t
ctgccccgtaagcacaattgcgctctataggagngtgcgaagttaaagcctcaactcacgtgcgcgcacgagtgactcacgcccgtgacatggccagagccctggcgaggccgaggtgggcggatcacctgagttcaggagtttgagaccaacctggccaacatgccaaaaccttgtctctattaaaactacaaacaattaatggggcatgggcgtgggcacctacaatcccagctactggggaggctgaggccaaagaatcacttgaacctgggaggcgaggttgcagtgagccaagattgtgcactgcactccagcctgggtgacagagcaaaactcatcttaaaaagaaaaagaagacgggatagaaagaaagatggacgaaagaaagaaaganngaagaagaatgatgtaggctggacccgt

SEQ ID NO: 613836 - DNA, 91 bp, Homo sapiens
  misc_feature (71)..(71): n is a, c, g, or t
  misc_feature (90)..(90): n is a, c, g, or t
cctggcagaataatttggataattctttatatcactctgaagctaattgactatctgagatgtgttgttcntataaagtgaagtgatctna

SEQ ID NO: 613837 - DNA, 1315 bp, Homo sapiens
  misc_feature (170)..(170): n is a, c, g, or t
  misc_feature (565)..(565): n is a, c, g, or t
taaacctttccttatgagcatgccggggttggggttggacagtggagggtacataatggcactggtcgggttggattggtgaagattattgggcgctggtcacattggtccagtctcagtggttttcaatctggcaccgcaggcttaatcgcggacggagaatgtttccnatggtgtaacttatatctactaacacatattagagattctctctatataagggtgagataagtattgggtcccaattgggtgttgtggagagagtctcagttaataaatgtgttgggggaattttaaaaggtaagtggggtggtctgagctatgaaagcgcgcattctcatttaacagtgggggtgggcgtggcttatatagaggcgccactaccatagtgggcgtgtgtctacaattttttttataacagcttcgatcttacatacccagagggggtttttataatacgctatagtgtgtttccccaagagagagcgcgtgtgtctcccctctttgggggcaatctaacacgacgttttaacaatatatctcaccaagagggagggaaaatctntcacgagacggggattctccgtgtggggccgccacacattctatcacacgaggttgtgacccagcttcaagacattctcctaactacttggtggaaacaaacaacccaggtatatatcacacccgagaggactctgcggggataaaggtatattgatggagtccgagccctactctataataaacccctgtttgctgccgcaggacacaaaataaccactaatttttaatatcacactaacagaacaaaaagtatcagataacaaataaaaataagtaaacaatacaaaaaataacacacataaaaaacacaaaaatcctaagagagagaacaagaaaccataacataataatcacagagggacaggaagacgagacgaaaacaaaacaaagagtccgtatcatataaattcagaccactaggatgagccaactaggcaggatactaacaacaacagggctcgagggtagatacctcagcgcgaacacaccacaagaacaattcatgcctgatgcaaacccacgaggggaagaaacaaacagcaagggggggagacacccccccaatactaggggagaggaagcaaggatcaactaaaaataattacgcaacaccaaacaccgcgcacggataatgaccgcgcggtaataagaagaaaaaccgagagcgacgaagataggccggtccacgcagcagcagaagatcagtccgacgagacgcacaatcaacaagaggagcagaagccacaag

SEQ ID NO: 613838 - DNA, 157 bp, Homo sapiens
ggctaagaagaatacctctcttggatacccgttttggtttttttagtcaatactactaaaggcttagtaatgatatctcacaattaaaaactatgacggaagtgatctcaacatcgagagaacactggcacgcagagaaagagcgggaccagcagat

SEQ ID NO: 613839 - DNA, 218 bp, Homo sapiens
gttggtattaaggatcccagagtcattctgcatctcagatcaggtgtactgatattctaagtgtctagatggttaattcttttaagggcctgttctcggctagctggcatcatgtataaaataattctctttaatatgctcggggtctaggtgttaatagagtgttggcttaaagatcatgcagagaagtggaggtcgtgggtaccgggagctcgaat

SEQ ID NO: 613840 - DNA, 123 bp, Homo sapiens
gtgttgactgacttacagttagtacgagattgaggggagaaaaagtgaacgggctaaaaggggtaaagtttgcgctgtgttggcctcactccacttgagttactggggcctgagtcctaagga

SEQ ID NO: 613841 - DNA, 351 bp, Homo sapiens
tagctaattcttattaatcgtaaagatggagtcaagctagtacgcccaggatgatctcaactgcggtctcacgtgatcctccctccttagcctcccaacgtgctgagattacaggccgtgacaatcaatttctaacaaactctcaaatattgtagacgctactttgtctttgacctcaccaccctcaaatacacacacggatttgaacagacacctactaactgacaaaaacgactttgtagaccctacctgggcccctgcacacactaccaggaccacacttctgaagtatcacatgttgcgggctactgacgggacttacagacggatctacttacgactcacctgaca

SEQ ID NO: 613842 - DNA, 196 bp, Homo sapiens
  misc_feature (153)..(153): n is a, c, g, or t
gggtgttgacagtgtgggacagaaaaatgaactccatctacaagtgattacctagttgtgagctgtggcatgtggttagaagccatcagaggtgcaaggcgttagaaaagaccctggccatgaccctgactccactctataaaccctgggtcnttctcctttggctggtgctagtcagacacctttcaacgggggg

SEQ ID NO: 613843 - DNA, 156 bp, Homo sapiens
agagatatttcactgaaggagtataagcagatgacagagagaacatgagggacgttcgcctacaccgggccatcatgcggggatcagtgggggctgctgtatgtcttggatgccgaacggggacggtgacataggcatcatagccaaagaggcacg

SEQ ID NO: 613844 - DNA, 412 bp, Homo sapiens
tcgacttttgaatgatctgctgaaccagcctttaatacctgggataaatcccacttggtgtatattctaacatccctgccatatctgactctggttctgatacttgctctttctcgtcaaactgttttttcttgcctttaatatgtcttgtaatttcttttcttgattactggacatgacacacaagttaagaggaactgctgcaaacaggcctttagtaatgtggtgataaaatatggagggagaggaagggttctatagtcctaggagggggtctcaatcttttagtgagcttgtaccactgaactgtgaacttcacacatgcttctcaggcccccctgacccccttgcataggacaagatggctagagtgtattggagttgggtatttcccttcttccatgtggaaggc

SEQ ID NO: 613845 - DNA, 139 bp, Homo sapiens
ggggctgccaggctgccaggtgatggaggggcattccagagtcgtggaggagctactgacagggacttggtagtaaaatctctcggcgtagcagcgtcgggtatctacgccagctaagttcacttcgtgatactcggga

SEQ ID NO: 613846 - DNA, 94 bp, Homo sapiens
ggatttgctggtgcagtacaactaggcttaataggaactcgaattcaagttctaaacgttagaagcttgaattcgagcagtagtagtagtaggc

SEQ ID NO: 613847 - DNA, 165 bp, Homo sapiens
gacttagatccacactggcattatccagacatactttcactcaaaaagacacatgctcctgtggagttccatcgtgctcagtggttaacgaatccaactaggaaacatgaggttgctgggttcaatcccgtggccttcgtcatgttgggttaatggatcctggcg

SEQ ID NO: 613848 - DNA, 145 bp, Homo sapiens
cactagaaactgctacagacttacccgtatattgtcaagatcatagctgactttaaaaacagtagtaataaactttttgatgctagctgtttactgggttgatgtttttgatgtcataaatagaccttgtttaagtagtcacaag

SEQ ID NO: 613849 - DNA, 446 bp, Homo sapiens
aatgccgacatacacgaaatcaatcaaatagattatagactgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcattcttaaaaatgggcaaaaaattgggacaaacatttttcaaaaagaagacatacaagtggcctacagttatattttttaaatgtttgacattgctaatcatcagataa

SEQ ID NO: 613850 - DNA, 273 bp, Homo sapiens
  misc_feature (14)..(14): n is a, c, g, or t
gagtgaccagaggnaagaagagtgaacacagcgtagtgaacgaatcagcacgaaagatccccatgttgttgggaaaagcctatgaacgtcatcagcgacgcactatcggcctgacggtgttggccgcgctgatggtgccgctgacggcgggcacgatgctgatgctgatgccgccggcccgcgcggtggacaactgggaggtggagggcgcgaacggcacgctccacgtctacggcgcgttgacggaaagcgcctgcagtctggaaatgacca

SEQ ID NO: 613851 - DNA, 1272 bp, Homo sapiens
aactacctcggactcctgcctcactcatttacaccaaccacaccaactatctataaacctagccatggaccatccccttatgagacgggacgcagtgattataggcatttcgcgtctaagattaaaaagtgccctagcccacgttcattaccagcagaggcacacctacagccccattatccccatactagattattatcgaaaccatcagcctacgtcagttcaaccaaactagccctggccgtacgccataaaccgctaacattactgcaggaccaccatactcatgcaacctaacttggaagcgccaaccctagcaactatcaaaccacttacaccgttccctctacacttatcatcttcacaagttctaattcatcactgactcatccatagaaatcgcatgtcgccgttaatcccaagccatacgtcgtgcacacgttctcgtcaagcctctacctgcacagacaacagcatacacaaacacagcacgcaaacaaaacacaaacaacacacacaaaaaagcggcagcacagaacaaaaatacccaccaggcaccccgtaaacagagaaacacaaaaacacgcaacaaggtgaccacaaacaagaaacaaaaaacacgcacacgacaccaagacaaccacacaaccacccaccaggacacaccgcaacaacatggcaccaccagagaaacaaccactccaacagcgagccggaccaaccacggaaccacctcacgccgaccatcacagagcccacacgggcacacaccacaccacaagcagaccacaggcgtcaccacaacccaaaacaaatgaacacgcgccgccacacgacagaccacagagaacgacccgcagcacccactcaccaaccggcgcagagcagcacagagcccacacacccaaaccacacccccacagaccacaaaccaacgggacacaactagaccaccagaaccacaccgcagaccaaaccacaccacacaccgggacggacagtctggaaacacgcagaccacgagaaccagagcgaaacgacgagacagacgaaaaaccaaagaaaggaagaacagacacgaaaatcctagcagaatcgagaacaagacaaaaccgaagagacaaaagagcacgcgacgaaaagcaacaacgcagagaacaggagggcaaaggaacgacgaagcaggagaaagcggagagaaacaacgccaagaaccagaagaagagacaaaaaagaaaaacaaaacagcaagcaagacagagaaaaacagag

SEQ ID NO: 613852 - DNA, 135 bp, Homo sapiens
cgagctgccccccccagggacccaggctttgatgcgagatccatcctcgttcaaggtttggttgacaggaacagagctcatcgaggcgcactcgacagagatgtgcccacgagcagtcgagtacatgtttctggt

SEQ ID NO: 613853 - DNA, 1348 bp, Homo sapiens
acccacgcgatcgcggacgcgtggtatcgaccacgcgtcgggcagcggatgccactgatggaggccgtggtgaacaaccaccatggaggatagcccgatatacatggtgcagcgtggatggcatgtgtctatcgcaaggaggaggacggttccaccttggcatccaccacgcagcacaaaatcgggaacattggagatggtcagcctgtctgctgagcacaaggacaggtggacgtcaaagcccaggacagtggggggtggacggcccatcaatctgggcatgcagagcaacaaggcacatcgaggatgatccgacatgctaaatgacgacggggcagccgaacgatcaaccatcacttgacaacgacggaagaacaatctggcctgcaactggagccatccattcaccggagcagacagaccgccaatcgaaacggaagatcacattcatgaaagtgacgcagcatgatgaacacatccattgactggtcacaagatacacaatgggagaaacaaccaccccacgtgaacaaatacgcaagacaacggaggcagagacgtaacccatgcacctggcagatgcataggataagtacactggtacaacagtgggagccaaaccaatgaagacgtggcgggaaacaaaaaaacgaagaaggaaccacagcaaaggggcaccgtggacataccgagagcggacacggacaggaagaggcacaagaccgacatcaacacaccacaccgcaaagagctccgaacaaggagcaatggggacacatcaaggcaaaaccagacaaaagaacgaaaggcatcacacaatgccaggagaacggagagacacggaggcaacgagaagaaacagtggcaccaataaccgaagaggacacccacagaagatctgacactgagcgacgaccccggccacaggcaggaataataccacagcagaaacaccaacacaaaagaaacagacaacaagacacggacgtcatcgaacagagaaaacaaccacacaggtagaagcagagcacaagaaggacaacaaggcacaccaacaaagaagtaggaacggaaaaaaacaagaaagagaagagaaaacgcagacggcccagacacagaaaacaacagaaagtgacgagcgaagcaagaaggataagcagagaaggaagcgagaaacagccacaacagaacaaaaccagagaccagagcgacaaagacagccaccaagacagcaaagacgagaaacacagaaccagcaaaaggacgaagaaggcagaaagacaacagacaaagagggagacacaacacgaaagcaggcaacgtcgacacgaacacgcaaccacacaac

SEQ ID NO: 613854 - DNA, 271 bp, Homo sapiens
tcgctattcatcggcaccaggttagttagatacagagtgttgacacaaagggtctccaaggccccaccagagtagctagatacagaggggccattggtgcattcacaaaccctgagctagacacagggtgctgattggtgtatttacaatccctgagctagacataaaggttctccaaggacccatcagagtagctagatacagagctgaagggctcctcaagtgctgccaaagtgggagcccaggcagaggaggtgccgatgaatagcga

SEQ ID NO: 613855 - DNA, 415 bp, Homo sapiens
  misc_feature (279)..(279): n is a, c, g, or t
tcgacctttgggaggccaaggcgggtggatcacctgaggtcaggagtttgagaccagcctggccaacatggtgaaaccccatctctactaaaaatacaaaaattagccagggagggtgatgcacacctgtaatctcagcttctctggaggctgaggcaggagaatcgcttgaacccgggaggcagaggtttcagtgagccgagattgtaccactgcactccagcctgggcgacaaagtgagactatcttaaaaacaaaacaaaacaacaactacaaaanaagcaaaaggagaagctgggttgggctctcaggtgggtactatcaacacctgtctgagtgggatgagggatcggaacaccagctgggcttgagaaatgggggtccacacagccccttcccagtcgacgcggccgca

SEQ ID NO: 613856 - DNA, 120 bp, Homo sapiens
gatctagaggatcctccatcttatttcattatttttaaacacagcacagggagaatccaaaatgagttcccaagatgaatgacaaatgacagcccatatcataaccaggtattttctgat

SEQ ID NO: 613857 - DNA, 761 bp, Homo sapiens
  misc_feature (761)..(761): n is a, c, g, or t
cgcgcggggagccagggcgcccgagcccggcgcgccgcagggcgcgcagcccccgacgcgccctgtggggacccggacgcaggagggaccctgccccgggaaaagggcgtgtggagaccgtgggctccgagcccgagttcatccccccacagacccgctgagcgacctgatgacagccgtggttccgcgctcgggaagcccatagtcactgcgcctgtcggtgtcatgcgcacggcatctcgtggcctagaaattcggtggagcgatgtccgggttgacccttggcattgcgactggaaccttgtgttgccaggttgcgcattggcgtgtgttcacaacggactcctgacaagggcgggcacttggcatccacttccatggtagctagttcacacgatgagcgaagcattgttgacattgtattgtgcctgaacattttcctatggcttgacggtccgcgtcggtagggggcatagcactcaatagtagcgggacccacctcacgtcggggcaatcacaacgactgttaatccaggtgttgaccttaaagtcctatcacaaccgattggttagatacatgactcagcaggggaaggatcatttaaaccttcgtctaccatcccctggcgataggattcggccattatacgtttcccagtatatagcgcttccacataacgccactgaggagaacaaccgcttcgatcgaccctttacactttgagccaatacttactgaacgcttcctcccccactatagn

SEQ ID NO: 613858 - DNA, 746 bp, Homo sapiens
  misc_feature (76)..(76): n is a, c, g, or t
  misc_feature (134)..(134): n is a, c, g, or t
  misc_feature (146)..(146): n is a, c, g, or t
  misc_feature (155)..(155): n is a, c, g, or t
  misc_feature (163)..(163): n is a, c, g, or t
  misc_feature (174)..(174): n is a, c, g, or t
  misc_feature (180)..(180): n is a, c, g, or t
  misc_feature (185)..(185): n is a, c, g, or t
  misc_feature (199)..(199): n is a, c, g, or t
  misc_feature (201)..(201): n is a, c, g, or t
  misc_feature (214)..(214): n is a, c, g, or t
  misc_feature (223)..(223): n is a, c, g, or t
  misc_feature (248)..(248): n is a, c, g, or t
  misc_feature (260)..(260): n is a, c, g, or t
  misc_feature (264)..(264): n is a, c, g, or t
  misc_feature (268)..(268): n is a, c, g, or t
  misc_feature (297)..(297): n is a, c, g, or t
  misc_feature (312)..(312): n is a, c, g, or t
  misc_feature (314)..(314): n is a, c, g, or t
  misc_feature (324)..(324): n is a, c, g, or t
  misc_feature (328)..(328): n is a, c, g, or t
  misc_feature (339)..(339): n is a, c, g, or t
  misc_feature (347)..(347): n is a, c, g, or t
  misc_feature (365)..(365): n is a, c, g, or t
  misc_feature (392)..(393): n is a, c, g, or t
  misc_feature (397)..(397): n is a, c, g, or t
  misc_feature (413)..(413): n is a, c, g, or t
  misc_feature (424)..(424): n is a, c, g, or t
  misc_feature (559)..(559): n is a, c, g, or t
  misc_feature (564)..(564): n is a, c, g, or t
  misc_feature (672)..(672): n is a, c, g, or t
  misc_feature (684)..(684): n is a, c, g, or t
  misc_feature (717)..(717): n is a, c, g, or t
gtacccggttgtcctcaggcgctgtcagatctgtggtttttctacttgaaggacacaatgttttccaaactagcanatttgcagaggtttactgtacttagtcgcggagttcattcttcaatggcttctgctanatctgttgcaantaaaaaaanaatccaangccctccaaantctgangaaanttttgaaaaggaananaaatatggtgcanaaaaataanatcctttacctgtagccctggaganaggaaaaagtanttanttangggatgtaaaaagcaaaaaatattttganttcctgagttcttanantgctgtcaancaanggcattgtcancccaaaantgtgaatgctctgaagantcaagtggaaaaaataaacttaaaaannaaanctttctaaaaaaaagnaattggtgaanaaaaggaatatattactaaacttttcaactaccacaaagttcttcctatgaatacaggagtggaggctggagagactgcctgtaaactagctcgtaagtggggctataccgtgaagggcattcagaaatacaaancaaanattgtttttgcagctgggaacttctggggtaggacgttgtctgctatctccagttccacagacccaaccagttacgatggttttggaccatttatgccgggattcganatcattccctanaatgatctgcccgcactggagcgtgctcttcangatccaaatgtggctgcgttcatggtaga

SEQ ID NO: 613859 - DNA, 276 bp, Homo sapiens
  misc_feature (10)..(11): n is a, c, g, or t
  misc_feature (55)..(55): n is a, c, g, or t
  misc_feature (109)..(109): n is a, c, g, or t
  misc_feature (117)..(117): n is a, c, g, or t
  misc_feature (263)..(263): n is a, c, g, or t
ggtggttgannccttatgaaatggcttggagccactctctcagtagtaagtgacntcttcctctattacttctcatgagagctgactgttaaaaagagcctggaaatcnccttgtancctctcttgctacgtgatctctgcacatgccagctcctttttgccttctaccatgagtggaagcagcctaaagccctcaccagaaatagatgttggtgccatgtttcttgtacagcctgcagaaccatgagacaaataaacttttnatttttataaatt

SEQ ID NO: 613860 - DNA, 865 bp, Homo sapiens
tgcacactgctcttatgtaataccttacacaactacttgtgcggtctcttctcctggggcaccccccccagtgttggcccccgacataattgcgccccctaaatcgctgtgatcccctgttcacaagttccctctcctatttggaaaacactgcttttatcttctcggaaaaaattccctgtgtcctctttcacgaaagcatattcccgcgggttgaaaaattacggggcacaccgtctgcacacagttttgcacattcctgtaaccacagtgcttatcgcaaacacccttagctgcgcgcgttaacttcaacttacacagttctccccccctgtaaacaatcaagattcgtctcacgaagggcacagaaacttcgctagcctttttcgctccaggacacctcgtggtagggctccccgtcaatatgcccccagggggcggaaaaccccagaaatgtgggcgcacatcgtgtggacaacattatggtcgtctagttgctagtcctctcccaagtgtgtacgctcacattcagcgcctttgagttacatacacggactgtatatgggttgtgacatattcccaaaacctacttctgccagtattcaaaacaatggaagaatccaacacacagcccttccttaaccaaagaattgcaatttactcatcttttgaatatttcaatgacgtgatattattcaccccctggtatgaataactttatgcataatatttcctcttggttaacacgctcctagattacgaaaacccctcccccctccttatttaaatccccggaccaccagacgtatgagaataaaatcgccccgcagttgccttttagaaactataaaacaaaaaacataac

SEQ ID NO: 613861 - DNA, 609 bp, Homo sapiens
tggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatatgtttttatgttaatttttgttaatttgacatccctagacgatatcatgaaaatatttactgtgtgtacgtttgtgtgtgtgtatgtgtgtgtgtgggtgcagttttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttcaagttcttaaatcaataacacacaaggcagggccctgtgattttt

SEQ ID NO: 613862 - DNA, 242 bp, Homo sapiens
cgattcagaggcgttgcgcattcaacccccggacgccgtcagcaggacctgatcagcagatggtcgccgtcattcaagccgtctcagaatctggcacacgacagccggtcactgagtgccgggtgcgcaccctcgcgctgtctggtatcgtgccgctcgctggcgactacgcgcacttgtgtgccgatctggtcttgctggcctgtccttgcagatggggtacgcgagcctctgaattcgta

SEQ ID NO: 613863 - DNA, 154 bp, Homo sapiens
atcagctcggacctatttgtgtgattgcgcgtaagcagaatatttgccgtggatcgagcggcgctcactgaagcaaatgtttcagactatatgcagcatgttttagatccagaaaagtcaaaggtcattcgttatgaattacctgcgatgaatg

SEQ ID NO: 613864 - DNA, 143 bp, Homo sapiens
  misc_feature (122)..(122): n is a, c, g, or t
aattggtccgcttgctcccatgctcgtcctccagttttcagaagtctgtccagttccaagaatggctccttcctttagttcactaacattggcacttagtgggtgaagtgccgcttaccctngaagatcttgggagtctcagt

SEQ ID NO: 613865 - DNA, 373 bp, Homo sapiens
tgagtttagtgattccttccaacaaatagatgggtgtgtcactttgaggactaggtaataaaaggcattgcatcctccttactctctcttggatccttcactctagggaaagccagcagccatattgtaaggccactcaactccatggagaagacctagaagtgaggagcagaggcctccagccaaaagccatgtgagggagccatcttggaagcaattctccaggcccaaacttcagatgactgtggtcccagccaatgcattgaccacaacctcatgagagaccctgagctagaaccacctagctaagccactctcaaatatcttatctacagaaactgagatgataaatgtttgtggtttaagcaaaaaa

SEQ ID NO: 613866 - DNA, 209 bp, Homo sapiens
ccagctatacactgctataccacgtgtagattccattctttccattccgttcaagttgaatccattccattgcattacattccattcgattccattcgatttcactcgggttgattccattccattgcattccattccattccattccattccattccgttccattctattccattacattcggattgattctattggtggtatagcct

SEQ ID NO: 613867 - DNA, 560 bp, Homo sapiens
cacgcgtcgccacgcgtcgcccctgcactcaaggccacattccctcgacaacggctgcacgggctctcggcgccaagaccggcctggacctcacagcgccgagagcccctgcactcaaggccacattccctcgatcaacaggctgcacgggctgtccgggatccgaggtgtctgtccgcagactgggatgagtctactcgatgcatctccggagacctgcctgtcagatctgaggtgtctccttgactggcagagttgcgctcacgctgagggctggctgtagatgaactacatcgtctctgttgtatactttaatgttttcagataatgaggactatttcgaacgcttaagatgtgtttcattcatgaaagcgtgtagacaagctgtatttactgttctggtgttatttgatcgttgtaagttaactgaggtaagttcgggcaacagagtaggaatttacgacaaaacgtgaagctgggaagcttcccgttgagggcagtgcaggaggtgcgagttgcagactgtaggccggcatcacgtagctcgttgctcggctaat

SEQ ID NO: 613868 - DNA, 175 bp, Homo sapiens
gcggagcatatccaggcagaaaccgagctgtgtgccgaggctgatgagctccgggcccgcctgaccgccaagaagcaggaataagaagagatctgccattacctagaggccagggtggcggaggaggaggagcgctgccagcacctgcaggcggagaagaagaagatgcagcgtt

SEQ ID NO: 613869 - DNA, 553 bp, Homo sapiens
  misc_feature (77)..(77): n is a, c, g, or t
tcaccgcttatacttctaaggatcgctgtctcggattttccagtcttaattttatattttattaatctattggagtngtgcttttcccatttatagacgtgtagcagtaatgcaagaagttcttgagctgaattcctgttgtgacaacttcctataattacagtagataactttttcttttagtcgtatataacttttctatcacacttgtgcatggacaagagatatgcttcatccaataaacataagcttaaatattagatgctcttgggtcaaaatgtccttttaccaaactgacctttttatgcagtctttgggtacatcactttaaagctttttatcattttacagaatacttgtaaaagcatatccacatcttaaaccagtggtgcacatgtggatttacagctcatggactctactgttcagctttaatttataaaaccatatcacacatttaatgttatacagtatttacatatagtggaacatagggataactccagtttatgtaaatttctgtcaagtgttgtagcctgcccagagtgacttc

SEQ ID NO: 613870 - DNA, 1486 bp, Homo sapiens
  misc_feature (267)..(267): n is a, c, g, or t
  misc_feature (535)..(535): n is a, c, g, or t
  misc_feature (1154)..(1154): n is a, c, g, or t
ccataaatagttgtgtggtggctgcccctctccctccgcgctccccccaactgttgggtgggaagaagacatcccatcaagacccttgttgggggtgcttgtgtgttatcaacagtcgttggtgggcgcttcctacacacagacggggtgttgaacgattttttaatttgtggtcccccgttctggtaggagccccccccatcattggtccctccacgggctgtcccgcgcctactatttattagtggggccgctcctccgcgggcngcttaatttatgggctcgccgcccgctcgggttaaataatttttgggtggaagaatggttggggcgcacgccaccaacaaccgaccagccggggcgttatcaacaacccacgcgtcgttgggagacataatggccccacaaaagagtttttttgcgtcgtcggagagcgcttgtaagtatagggggagataatcaagagagatttgtgtgaggattctccgcctccccgcccgtcttttctgtcgggcggtgtgattataagtaaatnaagcctgtcctcggtcgatggaataagaagatgtgtgggctccccgcctcaacagaaagttgttctgctgatggaggaatagtgttctgctggtggtgtgaaataatagtctctcgtctccacaacgtgtgtgtgtagtagataatattggggaggtgtcctcctctggtgcgacacaggcccaccacactggatgtgtgtgtgttgatagaggagagcggctctctctctacagagactaatagtcgcacaccctctctgtgggggggtgtctctctgctttgttgtgctctgttgtgttcgctgatgagtagtaaagagtagagagcacacagacacacagctgtttgcgcggggtgtgggggtgtgtgtcacatctcacacacagacacactggggggagcacacacagagaagagggctctgcgctcggagagagactctgcgcgcacacagggtgtcacaccaccacagtgtctgcggtcgctcacagagaagagagtgctcacagagagagaggctgaaataaggagataatattaatgtcctctcaaataatcctcgcgcacacccacacactctctctataatcacacagtgtggtgggtagaagagaccncgggtgtctctcacagagaactctgtgttgtgtgtgttcacacattggggcgcacatctgtagaagtgtgtatagtgagagtgtaaaaggagactctggtgtaaaggagagaaccacatagcacttcgtgtaaaacctcttcacagagaaggagaaaggaagaatatgtgtttttgggagaccacaccttgggtgttttcttgttttggcgtggtgggcacagtgtttaaagtgtaataagttgtttataaatcaagagactttttaatgggaaccacttgaccccaaatttgtcaccagaattttgagaccccatttaaaaagtttaatga

SEQ ID NO: 613871 - DNA, 1052 bp, Homo sapiens
cggtaccctctccctactgtatcctacctagaagagttattagaagtgaatccagcaatattctagcagattcagtcagccaagtcaattcttagtttcacttctaaaagaataagttagaaatcccaaactgctgggcttgtcagattcttatacactgcttgtggaaggtctagggtgccctacaatatttgggccgatccacatatctctaacaccattaatatgaatcattggaaatattttacttattaacaaagtctcttgtgttaagctacagataaagcttttgtggtagtgtctgaagtgactagagtttttttcaaatgctagcagccctgaagttgtattcccaattaggatatgtcagacgttaagcaggcacccccagagtaactattatgactgattaacatatgccaaaataatttttaaaaattatatcaagtataacagaacttattaaagatttcacaggttattataccctcacactagggtggggtgaagctctttactgctctaaactcaacaacctgctgtgtagaggtgaactggcaacttatccttagtgacagcctgttcatccttaggggtgtgtgtgtgtgtgtgtgtgtgtagtgtgtgtgtgtgtgtagtgtgtgaagagagaagaaagccctgtgtcaactaactccaaggcacaacaaaaaaacactatgaagacacacacatatgaaaccaaaaacaccaccagcaaacctcgcaccaagcacgtcgaaaaactacgagaagagagcatatacaacacaaacaaaggagtacgaacctccacacaaagcaaaataccggcagagaatcgagaaaaaactatcctaaacaagcaccatacaacaacacaaaacacacaaaagcgcgataatcacacacgaagcaagcaacacaaagcagaccacagagagcccaaaatagaatcacctaaaaaaaaaaacaaataacacagcaactaaccgagactgaaataacacacccatcctagaaacgatcgaacaacacacaagaacaacacaaag

SEQ ID NO: 613872 - DNA, 441 bp, Homo sapiens
  misc_feature (148)..(148): n is a, c, g, or t
acaaatacaatctttaaaatttttttctaattctagcacttttatagaggcaggtagatctctgtgggttcaaggctagcctatactctgtatttcaaaacataacaacatttctgcactaaaaaaggtgttgtgtattgccttgccngtaattccctgtcagacagagccagcgttctgacctttcatcacctaggttggctttgtctctgaacttattgatggcatacctagctttcttatgaagggtgggaagagttaatgagtcttatgtccttgcttgccattgtatgactttagacctaagtcagatgacacttggtaagatggctttttacccccattgtggtttatgttggagaagagcgtctctgcttttttactggcagtaatcctttagtgggttaatgttatgacctgggaagtttatttagaatttag

SEQ ID NO: 613873 - DNA, 255 bp, Homo sapiens
ctggccgatctacatttattggaaagaaatcttagtggaggtatgctgggccatggagagccaatccatgatgtgttgagatttagtaaaccccattctcacccacaagaagtaaaggcagtacaaggggactcccagtggtttcctccagaccagggactgcaccaatccaaacttcgtagactctgcagatttggtaactttccaactgtattagtccattttcatgctgctgataaagacataccccagcct

SEQ ID NO: 613874 - DNA, 243 bp, Homo sapiens
  misc_feature (56)..(56): n is a, c, g, or t
ctatatctgtcagtgcaaggacttgggggtagtacccacccttcgggcttactccngaacagattttgttggcatagctttgggggggcagttttttaaaaatgggctcaaccccaaaaagcccaagttcatgcagctgtggcagagttacagttttgtggtttcatgttagttcccttatagttactgtgtaattagtgccccttaatgtatgttaccaaaaataaatatatttaccccaga

SEQ ID NO: 613875 - DNA, 1671 bp, Homo sapiens
gaattccgccaatgtattccgagcggcgataacggatacccctccagtcacgggcctgcccacctgctcctgttcggtcgtggggctgcgatggacattcggaaattctttggggctatatcaagtggaaaaaagcctgtaaatgagacagtaaagaagaatgagaagacaaaaccttcggagggaactgtcaaaggaaagaaaggagtaaaggaagccaaggttaataatccctgcaaagaggatgcctccagaccaaagcagcacaacaagaaaaagaggatcatctatgactcagattcagaatcagaggagacagtgcaagtaaaaaatgctaaaaagaaatcagaaaaattgccagtgtcttgtaaacctggtaaaatctctcggaaggatcctgttacctatatttctgagacagatgaagacgatgactttttatgtaaaaaggcagcctccaaatcaaaagagaatggagtatctacaaacagttaccttggagcatcaaacgtgaaaaagaatgaagaaaacactaagactaagagtaaaccgttatcaccaataaaactaacaccgacatcagtgcttgattattttggaactgaaagtgtccagagatctgggaagaagatggtggcgagcaaaaagaaagagtcttctcaaaccccagatgattccagattaaatgatgaggccatcgccaagcagctgcagcttgatgaagatgcagagctggagaggcagttgcatgaagatgaagaatttgcaagaacactggccttgttggatgaagaacctaagaccaaaaaggctcgaaaggactctgaagagggagaatcattttcacctgccaaagctgagttaagcaaagcagcaaagcagaagagccctgctaacgagcatttctcaattggaagaaagacctacagtcctgctaagtacggcaagggtagaggctcagaaggcaccaagcagccctgcagatcagctcaccagaaggaagcctgctcctctctcaaggccagctccaagctggctcttatgaaagcacaagaagaaaattcttacaaagaaacagaactgctggctgcaaaaagagaaagtgccattgagcccaaaggagagaaaacaactcctaggaaaacgaaaggctctccaactaaaagagagtctgtaagcccagaagattctgaaaagaatcgcaccaattatcaaagcttatcgaagctacttaaatcgagaaggtcccaaagccctgggctccaaagaaatacccaagggagctgaaaactgcttggagggcctgacgttcgtgatcaccggagtgctggagtccatcgaagcagaagaagccaagtctctaattgaacgttatggggggaaagtaacaggaaacgtgagcaagaaaaccagctacctcgtcatgggccgggacagcgggcagtccaagagtgacaaggcagcagctctgggaacaaaaatccttgatgaagacggcctgttggatctgattcgaactatgccgggcaaaaaaatccaagtcgaaatcgctgctgaggctgagatgaagaaagaaaagtccaaatcagagagagacagagagagacagagaggcagagagagacagagagaggagaaggaggaggaggaataggaggaagaggaggaggg

SEQ ID NO: 613876 - DNA, 497 bp, Homo sapiens
  misc_feature (51)..(51): n is a, c, g, or t
  misc_feature (75)..(75): n is a, c, g, or t
  misc_feature (113)..(114): n is a, c, g, or t
  misc_feature (124)..(126): n is a, c, g, or t
  misc_feature (174)..(174): n is a, c, g, or t
  misc_feature (181)..(181): n is a, c, g, or t
  misc_feature (187)..(187): n is a, c, g, or t
  misc_feature (211)..(212): n is a, c, g, or t
  misc_feature (355)..(355): n is a, c, g, or t
  misc_feature (388)..(388): n is a, c, g, or t
  misc_feature (399)..(399): n is a, c, g, or t
  misc_feature (404)..(404): n is a, c, g, or t
  misc_feature (408)..(408): n is a, c, g, or t
  misc_feature (414)..(414): n is a, c, g, or t
  misc_feature (419)..(421): n is a, c, g, or t
  misc_feature (423)..(423): n is a, c, g, or t
  misc_feature (426)..(429): n is a, c, g, or t
  misc_feature (436)..(436): n is a, c, g, or t
  misc_feature (486)..(486): n is a, c, g, or t
ggagagcccagtggtggatccagcctgaagtcctgccctctctcatctgtntggaaaggaggtagcacctttttngggaaacgggttagggagtaaagactgcaccctacatnntcctggtggnnngggggataacagtaaaggaatttgcaacgttttaatgccatgcctgantttaggntcaggngtggtgacttgggtaaccacttgnngtgggggcctgggattccctgctgtgtgccgtgataacagcaaatggtgataaggagaaagccaagacctgtggcctgatgcagggctgggggcggggggtgatcacttcagcaggcacaacacacttcactggctgcggagntggaggggtgactctgggagctcaggggcaatngatccaaagangctanggancttgtnccctnnnanacnnnntacattnactatactacctccacttccatcatatacctttccttataccccaatttnatttcctctac

SEQ ID NO: 613877 - DNA, 292 bp, Homo sapiens
gccggctcatctccgcgcgcagaggcagcgtcgcagcgagcacaccaccttcgacccctcctcctccccgtagcctgccggctcttcccgccgcctcgcttgcgagtgagacgatggcgaggccgtcgtcgtcgccgatggcgacgaggctgccgctgttgcttgtgctgctgtcgtcgctggccctgcaggcggcggcgcagaagtacaatgcggtgtacagcttcggcgactcgatcacggacacgggcaacctgtgcaccaacggccgcccctcggcgatcaccttcac

SEQ ID NO: 613878 - DNA, 779 bp, Homo sapiens
gcaattctcctgcctccgcctcccgagtagctgggatgacaggcatgtgccaccactacccgactaatttcatatatttagtagagacggggtttctccgcgtaggtcaggccgttctcaaacttctgacctcaggtgatctgcccgcctcgacctcccaatagtgctgggatgacaggcatgagccacgtgtgcccagcctgtcgactatatcttcaaattatgtctagggacagggtcttgttctgtcacccaggctggagggcagtggtacagtcatagctcactgcagtctcaaagctcctgggctcaagcgagtcctcatcaggctcagcctcccgtgtacgctggggctccagggaacagatccgcgcactgctggttaatattaggtatttttgggtagagtcagggtttcatcacatggacacaggtctggtctcaaagttcctgggctgcagtgagtcctcccgccttagcttccagagtggccaggatcacaggcgggcaccaacatgcccaggtcaatttgactcaggggtagagacgtggtctggctatgtggtccaggggggtctcaaactccgtggggtcgaactgatcgctcccagctcaactctgccatagccaggacctcaggtgtcagcaacatacccacagctaatcgtatcggttaagtagagatggggtctggcctctgtatgctcaggctggtgtgtagtaggggcacggtcatagttcacggtacccttcaacgcctgggctgaatcagttgtccg

SEQ ID NO: 613879 - DNA, 164 bp, Homo sapiens
tctctccggatctcctcctcagcatacgcagtctagtccagcggaggagcggccctcttccccctactcctggccacaattgagctgctgctaacggtctactccccaagattgagcggagtgcctcggcaccctccttgcaccgcacccaggccgatgagttg

SEQ ID NO: 613880 - DNA, 143 bp, Homo sapiens
gtgatagacagatgagaagaaggaggagtctgaagagtcagatgatgacatgggattggccttttgattaaattcctgctccccctgcaaagtaaagcctgttttacacatctcaaaaaacaacaaatacaatacaaaaaggg

SEQ ID NO: 613881 - DNA, 462 bp, Homo sapiens
gcctactactactaaattagcggccctgcgacctttgggaggctgaggcaggaagactgcctgagcccaggagtttgagatcagcctgggcaacatagcaagatcccatttctaccaaagtactgacaagcatgagacactgtgcctggcctcattttttcttgagcaactaataaatggtactgtgttctaaattttagttttcaattattcattgttatttgtggaaatatgaatgtgtgtgtgtgtttgtgtgtgtatgtgtgtttgtgcgtgtatgtgtgtgtctgtgggtatgtgtttggatatctgcaaccacaaacttgtttattaattctaaaaggtttcttttcaaactctagtgtcttcttgtttgttgattccttggagatctcctatgcagccaaccatataatctggcaacaggaagagttttatttattcctttctatctgtatatct

SEQ ID NO: 613882 - DNA, 452 bp, Homo sapiens
cttcctcaataaaaacacatatgatccagcaatcccactactgggtatatatccaaaggaaatgaaatcagtatgttgaagagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgatgaaaccccgtctctacaaaagatacaaaaattaggcaggcatcttggagggcgcctgtaatcccacctactcgggctgaagtgagaatggcttgaacccaggaagtggagatttcagtgagctgagattccgccactgcagtccagcctgagcgacaagagtgagaagagtgagacttcatctcaaaa

SEQ ID NO: 613883 - DNA, 946 bp, Homo sapiens
ctcttctcacaggaccagccactagcgcagtctcgagcgatggcctatgtgcccgcagcagggttaccagtcccacctacaagccgatgctgctcgttatctaccagcccatcgccgggcgggctcaaagtggcgaatgtctgtttacactccaacggagtggccagtcgagctagcatgaagctggttcttcgatgaactttgtggttgggcaggatccgggctcagacgtcgccttccacttcaatccgtcgcgttatgacgagctagtggacaagagtggtcttcaatgacgtagcagggcgggaagtggcgagcagcgaggagaggaagaggagcatgcccttcaaaaaagggtgccgcctttgtagctaggtcttcatagatcctggactgcagcactacaagagtggtggtaaactggaaagtcccttctatgagtacggtgcaccggtcttccctcgtacagagtggtctacccaccgtgcaatgtggatggggatctgtaaccttcaattcaattcaacttcatcggaggccagtccctccggcccctagggtacctcctgattgatgccacctttacccgtggtcccggacattgccatcaaagatgctgagacagctctgcgcaccactggataggaacccacaagctttcaaaccgtgctgtgccagtatgtcggtgaggctgccaagggagggctcacatttcgacagaaactcatcaatcattgaagcgggctatgtgccttcccaagagagcgagaagctcttgctatctagaacttcaagggtgggctaccttcagggcgaccattagactcttgctacattaaatcccacgacatgggcaacgagtaccggtggtaccaggaaccagtgctgcctgaatgggctacgatgggggactcccgaggcaaaagcaagataaccccataagcca

SEQ ID NO: 613884 - DNA, 347 bp, Homo sapiens
cgtgagcagcacgttggggggcaggacagaaggacaagagtctaacacactggaggggtggtgtgagagggagagtacatgggctcagtccacaggcagaggacaagggctggtactgaccattcccctcacaggagtgtgcgcctcaaaggccaccccagacacacaccacacatacgaagtatacaaatcctccccagcttccacaaggcaaagaattccccagcctgggaactgtggagttcttgtagccgtcaccatcgtacgccttgagtcacagagctcgtgatcagtaggagaaccgtagcgatcctgcaaggcattcatcacaccattggccagcggga

SEQ ID NO: 613885 - DNA, 332 bp, Homo sapiens
gaccggaccctcgcgacgtgtatccctcgcgaacgtgtgatccgggaagatagacaaggtagagccgagaagaatgtatattctggtgacttggggtggagagttctgtagatgtctgttaggtccgcttggtgcagagctgaattcaattcctggatatccttgttaactttctgtctcgtggatctgtctaatgttgacagtggggtgttaaagtctcccattattattgtgtgggagtctaagtctcttggtagatctctaaggacttgctttatgaatctgggctcctgtatggggtgcatatagatttaggataacaagttcgcgag

SEQ ID NO: 613886 - DNA, 667 bp, Homo sapiens
  misc_feature (33)..(33): n is a, c, g, or t
  misc_feature (63)..(63): n is a, c, g, or t
  misc_feature (66)..(66): n is a, c, g, or t
  misc_feature (73)..(74): n is a, c, g, or t
  misc_feature (82)..(82): n is a, c, g, or t
  misc_feature (84)..(84): n is a, c, g, or t
  misc_feature (94)..(94): n is a, c, g, or t
  misc_feature (96)..(96): n is a, c, g, or t
  misc_feature (106)..(106): n is a, c, g, or t
  misc_feature (126)..(126): n is a, c, g, or t
  misc_feature (131)..(132): n is a, c, g, or t
  misc_feature (139)..(139): n is a, c, g, or t
  misc_feature (146)..(146): n is a, c, g, or t
  misc_feature (149)..(149): n is a, c, g, or t
  misc_feature (159)..(159): n is a, c, g, or t
  misc_feature (172)..(172): n is a, c, g, or t
  misc_feature (176)..(176): n is a, c, g, or t
  misc_feature (183)..(183): n is a, c, g, or t
  misc_feature (185)..(185): n is a, c, g, or t
  misc_feature (188)..(188): n is a, c, g, or t
  misc_feature (197)..(197): n is a, c, g, or t
  misc_feature (202)..(202): n is a, c, g, or t
  misc_feature (209)..(209): n is a, c, g, or t
  misc_feature (212)..(213): n is a, c, g, or t
  misc_feature (215)..(215): n is a, c, g, or t
  misc_feature (219)..(219): n is a, c, g, or t
  misc_feature (231)..(231): n is a, c, g, or t
  misc_feature (238)..(238): n is a, c, g, or t
  misc_feature (250)..(250): n is a, c, g, or t
  misc_feature (256)..(257): n is a, c, g, or t
  misc_feature (284)..(284): n is a, c, g, or t
  misc_feature (286)..(286): n is a, c, g, or t
  misc_feature (309)..(309): n is a, c, g, or t
  misc_feature (315)..(315): n is a, c, g, or t
  misc_feature (339)..(339): n is a, c, g, or t
  misc_feature (344)..(344): n is a, c, g, or t
  misc_feature (349)..(349): n is a, c, g, or t
  misc_feature (389)..(389): n is a, c, g, or t
  misc_feature (403)..(403): n is a, c, g, or t
  misc_feature (418)..(418): n is a, c, g, or t
  misc_feature (433)..(433): n is a, c, g, or t
  misc_feature (461)..(461): n is a, c, g, or t
  misc_feature (484)..(484): n is a, c, g, or t
  misc_feature (509)..(509): n is a, c, g, or t
  misc_feature (561)..(561): n is a, c, g, or t
  misc_feature (585)..(585): n is a, c, g, or t
  misc_feature (589)..(589): n is a, c, g, or t
  misc_feature (663)..(663): n is a, c, g, or t
ccggagcctcacacacctataaatatctcaganccaaccagtcgcgaacagaggaagtaatanaantgcattnntaaatgtncncatgcgacangnagaggcagtnaatattagatctggtaaganacagnnggcccgnggggggntcngcggggggangccgccccaaganagcngccccancngancctgccccnatccnggccggnccnncncggnagtggccccccngtagacnccggccactccntgcctnncagccactcaccagctcaccccattcngncacctgccccagcctctcgcggngcttgncacgcctcccaccatgaagcactnccctncattnacacagaaagtcttctccttctccgcacattttacaaganggcttgtcccagtngtggatgtagatgtngaaagtctaggagcngtttggagattagtttctgttgtttgtngctgagtagctgacttgggcgtnctcacctcagggttccgggtgggtnaagggaaggatggcgcagtggacggcaagaaagaaaaggcaaaatacgattnttcggtgtgggtgccgctgagggntcanaggagagaacagctttgttaccttgcactgttacttgaacctcactttcagatttatccccagagacaggtgangtgt

SEQ ID NO: 613887 - DNA, 537 bp, Homo sapiens
aaggcctctctaattcaaggcactgtccagtgttttgcacagcattcacagctaaccatgatgtaatcacggtggcagttacctgtcctctgtgttatcacgaaaaagcattgtccaacgtagttagccgttcttgggtgaacatcaggaacagcacttcataaggtttgggttcagccagcagtgggatcattcgaccagattgaaggctaaaagacatgcgtttgtttcagcccaaaagtgattaaaaatgactgaggtttcaagtgaggaatgggaaagatcttatccgcctgtagttaaaagaaaagaagagcatgatacgtacggatcacgaggtgaggagttcaagccggatgaacatggtgaaacgccgtctttaccgaaaatacaaaaatcatccgggcatcgtgaagggtgcctgtaatcccagctgctggcaagcctgaggcaggaagattacttggtcccagcaggcgtagtttgcagtgagctttgatcatgccattacaaaacagcctgggatacatacaaaca

SEQ ID NO: 613888 - DNA, 184 bp, Homo sapiens
aggacgttgatggctcgacatgtctatgcatcagagatgtggccattaaggagcccctagatggatgtcgtggagcccaagacagctggtcaccaacgcgctgcctcatagaaggaggtggacatctatacacgtcaaggtggacagacctgtaccttcacctaccccgttctgcactgcaaga

SEQ ID NO: 613889 - DNA, 804 bp, Homo sapiens
gcaggaaccagcccgaggccaccagggctgctccctgcagtgctgggctgccgggcggcacgccactcaaccagcacccacgagcacatgcacctgcacgctggccgctgcacgacgggcttccctggcacggctggctgcgtggcctctgctgctgacgcgccggcctgctgacagatccaaccctggcccggacgccctcacctcggcaccacctgcccccttgccagcctcgcgttccactcctcgcgccgcgtgccccctggcagcctcagccggccacttgcctccgcacggctccctcaccgcgcagcgctgcccacaaccactcgcactgtttacccgccctaccaaccacgccacgggctcttcacctcatgccctgccagccactgcccctccccttcacacggcgttcactcgccccctgctgacgcctgcttggcgcgctgcgcgcaccacaagtcctgccacgcccgcgcccttcattgacctggctgcctggccttgcgcgcgcgccaggcttccccacgcgcctccccacgcaccccaaatcccctcccccttgccatcaccacaaagcaagccctgcgtgcacgaaacacgcactctcgctgcggcctccgcgtggcctgccgcgccagcccctgtgctgcggcaccgcccccatacgcaacacgcggcacgcgaacccggggcccttctccacgccgagacccgcccgttgcgcactttcattggcggccttgccacccctccaaatgccaaaacccaagcgcggtcgcacagggcctgggccccaca

SEQ ID NO: 613890 - DNA, 175 bp, Homo sapiens
aggatctttcactgctcattattagcggctgatcgattttggtgtcctgagtccaacatcgagctcgtgaaccctattgttgatatgtgactctagacatatggattgcgctgttatccctagggtaacttgttccgttggtcaggttattggatcaattgagtatagtagttcg

SEQ ID NO: 613891 - DNA, 716 bp, Homo sapiens
  misc_feature (256)..(256): n is a, c, g, or t
  misc_feature (288)..(288): n is a, c, g, or t
  misc_feature (290)..(290): n is a, c, g, or t
  misc_feature (338)..(338): n is a, c, g, or t
  misc_feature (347)..(347): n is a, c, g, or t
  misc_feature (393)..(393): n is a, c, g, or t
  misc_feature (444)..(444): n is a, c, g, or t
  misc_feature (481)..(481): n is a, c, g, or t
  misc_feature (529)..(529): n is a, c, g, or t
  misc_feature (532)..(532): n is a, c, g, or t
  misc_feature (610)..(610): n is a, c, g, or t
  misc_feature (612)..(612): n is a, c, g, or t
  misc_feature (622)..(622): n is a, c, g, or t
  misc_feature (625)..(625): n is a, c, g, or t
  misc_feature (637)..(637): n is a, c, g, or t
ggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagctcctcctgcacggcgcccgcagcaagccctactcgtgcnccgagtgcggcaaaagcttcggcgtgcgcaanancctcatcatccaccaccgcagccacaccaaagagcggccctacgaatncgctgagtncgaaaaaagcttcaacttccactcgggcctcatccgccaccaaatnacgcaccgcggcgagcggccctacaaattctcggagttcgaaaaaacctanaaccgtaaagaacaccttcagaaccacacaacggctncacacgggcgaacggcctttccaattttcacttttcggcaaaaacttnatncgcaagacagaacctgctcaaacacacaacgcatccacacggggcgagcgcccctacacgtgcggcgagtgcggcaanancttccgctanaangagtcgctcaangaccacctgcgcgtgcacagcggcggcccgggccccggcgccccacggcagctcccgccgcctcctgagcgagactagg

SEQ ID NO: 613892 - DNA, 346 bp, Homo sapiens
gccaccgatcgccgggcgcgctttgtcgggctcgaggcttatacggcggcgggcggcaccgtgctgcgcgacctctttaccgaggatcgcggcggctatctggaagacgtcgcgctgctcgatctgctggtcacggcaaggcttggccgcgaggcggatcggttgcgggcgaccgagtgctagaagtggacggagccccatctcgactttccgcacgcccacggcatgcgtcggacatacccgcatccggtcgagctgtcggcggaggatcaggccgcgcttgaggccgttcagagcgagttcgaccggctgaccgagcagcatcagacggccgaggaattgcccg

SEQ ID NO: 613893 - DNA, 167 bp, Homo sapiens
cccttacctacattgtttcaacatgccagaggctgttcacctgccagcggcgtggacacctttctcgggtgtcctacgggcgctcaggactctactccctcagcagcgtggtgaccgtgccctccagcagcttgggcacccagacctacatctgcaacgtgaatcac

SEQ ID NO: 613894 - DNA, 436 bp, Homo sapiens
tgagcagagcccgatggaagtgagaagggcgtgaaaagaacagtctcttcagtagtggtggagaaatgatatttatatgcagaagaatgaaattagaaccttatctcttgccatataaaaaaatcaaatcaaaatgtattaaaggcttaaatctaagacctctaactataaaactactaaaagaaaacattaggtaaatgcttcagggtcttggtcttggcaaatatttttctagtaataccccacaagcacagacaaccaaagcaaacatgggcaaataggatcacatcaagttaaaaaccttttgcacagcaaaagaaataatcaacaacatgaagagataactcatataatggaagaagacatttgcaggctacccatctgacaagggattaataatcagaaaatataacgagctcaaacaactctacaaaaa

SEQ ID NO: 613895 - DNA, 220 bp, Homo sapiens
  misc_feature (37)..(37): n is a, c, g, or t
  misc_feature (66)..(66): n is a, c, g, or t
  misc_feature (100)..(100): n is a, c, g, or t
  misc_feature (116)..(116): n is a, c, g, or t
  misc_feature (131)..(131): n is a, c, g, or t
  misc_feature (216)..(216): n is a, c, g, or t
taatggaacacatgatttgaatagcttttcagtatgngtgcttgtcttgattatgagttgctaggnttgctaaggaaacccaactcaatctactgttaancttggaatttattggnttatgtagggatgangtctgaggacagggttgactgcatccttaaggctctgatgctgatgatgctgcttctgagttactcacatcttcacaccttgctnggtc

SEQ ID NO: 613896 - DNA, 1056 bp, Homo sapiens
aacattcaggatggaagcttggactctgaatgctgctgagtctggtgtacaacacaaaccttcagaccccgcagggaggccggctaaccagtgaaccccaaacccagagagaaggctgtggatgctagtgacctcttatgctgtggaccctcatattgacctttcagcctctgtctgtatggaagcagtacttattagctgcctcatagtcttctgtacatcttactgggtttaattaaaaaaaaaacgaaaaaactctgtggtacacaacacagctttaacacaatacctaaactgctatacaacctagatgtactcaggtatactcaacggcaacgtagagtaactaaatctcatcctgcatgcgtaaatctagactttatataacccccattgatccctcgtgataagtatgtcaccaatatatgattataaacacgagacactgatgctggaccttcatgattaaaaagccctaccacttgggcaaggcattaggactcactgtacggtctaactctggtgatatctccacagccttaccttccccatccttcaactgtatcaagtatgtcatgtatgtccaccaatcacgttacatatggctgtagcacaattacatatctgatgcgtagcacgaacgaggagacctatcactggtattaagtcccgatctgggacatacacttatacctgctaggtgataagttggaactctctcactaacacgcagcataggccaccctgactcttacacctcaacaacagggaaacaaatataccattctatcacatcactcccacgaagacatcactaacatcgcttcacccctatagtgtaatacccacacacaacccaaagccacctacaacccgccacacacacagcgactaaccacacgcgcacacaacacgcacacacacacaacaccaaccgggcggaaccacacacaacacccacaacaccagagcacaaccacacacgaccgacgcaagacacaaacccacggaccaacaaaacaaacaagacaacggaaacacacacaccaccgcaca

SEQ ID NO: 613897 - DNA, 135 bp, Homo sapiens
agacagcttctgagagctggatacaggtgcgcacacaactggctaaatttttgtattttttagtagaggtggggtttcaccatgttggccaggctggtctcgaactcctgatcctgcccacctcccagagtgggt

SEQ ID NO: 613898 - DNA, 219 bp, Homo sapiens
gcgattcagaggatccagtggaagaagtgcttttattatattattattatacttaagttttagggtacatgtgcacaacgtgcaggttggttacatatgtatacatgtgccaggtgggtgtgctgcacccgttaactcatcatttagcgtcaggtatatctcctaaggctatccctcccccctccccgtcagatgcacattcaagcacattattccaag

SEQ ID NO: 613899 - DNA, 447 bp, Homo sapiens
tccataatgtgtcccagaggaccaaataaagaactaaaaaactaagcaggcgcagtggctcacgcctgtaatcccagcacttaggaaagctgaggcgggagatcacctgaggtcaggagttcgagaccagcctggcctacatggtgaaaccccatctctactaaaaatacaaaaattagctgggcatggtgatgggtgcccgtaatctcagctactcgggaggctgaagtaggaggatcgcttgaaccctgggggtggaggttgcagtgagcagagatcgtgccatggcacaccagtctgggtgacgagcaaagctctgtctcaaaaataaaataaataaaataagattaaaaaaatagaataaccatcttaacaattttaagtgtgcggttcagtagtgttaggtacactcacattgttgggcacacattatgtaggggtaccgag

SEQ ID NO: 613900 - DNA, 132 bp, Homo sapiens
ctaaggtggagtacagcggtgcaatcacagcgtcactgcgagctgcaaactcaaactcccaggctcaaacgtgcctccggactcagcctccagattagctgggacatgaggtgtgccccacagagagagcgt

SEQ ID NO: 613901 - DNA, 841 bp, Homo sapiens
aaacaggagaggctgggctgcgtgactgccgggttgtggatggtctgacttggacgagaatgaccccctgacccaagggtgcccctgggaacggggaagtctgcggacccccggggccgcccgggctggggggcaaaggcctccctggaccccccggagaggcaggagtgagcggcccccaggtgggatcggctccgcggcccccgggaccttctggactcccgagctcccttgtccccgcaggacctccctggagcccctggacagccaggagtcctccgctgaagggcgcctactgaccttcagtgcccaagtatctgcccgacaggtaccccagggacgcccgctggaatgccagggttcaagggagcccactggctacaagagtgcgagcaggggggaagtcggaaaggacggggagaaagggtgaccctggacccacactgggagcccgaccgggctccgggcagacgtgggcgctgaggggaccccgggggattacggagggacctggcagggacactacggggaccacctggggaccggagatcgcatatggggttccggagggaccggctgggatcccaggagcgcctggggacacgcggggtgacccgaggcgaagaggggaccgagaaaagggttccgcgggggccccaaagaggttagcgtcggggcgagcaacctaggacgcacaagggaaacccagcgggagttgaccggcaccaaagcgcaacgaggcgggcaatgccggggccaaggaacggccaaaatgccgtgcacacagagctgagtgccagaacgggggagggttggcggcagcggtgcgccgggagaaaag

SEQ ID NO: 613902 - DNA, 901 bp, Homo sapiens
  misc_feature (73)..(73): n is a, c, g, or t
  misc_feature (132)..(132): n is a, c, g, or t
  misc_feature (134)..(134): n is a, c, g, or t
  misc_feature (156)..(156): n is a, c, g, or t
  misc_feature (167)..(167): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (191)..(191): n is a, c, g, or t
  misc_feature (195)..(195): n is a, c, g, or t
  misc_feature (210)..(210): n is a, c, g, or t
  misc_feature (214)..(216): n is a, c, g, or t
  misc_feature (221)..(221): n is a, c, g, or t
  misc_feature (226)..(226): n is a, c, g, or t
  misc_feature (228)..(228): n is a, c, g, or t
  misc_feature (232)..(232): n is a, c, g, or t
  misc_feature (276)..(276): n is a, c, g, or t
  misc_feature (279)..(279): n is a, c, g, or t
  misc_feature (281)..(281): n is a, c, g, or t
  misc_feature (286)..(287): n is a, c, g, or t
  misc_feature (299)..(299): n is a, c, g, or t
  misc_feature (325)..(325): n is a, c, g, or t
  misc_feature (337)..(337): n is a, c, g, or t
  misc_feature (349)..(349): n is a, c, g, or t
  misc_feature (415)..(415): n is a, c, g, or t
  misc_feature (455)..(455): n is a, c, g, or t
  misc_feature (538)..(538): n is a, c, g, or t
  misc_feature (560)..(560): n is a, c, g, or t
  misc_feature (569)..(569): n is a, c, g, or t
  misc_feature (627)..(627): n is a, c, g, or t
  misc_feature (664)..(664): n is a, c, g, or t
  misc_feature (670)..(670): n is a, c, g, or t
  misc_feature (728)..(728): n is a, c, g, or t
  misc_feature (736)..(736): n is a, c, g, or t
  misc_feature (763)..(763): n is a, c, g, or t
  misc_feature (774)..(774): n is a, c, g, or t
  misc_feature (780)..(780): n is a, c, g, or t
  misc_feature (796)..(796): n is a, c, g, or t
  misc_feature (799)..(799): n is a, c, g, or t
  misc_feature (811)..(811): n is a, c, g, or t
  misc_feature (826)..(826): n is a, c, g, or t
  misc_feature (900)..(900): n is a, c, g, or t
tgtagaaattacttttattatgttaaaatattccttaataaactagcaattatttatgtggaggagcatccanaaaacaggttcatgactgaattatccttgtccttgattatagagattcatgaatgacananataaccctattttctggagtanctgtgaagctntacnangctntnaggttggaggcncttntccctgcctgttaanctgnnnctatnacatnangacnggatggacattatttttctcttttgaattaaatctttacaacanttngnatgcnntttccagaatgnatcagttcaaaggctttgttgatttnatcaaaagaaanattgtgagtaanaaattcatcaacttttatctttttggacaaatattcagacaccaactttgggacactttctacacncttccatcccccaaaggcagtccctttccatgtgcgaccngttaccagccggaatggacgagtgggaatttcttcacctgaagcagccactccaaccacgacgctgacgccccaccccttgtnaaaagccttaagtgctgctctnatgaacttnaaattaccaatacattcaaaggaatagtccactcctccatcggtcatctcaatgagcncttcctggatgggtttactaaaatcctgagggttaanacattnagtggctccaaactctttggcccttgcaaatttatctttattgatgttcacaccaatnatccgggnagcaccagccactttacagcccatganaactgccaatncgactnctcccagaacaaaganggnacaaacagagcnagggtccaacttggnagttttcacagcagccccataaccggttgaaatgccaaacctagaaggcagatttatccaaggtgctaaggatnt

SEQ ID NO: 613903 - DNA, 812 bp, Homo sapiens
cagtgcccaccaggtgagggggctggcctggtgggtcttgtggaaggcccctccccagtgccctaggccacctcgcggaagccttcagcctccgcccctacactgcagccccttgtggacttgatgtgtgtgggccccaggtggtgttctcatgtgaccccatcccaccaccatcccagtgcatatccactgtctccaaagagcgccattccatgtcaccctctgtctatcccatgcgccttggttggctggtggtaggctgcgtgcctgctggtgtgactacccagtttatatatgctagtgtggaaacagtgctcctgagaaatttgcacaacctgaccctcacgtgtgtgcctggccagttggctgttgcccatgggtagcccattatcctccctccttcctgccatcgttgtagcatcccctatatgtgatccatcttgagtgtgacctcaaggagagtgccggtgtccctaaactggacgggggggcgtcatcccttgcgggtgccaggacctgaacgggggtcctcggacgtgcatacgaactggacgatggtttccatgtggacttgtgcacgaagatagctgatgcagattggtaggtagtttggtaggcaagaaaccgtttaatggcctcatcaacacagccacacgttgaacccgattaccacacgaggggcctcctaggtgacccttgtgccttgggcaaacccccaagtggggcagcaggccttgcggtggggcctgaggcaccgcagcgcccgcggctcccagccgccaccgcccacatccagaccgacacacgccgac

SEQ ID NO: 613904 - DNA, 411 bp, Homo sapiens
cacagacattaaaacaacttatcaaaatttatgggatgtagtgaaatgcagctgcttagataaaatttatacattgaatgaatatctcagaacataatgatcataatcaatcacctcagagtctaccttaagaaactggaaaaagaatagcaaattaaactcctagttagcggaagaaaaaaaagtaatagaattagagcagaaatcataaaattaaaaacagaacattaatagactaactcaatgaaatccaatgcttttttttaaaaaaaagatccatacatcaataaaatcaataagcctttagccagtctaagagaaagagagagaggacacagattactcataagtgacagggggaatatcactacagttcccatagtatttaaaaggataataaaataactctac

SEQ ID NO: 613905 - DNA, 151 bp, Homo sapiens
gacggagaggactcccgggggttgacgagggctcgcaggttctgcatcacgacgagtcaaggacagccatggcgtagatggcaagcatgtggtgtgcggcaagcgttctagcagggcatggacggtggctgcggaacggtggagcagcacc

SEQ ID NO: 613906 - DNA, 434 bp, Homo sapiens
gggtggtgaaaatatcttacagttccaatctgaggttccagattgtatttttcaagaacaactaagggtggaaggaagggaggttacaatgaggatgaagaacaagtaggagtaagaaaccggcagaaggggacagaaagatggtgtcttcagagagatgtggagaggaaaatggtggcctgggaagagagaagatcataagaaatggtaaccacagtaacatgaataggaaaatgatggtataagcaaaaaacacagattcgaaaataggaaaaattattttgtaaaacaatatttatttctctcatgttgcccaagccagaatgcagtggctattcacaagcacactcacagtgcactacagtcttgaactcctggggtccagtgatcatctcacctcagccacctgagtagctgggactatatgtgcgtgc

SEQ ID NO: 613907 - DNA, 1300 bp, Homo sapiens
tgtggtcctcgtgttttttgttgtctgttgtgggtgttgttcggtgcgttgtgtggggtggttgcgctggtggtttgctgctggtgtcgtgcgatcgtggcttgtgcgtagcatgtttttgctcggtgtctacatggtctgctgtacgtgtggtggtcttatctttttttgggtcttctcagtggtcttcgtctgtgttgtaccgggtcgtgtcccagtggggtgtggcgacggcccgctctcacgttgtgggcgtatgtgtgctcgcgcattggtttttgtggggccattcttttgggggccttgtgggggtgggtcgtgtgggggtggtgcctgtctgtgttgttatcatgttgtggggttggtcccgatgtttggcctcctgcgatggtttgtatgtggccatccaggtccctgtgctatccctgcagtgggacacttggcgggccactgacagtcagtctgttcatgcagtttctccaggggcacgttttgtttcgtgtgttgccccggggtgttcattggtggtcccacgattccaggccagtgtccagcgcgtcagttgttgtctggagcctagagcccgtctgtttttgttcgacagacgggccttctagctgtttctccccagattccgagtcaccggggttgtgagtgggcaaagtggaaacgctttgtggtgacaccattgagtggcgtttattgcccccacgtgtgggtaccggttcttctgtggatttgcaatgggcctgtgatttttgaggcccacaggtggtgtcccaacacattccacactcatggggaaagcgttaactgtggtgccctccttggaactgggtgttggtggtcccatggaacattctctctcttgtgatttccaggtccagtaggcggcgcaggtatatgcctctatgatgatagatttttgagcccccatttctccagacccctcacaatcccatcctgtccctggaacaatcccatcaaggatttcccatagagggtgtactggtgccctacctccagtcttggcacccagatgcctgctcattgaggagagttactgctggcccaggccagaaagaatatgggctcttgccaatgtagaccagacctggaggggactcttccccttgagccactagccagctggaggaattgggagattcatggctatcaaggttgtgttaatcgattgtggggatgaaaagtcattgtgtatggaaagcggggctcatggctgattggccaataaaatggcggctgcccttgtcattgtttcccaaaaaagaaataaaaa

SEQ ID NO: 613908 - DNA, 129 bp, Homo sapiens
tcgataatacggtcacgctcggatccagcccgggtcatctgccaaatcgagtccaaatcaggttattttcgtgtccgtgtcatgaggtttcctgcctaaaagccgagagaaaaacgctgtgcggacgag

SEQ ID NO: 613909 - DNA, 101 bp, Homo sapiens
gcgacttatgctaacctacctaccattgcgctggagaacacagattctgctctgagctatgtggacattgccattccatgcaacaacaagggagctcactc

SEQ ID NO: 613910 - DNA, 1264 bp, Homo sapiens
  misc_feature (126)..(126): n is a, c, g, or t
  misc_feature (366)..(366): n is a, c, g, or t
  misc_feature (421)..(421): n is a, c, g, or t
  misc_feature (445)..(445): n is a, c, g, or t
  misc_feature (489)..(489): n is a, c, g, or t
  misc_feature (910)..(910): n is a, c, g, or t
gcgaacgcggagagcacgccatgaaggtcctcgggcacgctagccagaggagtacaaggtgagtgaggtcggactgcctgcaccagcccctcacaatgtcctacacgccagtcccctcataccgcnatgcgaaatcctttgcgtccatatatcactgtcgctcggccagaggtctcccgacttcatggctagctttgtaatcgtcaggtcccaatgaatgattgaagaacgtcttacaggggtggagacttgttcatatctgtgtgcgcagagtgctattgagaaagtaccgcccctcgcagagggtggtaaccataccgtatcggggggaacttcatggcctttgccgcataaattgaccctcgncctggaacagacagggaaagcgcacgaccagatcgagttcgctagccctgagganattagcccagggcgagacctagtngacaacaccgcacaggactgcatgtgtacactccgcagagttgncataaccagaatgtaacatgtgtgggagttgcgcccggggcgaaaccggacgacacccggattggcactcgaacctacgcattaatcaaagactcaattcgaaaccgggttgagaaagggacaggagtacccagcacgccggagcgaacgccgaggatgtttgaccccgccaccgggcccctgggcccctcgttttcagaacgccaagggatgtgcccaacgttaactttctccaagaagcatactacaggattccacccgtccctaggcacgcgcaaactctgcgcgctccacttcgctgtcccagctccaagggcaaccaacatgttcccaccaggcttattagaaccccaacgccataggggacgcgtctccccaaaacgaaccccttccatttgcggttatcgattgcctacgcggncccccttttcgctgtgccgcgcgttttgatttgtcgccttctatagactaagaaaacatcccatgcggaaagctgccccaccgcgcatgaaaccgaaaaaaggggcccttccccatttgcaaagcgaacatgaacgggccttgacattttaatgcgttgggctcccccccgggttgggccacacagaacttaaagtcgaaattgaacacacaaacttagtaatttccaatttccccccaagccacagcgaaaaagggccagggtatatacagaccttttcccatagtcctattgacaacaaacacgggggtcccgaaaaaaaccaagtattgcgggggggcccttgggggaaac

SEQ ID NO: 613911 - DNA, 485 bp, Homo sapiens
  misc_feature (20)..(20): n is a, c, g, or t
  misc_feature (174)..(174): n is a, c, g, or t
  misc_feature (348)..(348): n is a, c, g, or t
  misc_feature (393)..(393): n is a, c, g, or t
gaagtgctgcccggtaaganagcttaagaccattcagtggttgctgctacttattcagtggcctgagcagtgggagctgcagaccagtcttccgtggcaggctgagtgctccagtcttcagctggaaactgctgaataggcacagagggcacctgcatgcctcagaccaatctncaacctcaggccgagtagcagtgaactcgggagctggagcagtccattcaccctgaaactcctcctggtcacagtcttttcagtagcagcctgctcttctttttcaatctcttcaggatctctgtacaagcagagatcaggcatgacctcccgcaagtgttcacaggaaatggngccacgcatgtgcagaacttctcaggccagcatccaccacatcanacccaccgagtgagctccctttgtgcatgcaatggcaatgttcacatagcgcagaggggaatctgtgttacacagcgcaatggtaggcaggt

SEQ ID NO: 613912 - DNA, 507 bp, Homo sapiens
  misc_feature (313)..(313): n is a, c, g, or t
  misc_feature (413)..(416): n is a, c, g, or t
  misc_feature (418)..(418): n is a, c, g, or t
  misc_feature (420)..(420): n is a, c, g, or t
  misc_feature (423)..(423): n is a, c, g, or t
  misc_feature (425)..(425): n is a, c, g, or t
  misc_feature (434)..(434): n is a, c, g, or t
catcctctgtattagtgaatggctcagtcagaagtcttgacttacagataacagattttacattggctggcttaagcagaggagggatttgttaagggtattaggcagcttacagaattgtggggcaaactggagaactaattccaagccatagaactgatttgacctgataagaaaactgctgttactgtcactaccatcaaatgctacatgccaggatatcaactcgtctgttatacctactgccgggggcactgaaaccacttctgctattgcttgagaccaggagttcgagaccagcctgggcaaaatngtgagaccttgtctctacaaacataaaaataaaaaaatttgccagatatggcagcacatgcttgtataatcccagttactggggagctgagacaggagannnncntnaancncgggaggtngagcttgcagtgagccgagatcgcaccactgcactccagactgggagacccagtgagactaggtctcaaaaaa

SEQ ID NO: 613913 - DNA, 147 bp, Homo sapiens
attttccccattgtcagggttgcttccacagtcatacatttcttcatgtacagtcagggctgcaggcaccaggcaacacaggccatggcacatcttccccattgtcagggtttcaacacagtcaagcatcacttcatgttcagtcaa

SEQ ID NO: 613914 - DNA, 1204 bp, Homo sapiens
ggtttttggcttctgctcgcgcggctttgttttttctgtttttcgtcgccgtttttcttgtgttcctggtgtggttggtcgtggcgcgggtggttttgtccttccgttttttttttgtgtgtgtttttgtttttttctgttagttcggggttctgctttttttgttttctgttcttcttccttcttttttctttcctttcttcttgtctagtgtattcgttcgttgtgggtttctgtctgtgcttttttttcttgtctcgcgtctctcgctggtttgggtgtttgtgtgtggtgttttgttttggcgcgtcgcgcctccgccctcctcctctcccgtctcgtcgtctctccctctccgtttctggggctcttcgtgtctctcttttgttgtcgtggcttgttcgcgtcgtgcgcgccgtctcccgccgctcgcgggcgcgtccccgctcccctcgcctcgcgctcgctcgcgcctctctcttgctcgttgtttctggtgttgtctgtgtgtttgtgtgcccgcacgcgccctctctgccctctcttttttgttttcggtttgtcgcctgttctgtctctgtcgtctgtgttgtgtgtgtggtgttatatatatatatttttttcccctcctgcacgcacgcgacacgtgtagctcgcctcctcttcctctcggttgtcttctctctctctcttcttgtctctcctcctctctctcttctcctcctctctccctctctcggctcctccctccgcgctgcgcgcgcgcgtggcgtccccccccactgcctccctctctctctttttctctcttccccgcccctctcttgtcgccccgccccccccgcccccgctctcgttctgcttgtcgcgcgcgcgcctcactaatatatatatataagcaccgctctctctctcctcctctctctctctctctcttttttttttttttttttctctctctctttttactatatatataataatttataagttagaaaaaaaaaaaaaaaaataaaaaaaaaaaaaaaaaaaaaaaacaaatacaaatataaaaaaaaaaataaataataacaatatcatataataaaatataataaatacaacacatagaaataaaacaataaataaaaatataacatacccaccattacataatacaacaataaataaacataacatataaacatatacaattaacataata

SEQ ID NO: 613915 - DNA, 122 bp, Homo sapiens
  misc_feature (92)..(92): n is a, c, g, or t
  misc_feature (119)..(119): n is a, c, g, or t
tgttcaagcgattcttctgtctcagcctcccgagtagttaggattacaggcgcgcactaccacgcctggctaattttactgtatgtaggagngacagcgtaacaacgtgttaacgagtntct

SEQ ID NO: 613916 - DNA, 374 bp, Homo sapiens
cttgattgactaaacagcaagaacttattctttttcatctactgataaaaggaagagaataatactttaagaagagctcaagctccagctggtatcagagaagtcagtagaggtcactgagaccggcagtctttcttgctctttggattagtgccctcagctggaactgtttacgggacagaagacgtaacatgcttcaggaagacatccaggtctatcacgcccccttctcaaggcttctcccaagtaaaagatagtgtcttcaatagcgtatactactgcataacagattcaggatctgtttgactaagggagctgtgggaatgataacttcatcgatatcattgttttccgactgatattccattttttca

SEQ ID NO: 613917 - DNA, 198 bp, Homo sapiens
ggtaccgtccttgctcctcgttacttctctgtcgcgttttagtttcccttatctataatcttatttgactggcaaatcatggaaaaatgtagtgcaatttggctcagagcttctgtgtttctaccctttctgaactagtgttctccatttcttcagggccaggctctctcctgcgtttagaagcttgggtaccgagct

SEQ ID NO: 613918 - DNA, 1007 bp, Homo sapiens
  misc_feature (217)..(217): n is a, c, g, or t
  misc_feature (348)..(348): n is a, c, g, or t
cacccccgccccccctgttttttttgtatccacaccggcgcgctcaacacaccatattgttataatacaacatcatattagcacccccccgtgtattatggtgtagtgctccattatacaccacatcatcacaccacgcagtatgtttttatagtagtgtgcaacaccagcatcttatatataggagatcatcttctcgagaatgaggattagcccncacacacaggtggtgttgtggtacgcaccacactaagtatagcgacacacggcgcgttgtgtgtagtataagacacgcgccgcgcgcggcgccacacgtgtgagacgtcatatgtgacgcccggtgtctcntcataacagggtggtaacgtcgcgagggcgctcttctgcggtgtgggcggacgaattttttcctggggcacacgcagagagccccaccgtgttgtgtcatctgtcctctgtggtctctgtgatgagagtgtgttgttctgcttctcataagagggtgatgataaatcacactgctgtgtgtgtgagagagatatagtagtgtctctctgggtgtctccgtctcgtccacagagagcctcccgcgcgcgcgccctcgttggtctcccaacactgtccgctctcggagagaaatgtgtagagagagaatatacacacaggagctcttctctctgcgttcacacactcgcccccggacgcggagaaatgagagatatccacacaaatctctgttctacacagagttcacacagagaaaataaaagggagacacacacggtggagaagtgttataaagtgttcagagagcacgcacagataccctcttgaacaccccctcggtgtcacttcacctcgagcacacaagaagaaaggcacagagagagaaactgagaacccgtgtccctcgcccccccgtttgtgcacctgtaaagaactgtaaatgtaaccccaccaccctgattgtgaactgttattatatttaaataccttaaaatcccaaa

SEQ ID NO: 613919 - DNA, 176 bp, Homo sapiens
agatgacctggaatgtggagattgccaactaccggaagctgctggagggagaggagagccggatcaccatctccccatccagacctactctgacctcaacttccgagaaaacagccctgcagcaacaggggttctgcgcgtcccataccaagcacagacggtgctgatcaatgacc

SEQ ID NO: 613920 - DNA, 524 bp, Homo sapiens
tggagagggggtctcacaggcggtccaggcgggtttcgaactccggaccccgaggcccgcctcagcctcccagagggcggggattacgggtgtgagccaccaggcccggcctttttatttaaatccaattggacaaggttggccttacaaagggtctaaatacctcaattaaggttaaggtaactatcaaggtggcaaggtagctcagtttaaatctaccgtcttactctttttttttaaaattattttttctggcttttctctggtccggccttcttcggaattaagtggtgtggtgactttatctccacttttcacttattgggctacagggtttttttcttatggtgggctctaaggtttacagtatatacatagctcacttacggtgatctacttggaccattagtctactagggatcacttcacatatagtacaagaaccttagaataatacactttaagttccactcccactcttagtagtatttggggcataacatttgaagggtacatgtatcata

SEQ ID NO: 613921 - DNA, 439 bp, Homo sapiens
gtgtgatgacaaatgacatgacaagatgctcaacatcgggaggttgaggcaggagaatcacttgaatctgaaaggcagaggtagcagtgaactgagatgtgccactgtactccagcctgggcgacaaagtgagactctgtctgaaaaaaaaaaaaaagttcatggaggaaaaaaaattttaaaagttttcaaagaaaggtctctctcttttctcccctctcttctcccctccccttcctttcattttcagaaaaaagggagaaattggtgcatataataagatgaaaccaaacacacttctaaaaatcggcttagatcctttcttaaaaaaaatctgtggaatattttcagggccttggcaaaatatagtataatcagggaatacctaagaaaaataaactggtgggcaagtaaatgatacagatgacagggattttct

SEQ ID NO: 613922 - DNA, 979 bp, Homo sapiens
agcggattcttccggtggagatggttgcggccgtggcggggatgctgctaggtgcgagtatccctgtcgcccgaagcgtggaccggtctgccttaccctcgcatacgtgtcctgacttagtggcgtcctggggtctgtataggcctggcattcgatacgtcgtgggattgccacgttgcaagcttggctagcaaagctctagattgagcctcgttgtactttgagaatacttatccacctccacgtagagactcaagccttagttcaccacatctagtttgctcttagcccatacttcgcctcacagtagcccccgccgcaccaaggagggcaggcataagagcacatcgagtcaaaggctttgcttcactgcacagtggggagaaatacgccagtcagcttattctctacggaacgaaccgggaagattgactaatcgccgtcactcgccagtagagtggttgagcttccttgaggctcgctagaaggtgaccgatacgcttgtcattactagcgagcaccgctaacgtctttgccggaaaaactagcgaaaagaatcggcttgagtggacatcgtggtctttgccacgcgagaggcaagggctcacctagaagagggcctcccattcactttgggaatgtgaacttcctacattgtatcgcataaactccctcgctggtccccccttctattgtggttgggtggacaaccaaatcgaaattgactggtcatgggatcaagtagaacacgtacgacacccatacgagttccaaacggaatggactcgtgctcaatcggggaattccctttcaaaagggaagccttgtttggcccaatttcccctgtggccgactggttttagtgcttgggctagccaatttgtatttgacataccaatttccatacgaggaccaggggtagagggcctttttatttccaaattcgttacctttccaaatgcctaccccccagcacttg

SEQ ID NO: 613923 - DNA, 773 bp, Homo sapiens
ggcgggacaacccagtcttacgacacgcccgacgccggcgcctccttctcccgccacttcgccgccaacttcctggacgtcttcggcgaggaggtgcgccgcgtgctggtggctgggccgacgactcgtgggcgctggccgtgagcgcagaggccatggagccggagctcgcggacacctctgcactcaaggctggctgccctacggccactcgcggagctcggaggacgtgtccacgcacgcgtgcaccaaggccccgcgttcgcaaagggcttctcgctgccgcaacatgagcctgtgccgtggtggaccgcgcgtgctgcagacagtgtgtgcacctgtgctgcgcctctgccccgagccccgacgcggcatgcttgccccgtgcaccgtccgagcccccgcgacaatgtggactgcggtgcctgagcgctgtccgcggaacgctggcttgcaaggtggagctggtggacacttcaacgcgagggggcgctgcgcttcctggtgtgcgacgacgcggccgcggtgctccgggggctcggctcagtggcagacgttgccgcccttgctctgcgccggggctgtggccgacggaacgcttccgctggaagttctccgtgcgcccaaagcctcagggcccaaggtcaggattcccacctggtcagcactccttgaggtccgcaaccaccatgccccctggaaattgcagagaaggataacacatttcgtcctcacaggtagagaatgggagcgaatacatcttggagagcacg

SEQ ID NO: 613924 - DNA, 489 bp, Homo sapiens
gaatctgcctgcagcttgaccttgaacttcccagcctccagaactctgaggaataaatttctgttatgtgaccgaaaaaaaaaaaaaaaaaaaaaaaaaaaacaatatgtgtgcggggcgcgcgcgcccgcggcggccccgcgagaaaaacgttttcttaaaaaccaatctcggttggggcgcgcgcggggcgcccagagagggtaagtgggacacatggggccaataacgcgggctcccaaaggaaaacccggggccaaggacaaggtggcgggggtttctctcaacaacataaaaaaagcgcgcgcgggggggggaacccgcggagcgctgttcctgagaaccaaaattttccaaagagggggagcgtccgaggagacgaccactaaagcggggggttgctaaacaacaacaacgggggaaggccccaaagggagaaccgcccagaattattcaaaattaacggcccgcggccgcggggaaaaaagg

SEQ ID NO: 613925 - DNA, 849 bp, Homo sapiens
  misc_feature (75)..(75): n is a, c, g, or t
ccggtgccatcgactactgcaaatccaaagcgtcaaccttcgccttcatggagagcctgaccctggggctgctgnactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgatttcctttgttcaaatcttccgtgggcagttgggagggagccagtcccaaccataaa

SEQ ID NO: 613926 - DNA, 789 bp, Homo sapiens
  misc_feature (1)..(1): n is a, c, g, or t
  misc_feature (124)..(124): n is a, c, g, or t
  misc_feature (143)..(152): n is a, c, g, or t
  misc_feature (221)..(221): n is a, c, g, or t
  misc_feature (286)..(286): n is a, c, g, or t
  misc_feature (296)..(296): n is a, c, g, or t
  misc_feature (341)..(341): n is a, c, g, or t
  misc_feature (364)..(364): n is a, c, g, or t
  misc_feature (381)..(383): n is a, c, g, or t
  misc_feature (390)..(390): n is a, c, g, or t
  misc_feature (402)..(404): n is a, c, g, or t
  misc_feature (411)..(411): n is a, c, g, or t
  misc_feature (413)..(413): n is a, c, g, or t
  misc_feature (585)..(585): n is a, c, g, or t
  misc_feature (604)..(604): n is a, c, g, or t
  misc_feature (613)..(613): n is a, c, g, or t
  misc_feature (626)..(626): n is a, c, g, or t
  misc_feature (664)..(664): n is a, c, g, or t
  misc_feature (787)..(787): n is a, c, g, or t
nccaacaccccccagcttggttgcccttaatctctcttgttgtcatggaaggctcattttgttgtttccttctgaagaagcaggattttggtgtagatacatatttttcattacaaatgcagtnggtagaccataacctatannnnnnnnnnctgtatgaatttgagaagagcattttctgagctctagagacgaagctgagttttaacaatgcagttctnatggtatcacatctattaatgcctcattaggagggacagatatgaaaaaagtttagaggtaattnaccctttgtnctaccttggtactataacaaaccaaagaggatgataatatttgtnttaactgtgttccttctttgatngcctactttaaaatccnnncttggcnatctccagcttnnnaaatttncntttcttataagttaagttagataaataacttttctatgtttatgttatatactccctctgttttcctagaccttgattcacatgaattacatgatttacatactttgcatgatagccaagttatagtttttattaattatattaattcctcaaggacacaggaaccactatnatgattcatgataattgtnatacaactngagggacattggnagacattatgccttactcatttatttcttaaaggagtnattagaggtaaattttagctaaatatgagatagaaaatgtgcattaacacaaaaatttgcctcttcccttttcagtttttgtttagattaaaacagaatcttttatattctcttagagcagcngc

SEQ ID NO: 613927 - DNA, 1233 bp, Homo sapiens
tgggagtcccctgtctgcgttgagggttgttgtttctccctcccgggggggggtgcgtgtttgtttgtggtggctgtgtcgtcgacgcatctttggtgttggcaccccgttgtggggtgtgctccctgtcgtggctcttccttctttgttgggagttgtggtgtgatgggttggtggtcttctcccccgtgctcttatctctccctgtggtgtgtttgtggttgcatgcgatcacaaaacgcgccgcacgtgtggtggtttggtgttggggggcccacaaagaaggtggttgtgctgtcacacgcggctcactcttctcttctgtcggtggagataatatgtgtggggcgtcgcgcgggggcttagggatccttgtggttgcccgcgccttgttgtatgttttctgtcccgcgagcgtcccctgtctccacgtcgcgcacctcgcgtggtatactacactcgggggtgtgttctcgcggaggtccgcaccgctatgtttttctcttctgtgggcgacacccactccccgggggggggaggacccctcgtggagggagtggtgggcgcccgctgtgattactcctcggtgttgcctcccccctctctctctcagagagagagatagagtgtgtgcacccctccctctccctcacacgcgctccccccacaccacgcagggtgttgcccccccccgcgatagtgtggggcgcccacacgcttgttgtaccccacagtttttctcccgcagcgtgtaatctcgaaggggaggacaagagacacaacagttccacactgcctctatctatatagggcgccctccagagccgcgttttgttttctttaagagaacgcggcgctcttagatacaaagcgcatctctcgggggatcacaccacacacttgttcttttctctctgtgtgtttggtgtggaggccccccccccccgaaagagccccccccggggttggcgcgccgaagtattcccacaagagatttttttttggcgccccggtggagagggcgcccccgagaggcggggagagccacccccgggcccccccccccgggtgtttgtgttttttgtgctgtgccccccctctcccccctctctccctcggggggcgagagtgtcccccctcctctcggggggcccctctcccccctctgtttctctctccgagaaagggttttttttttggtggggttttaataaacatttccccccgtctcca

SEQ ID NO: 613928 - DNA, 1017 bp, Homo sapiens
  misc_feature (918)..(919): n is a, c, g, or t
  misc_feature (925)..(925): n is a, c, g, or t
  misc_feature (932)..(932): n is a, c, g, or t
  misc_feature (934)..(934): n is a, c, g, or t
  misc_feature (936)..(936): n is a, c, g, or t
  misc_feature (942)..(942): n is a, c, g, or t
  misc_feature (954)..(954): n is a, c, g, or t
  misc_feature (956)..(956): n is a, c, g, or t
gaaaaatgtttagacgggctcacatcaccccaataaacaaaataaggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacacggcgtacctcctcagtatattcaaaggacttattaacctanntttttngggaagntncnggtggntggaggctgggnanaaaaaaggggggaaacaggagaaagccatttaagcaaaggtaaaagggaaagaaaagatga

SEQ ID NO: 613929 - DNA, 502 bp, Homo sapiens
agatcatgccgctccgagtaccagcctggtcctcactcaattgctatctagctgagtgccacagtggaacgacaacattagatctcatgaaaaccagaatggaaccactttcacttcataaactcatttataaaagtgcccatgatgaatagcaagaagtaccctgtggcccatctcattgaacaaaacttggaaagccaagggtggggcatcgtgcagctctcccataatctgagtattggtgatcctgtgtagcccacaacttcaaacatcttcttatatatttgctgtgggctctcggcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgca

SEQ ID NO: 613930 - DNA, 830 bp, Homo sapiens
gactccaaatgggtcgcagtcgcagccgttgctccacggaggaaacgtaggcgttcccggctccacatcccgggggagagagaagcgcaggcgcccgagaaaggtccaggtctcggcgagagagatcggagaaggagccgttcaggaatcccggcactgaaaacggttcccggatcgtccgaagacgacatagatcccacatcgtccttccccgttcttcgatggaaagaaggaagagatgagggaaatgtagaagaatcaataagaagcaaaaggagcaaaagaaagggcaagattactgaggaaagagtttagagcggcaaaacaggaggaacgaagatagagaatgatgacacgttacatgggatttagcctgccttgtgattccacaaaaaggtaagaaggcggatggttctgtaaatgcctatgccataaaatgtctctcagaagaggaagtaccaggcagtacatgatgtcgaaagggtggattcaaaagacccttgtggattttccattgggcatgaggaattggacaggttgttccgaaaggatgatttttttttttcccctcatctgtggtccagaggaggtgcctttgtaattgtatttaacttttgcattttcaaaaacacaggatctccagttctccttttctgtacaagtacagaaaatcttattatgactatatgccagttaactttacctgtggcttcaacagaaggaaggttcactattacattttttcttttacggaaatatcattgggggcagggggtaaacccattatttggccttattcctgggaagccggatatgttcttccggaggca

SEQ ID NO: 613931 - DNA, 1016 bp, Homo sapiens
  misc_feature (917)..(918): n is a, c, g, or t
  misc_feature (924)..(924): n is a, c, g, or t
  misc_feature (931)..(931): n is a, c, g, or t
  misc_feature (933)..(933): n is a, c, g, or t
  misc_feature (935)..(935): n is a, c, g, or t
  misc_feature (941)..(941): n is a, c, g, or t
  misc_feature (953)..(953): n is a, c, g, or t
  misc_feature (955)..(955): n is a, c, g, or t
gtacgctggtccacagcataaactattccagcataaactattataggttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacacggcgtacctcctcagtatattcaaaggacttattaacctanntttttngggaagntncnggtggntggaggctgggnanaaaaaaggggggaaacaggagaaagccatttaagcaaaggtaaaagggaaagaaaagatga

SEQ ID NO: 613932 - DNA, 1300 bp, Homo sapiens
  misc_feature (934)..(934): n is a, c, g, or t
  misc_feature (943)..(943): n is a, c, g, or t
  misc_feature (949)..(949): n is a, c, g, or t
  misc_feature (981)..(981): n is a, c, g, or t
  misc_feature (984)..(984): n is a, c, g, or t
  misc_feature (990)..(990): n is a, c, g, or t
  misc_feature (994)..(994): n is a, c, g, or t
  misc_feature (1088)..(1088): n is a, c, g, or t
  misc_feature (1104)..(1104): n is a, c, g, or t
  misc_feature (1125)..(1125): n is a, c, g, or t
  misc_feature (1147)..(1147): n is a, c, g, or t
  misc_feature (1186)..(1186): n is a, c, g, or t
  misc_feature (1192)..(1192): n is a, c, g, or t
  misc_feature (1200)..(1200): n is a, c, g, or t
  misc_feature (1223)..(1223): n is a, c, g, or t
  misc_feature (1226)..(1226): n is a, c, g, or t
  misc_feature (1245)..(1245): n is a, c, g, or t
  misc_feature (1269)..(1269): n is a, c, g, or t
gaaaaatgtttagacgggctcacatcaccccaataaacaaaataaggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 613933 - DNA, 136 bp, Homo sapiens
acgctgtgaggagaggctgcgctgtgcaggcatcgggaggcaggaggctgggcttatcgaggctgcaggggcacaaaagtcaaaagcggggttgggaaggcgcgggaggcatgagctgggctgggccgaaagaggc

SEQ ID NO: 613934 - DNA, 289 bp, Homo sapiens
agaaggatacaccagattatcgttatatgtggaatctaaaaagtcaaactcatagaaacagtagaagggcagttaccaaaggcagggacgtggggttaggatgggggctgtggacgtacacaatttcagttaggagagataggttcaatacatctgttgtatttcatggtgactatagttcatgatatatggtgtacttgcaaatggctaagagtagattttaagtgttcttaccacaaaaaataagcatgtgaagtaatgcatgtgtccagcagcttgagatacgcga

SEQ ID NO: 613935 - DNA, 1023 bp, Homo sapiens
gaaaaatgtttagacgggctcacatcaccccaataaacaaaataaggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacactcgccggctccctccttatgttttcttcaagggtcattaactgaaacctcttcgcttttcttttgggggggtcatggtgcttccttggttagtgtcctgggacagtggcctggggctgatcaaaatatttacagttaaaaaaaaaa

SEQ ID NO: 613936 - DNA, 524 bp, Homo sapiens
  misc_feature (18)..(18): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (81)..(81): n is a, c, g, or t
  misc_feature (83)..(84): n is a, c, g, or t
  misc_feature (99)..(99): n is a, c, g, or t
  misc_feature (107)..(107): n is a, c, g, or t
  misc_feature (112)..(114): n is a, c, g, or t
  misc_feature (116)..(116): n is a, c, g, or t
  misc_feature (123)..(123): n is a, c, g, or t
  misc_feature (125)..(129): n is a, c, g, or t
  misc_feature (133)..(134): n is a, c, g, or t
  misc_feature (136)..(137): n is a, c, g, or t
  misc_feature (145)..(145): n is a, c, g, or t
  misc_feature (149)..(149): n is a, c, g, or t
  misc_feature (165)..(165): n is a, c, g, or t
  misc_feature (173)..(173): n is a, c, g, or t
  misc_feature (201)..(202): n is a, c, g, or t
  misc_feature (210)..(210): n is a, c, g, or t
  misc_feature (267)..(267): n is a, c, g, or t
  misc_feature (376)..(376): n is a, c, g, or t
  misc_feature (418)..(418): n is a, c, g, or t
aagacaaacgcacccccnccaccacctgcccatcatgtcactgcactgaatacggtaggcaactntnacanaanggtattngnntctaaacacagaaangggatagnaaaannngngtattanannnnnaggnnannggaaaaanaaanggggtctgtaattgancaaaaaancattatgtagtgcatgaatattaaaatnntgcaaaanaaacccctgtatccatagtgtttaaaccataaaaccaatacctggtatatacatganaaaacaaagcatgtaaaataatatgcagcctaaagaattcaaagacaacaaaggtgacaaagtcaggtaaaagaaaggcaattagggacataagatattttttaaagcnggaagctgatgatgtccactgtaagcctggaagaaaccaggngtttgaacacggagcagttactgataggaaggataaagtgctacatctctaacagcaagcaaattaactctgctgaaattgccagaatgaaggccaaggtggtttt

SEQ ID NO: 613937 - DNA, 1818 bp, Homo sapiens
  misc_feature (75)..(75): n is a, c, g, or t
  misc_feature (1452)..(1452): n is a, c, g, or t
  misc_feature (1461)..(1461): n is a, c, g, or t
  misc_feature (1467)..(1467): n is a, c, g, or t
  misc_feature (1499)..(1499): n is a, c, g, or t
  misc_feature (1502)..(1502): n is a, c, g, or t
  misc_feature (1508)..(1508): n is a, c, g, or t
  misc_feature (1512)..(1512): n is a, c, g, or t
  misc_feature (1606)..(1606): n is a, c, g, or t
  misc_feature (1622)..(1622): n is a, c, g, or t
  misc_feature (1643)..(1643): n is a, c, g, or t
  misc_feature (1665)..(1665): n is a, c, g, or t
  misc_feature (1704)..(1704): n is a, c, g, or t
  misc_feature (1710)..(1710): n is a, c, g, or t
  misc_feature (1718)..(1718): n is a, c, g, or t
  misc_feature (1741)..(1741): n is a, c, g, or t
  misc_feature (1744)..(1744): n is a, c, g, or t
  misc_feature (1763)..(1763): n is a, c, g, or t
  misc_feature (1787)..(1787): n is a, c, g, or t
ccggtgccatcgactactgcaaatccaaagcgtcaaccttcgccttcatggagagcctgaccctggggctgctgnactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 613938 - DNA, 1382 bp, Homo sapiens
  misc_feature (1016)..(1016): n is a, c, g, or t
  misc_feature (1025)..(1025): n is a, c, g, or t
  misc_feature (1031)..(1031): n is a, c, g, or t
  misc_feature (1063)..(1063): n is a, c, g, or t
  misc_feature (1066)..(1066): n is a, c, g, or t
  misc_feature (1072)..(1072): n is a, c, g, or t
  misc_feature (1076)..(1076): n is a, c, g, or t
  misc_feature (1170)..(1170): n is a, c, g, or t
  misc_feature (1186)..(1186): n is a, c, g, or t
  misc_feature (1207)..(1207): n is a, c, g, or t
  misc_feature (1229)..(1229): n is a, c, g, or t
  misc_feature (1268)..(1268): n is a, c, g, or t
  misc_feature (1274)..(1274): n is a, c, g, or t
  misc_feature (1282)..(1282): n is a, c, g, or t
  misc_feature (1305)..(1305): n is a, c, g, or t
  misc_feature (1308)..(1308): n is a, c, g, or t
  misc_feature (1327)..(1327): n is a, c, g, or t
  misc_feature (1351)..(1351): n is a, c, g, or t
gaaaaatgtttagacgggctcacatcaccccaataaacaaaataaggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctgaggtttagggctaagcatagtggggtatctaatcccactatgcttagcctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 613939 - DNA, 851 bp, Homo sapiens
tgcccacagaagcctctaaatcccctgtaaatgtaactgttagtccaagagaggaacagctctttggacactaggaaaaaacgtgtagagagagtaaaaaatttaacacccgatagtaggcctgaaaagcagcaccaattaagaaagcgttcaagctcaagcacccactacctaaaaaatcccaaacatataactgaactcctcacacccaagtggaccaagtctatcaccctatagaagaactaagtgttagtataagtaacgagtgaggaaacattctcctccgcataagcctggctgtcagattaaaacactgaactgacacacttaacagcgccaactatctacacagtgccagagccaacaagtcgattattaccctcacgtgtcagcccaacacaggcagtgctcatataccggaaaggttagaaagaagtaacaaggaactcggcaaatcttaccccgcctgtttaccagagaacatcacctctagcatcaccagtattagaggcaccgcctgcccagtgacacatgtctaacggccgcggtaccctaaccgtgcaaaggtagcataatcacttgtgccttaaatagggacctgtatgaatcggctccacgagggtcccacgccgtctcttactttctacaccagtgaaagtggacctgcccgtgaagaggcgggcatgactccactctcagaccgagaagaccctatgggagctttctgtattactgccacagtaccctacaaccgccaggtcctaactaccaactgctaaaaatcccgtgggcgactcgacaaaccactccagcagcatgcagctcccacccagcactgttctatgtcctag

SEQ ID NO: 613940 - DNA, 634 bp, Homo sapiens
gaaaaatgtttagacgggctcacatcaccccaataaacaaaataaggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagcccagagcctacagacagcatgattgcagatcgtctttagaagatcactacgagccacaatcttaaaggttaatgaggatgacgatgactataaggatatagactgatcaagtatgaagtctatggataatacacgcagcacc

SEQ ID NO: 613941 - DNA, 498 bp, Homo sapiens
gaaaaatgtttagacgggctcacatcaccccaataaacaaaataaggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacagcgtggagcacacaggtagagatgagacacagtggcgacgagctgatattt

SEQ ID NO: 613942 - DNA, 529 bp, Homo sapiens
gtacgctggtccacagcataaactattccagcataaactattataggttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactcagtggacacaaatagactcgaagtgcttacatatctgacacacatagcttagccaactggattatatacccactatgctagccctacctcacagtaatcacaacgctcgccagacctgaccgcctggatcctgta

SEQ ID NO: 613943 - DNA, 472 bp, Homo sapiens
  misc_feature (385)..(385): n is a, c, g, or t
  misc_feature (392)..(392): n is a, c, g, or t
  misc_feature (416)..(416): n is a, c, g, or t
  misc_feature (446)..(446): n is a, c, g, or t
ctgttgacagacaatattggctaagctggagtgcagatggcacaatctcaacccactgcaagctccagctcccaggtttatatttttctcatgcctcagcctcccaagaagctgggactacaggcatgtgccccaagaggccagttaagttttctttttccttttttcttttttcttggttgagacggattttcgctcgtcacccacactggagtgcaatggcgcgatctcggcccactgtaacctccgactcccgggtccaagcgattctcccgactcagcctcccgagcagccgggactagaggcacccgtcaccacgcccgctacctttggcattcctagtagagacggagttccaccacgctggtcaggctgatctcaaanccccggnctcaagtgactcacctgccttggnctcccaaagtgctggaatcacagtgccggnctatctttgccatattggtctgcaca

SEQ ID NO: 613944 - DNA, 241 bp, Homo sapiens
attccagacgtacacacttacagtaccatgcatatatgtatgtatgtagagttgggctctcaccgtattgccaaactggtctcaaacctctggcttatgcaatctgccacctgggcctcctaaagtgctgggccgtgggccactgtgcctggccttctgtaatttattcactgattgattgattgattgagatggagtcttgctctgtcatccaggttggagtgcaatagagcgatctcgg

SEQ ID NO: 613945 - DNA, 167 bp, Homo sapiens
ccgacagcacagagaaggaggaagcacaaccttgtgtctgctgtgacccgctgttccatgctagacctgtgtttcctccccagctcatctttctcgtcccagagaggtggggctggatgtctccatctctgtctcaactatgtgcagtgagctgcaacttcttacct

SEQ ID NO: 613946 - DNA, 164 bp, Homo sapiens
tcacttgctcctatgtatcccttccttcctagctatactcctgtatgtttactatcagaacaatatcttcgccgcgtgtggtgtctcacgcctgtattcccgcttcttgggtcgctgatgcgggcatatcatcgcacgtcgggagttcgtgacccgcctgtgtc

SEQ ID NO: 613947 - DNA, 1290 bp, Homo sapiens
ggctgcacatcatggacctctggatcttgtcctgtttctccagcagtgggtggtgtctgaaacgcttcccgggaggctcctgcatgggcagctctgacgagtgacactgagtggtggcgtgatgcgtccccactggtctttggctggcgtgatcatcccgaaacgaagggttatcgtgtggagccaggttaccacaacagtgacgtgtcatgttcgtatcaacgtggagcgcgaggcggtgtgcggttcgctggtacagagtacttgcgtatcaccaatgaggagtacgctgtcggcgttcagacaagcgacagatgggcggaggtaccagggcgggtgacgggaggcgtaggaggctcggcactagctgcgctgaggtactggaaaccacgcgcagaacggacactcgctgtgaagcaagacgcgctcgcggcgcggcaggctggacgaccgtacgtgcgaggactacaacctagggggttcgtggaggatgcttcaccagtgttgcacgccagggctgatgtcgtaattctctagaggggtgatcgtgtgtaatcactggccgacaaggagcccattggaccctttgttatggcaccagaaatgcgtgccctcggggtccttgtctcctggttggacgatcggtatgcgtgagtgcccatgtgccaagccaattgggcgcaaggtccatggggtcgggtatcgcgcgggaaaaccgggcgccaggcgcagacggaaagaaaaaagcacgtgtggcggggttagcgttggtgcccgaaccgagggggcgccgtttagaatttctcggagggaaaatcggggtaaggctatccgtcggggtaaaacgcccgttgttgcccaaaggtggagctccaccacttgcggcgttgggacgtggggcggttggaggaacaaggatagacgcaaaggaggtgtgtgcgacacattcccgggggcaagaacatggtgtttcacagaaaagggcggggggtgtgaacgccaaaacccccccaagttggtcctcccaccaccacagggatgtgaggagcagagcgcagccgattaggcagcaacaagaaggcgtcccccggtgggggggaggaacagggaaacaaacgaccaccggcggagtgccaccacaacacaacacgacggggtttagggagcgggaaaagaaacgcttcgcgcgggggacaggtgaagggggccaaccatccggcggcgcaacaccctttgtcgaagagaggtttccacataaggcccccaccccgaagggaaaaaggaaacgag

SEQ ID NO: 613948 - DNA, 1291 bp, Homo sapiens
gacgcttttctcattctgtcaacacccacacgacctataggcacaatgaagtgagtaacctttattttcccttactttattctctcttcaggctcaggcttcattcccagggagtggtagtaatcagtcgcagcatgccaccacaagcagttgcaggtatgctccatcaggtattcacagcatatagggcagcaagcaaacattatcaaacagccatagcgtgttgcatatgcccttatgctccagctcatcttccaagacccgctggtcccatacgtctgcaagccctctatgctcacacacattacagttagcactgcaagtaaccgtaggcaattttagcctacaacaccatgttgctagctggatggaaggtcaaagcttgagacacattggtgcactacaatacacctctcgatacgccatttacacaggaagaaccaacatacaactggcacacaagagacgccacaacagtcattccggatgcaccaaccccataaagagatgcacacacctgcgccgtggaactgggcagagaagcccaacacccccacggaccaaccgtggacgcaggcacccactggcaactgcctagtcattggcaaacccacaacaccgaggtcgcccaacaccccccagaaaaccatccaacccgacacctatgggcagaacagcagccacgaaagaccaggaaagagtgacatgggaggcaccgcaggcaaaataaacagatgaagacaaggacgacgcaagaccaaatcaaaggacacacgcaagtaccattaaaactcagtggcaaaagagggacgacgcaaacggaaaaggtgcacgtacaccatgggaaatagagcccccggggaaacagcacccgagtcacctgagatgcactaaagaaaagccacatcacaaggctaggcaagaagaacaaaccggcaaagggagacccaacgccagccacgaacagaaccgccagggcgtgcccctgtaaggcccacaaggcatacgacatgacaaaatcgaggagaatgacacggggcacagcacgaccgaaccggccaaaaaacgaagacaacaacaaagagagacacacacaacccgcgaccaataagggaacacacagaaagcagtacgaaggcgccatgagcagaaatacacgaccaggcacaccgagagaaccacaccaccaaaactgaagaaagagaaaaaaagacacacacgaaccgcaacacgcgatagaccacacaagccaccgagagcaaggacaaaaggacaaacacaagcgcaccac

SEQ ID NO: 613949 - DNA, 366 bp, Homo sapiens
ttcagagggcgagatgtcgcatcagcggaaacctggatttggttctgacctgtggggctgagaaggggtgcccggaagtgatcgtgggactgaccggaagcgagccttggaggggaaagagagagcgagacatgcggagtgaggcggcagctagcctgcccagtggctgtcccgtggactgacacctgcgcccccgtgtgcaagcaggatcatttggtgccaacactcattcagcattcccgattaactaggatgaatttaagactgtgctcccatgtgttctcaagtggtagtttaaaaagtggattcttaaagtgcctttcaattgtctgtgaacgtataaaggactgatctgtctcattttga

SEQ ID NO: 613950 - DNA, 387 bp, Homo sapiens
ggcgcctcagggtcagcgtattgagcaggtggcgatctgtacgcagagctggacaccaataacactctgtcactcaagttggaaccacggcacagatgtcggatccttatctgataaagaggaatggctgtagtatggctacctactggcacgagaagggcggctagaggatgtagagaaccttggatgccgcctttacaatatctctgaccagcatgcagcaccgtgggtggtttctggctgtcaccagcttctcatcagcaaacgctcatcccgggccctctcatttcaggcagccaaggccattcagctgaacagtaatagagttcaggctctgctcacttcaagggagcagcacttcaggcaacaataggccgcatccaaagc

SEQ ID NO: 613951 - DNA, 338 bp, Homo sapiens
acgacgccgtgagcttcccatagcctgcccgctatgtccgagatagtgcgcagctgcatccaccaggtcgaggtcccgggagcaggcggcgatcagccggagctcttatcggcggccccatagggcgcgccgtgcaggcaggcttaggtcccgttcaacagcgtcagcagctcctacgagcacaagcgcctctagtgttcaggccgccgtgcgcgtgagcacgcgcctgccgcgcgcaggcccaaggcgccccccggcgcggcccgcgcgccccccggccagcccgccgaacccgacgctccgcgctcgtccccgggccccggagcgcgcgaggaggg

SEQ ID NO: 613952 - DNA, 321 bp, Homo sapiens
  misc_feature (9)..(9): n is a, c, g, or t
  misc_feature (25)..(25): n is a, c, g, or t
  misc_feature (99)..(99): n is a, c, g, or t
  misc_feature (110)..(110): n is a, c, g, or t
  misc_feature (120)..(120): n is a, c, g, or t
  misc_feature (166)..(166): n is a, c, g, or t
  misc_feature (275)..(275): n is a, c, g, or t
gcaagtgcntacctaccaccatctngcagcttagcctgccttaatgtgctcaaacccttacattagcctacacttgggcaatcatctaactaaacctanttttattattnatttattatntatttatttttgaatcagagtcttgctctgtcgcccagctggagtncatggcgcgatctcggctcaccacaacttccgctctgggttcagcgattctcctgcctctgctgtatcccgacatttgggatgccgggtgggaggatcgcttgagtccngaagttcgagatcagcctgggcaacatggggagacctcgtctctcc

SEQ ID NO: 613953 - DNA, 136 bp, Homo sapiens
gcgggcagggactgggacaggtttcagtcctaaaagcacttgagctacacacagagggaccaacactcaggaggcataggttaagagcacagggggggattcatttaaaagagatcaggagggtaatctaggtcag

SEQ ID NO: 613954 - DNA, 396 bp, Homo sapiens
gtctaaatgctagtattttattcagcaaaaatgcatctgaattcataagtgatctataagttctttagtttttgttttattaaaacaggtccataaaaatctgttttatcggtattttagaaaaatgatcttttggattcatacagattcaatgtatcctttccatgtctgatgtttttcatatattcccatttccataatttagggttttatttaaaaatctcttttgaaaacagtgtgatttcattctgtgtatacatttatgcaaagttagatgtattgtatgtctaatgcacacaaactgaagctgtactaaaatacatcaagggtaaattttcttgctacttttttatttcttattttttgctttactacacaataccttagaaaggcaaa

SEQ ID NO: 613955 - DNA, 213 bp, Homo sapiens
attcggctcggtaccctcttcctacgggtactaagatgtttcacttccccgcgttaccacccacacccctatacattcagggcagggccaccggacactactccggacattccaggtttccccattcggacacccccggatcacagctcgctcaccaactccccagggcttatcgcaggtcacaacgtccttcatcggctcttggtgccaagg

SEQ ID NO: 613956 - DNA, 895 bp, Homo sapiens
tatatcagggcctatttaggagatacttctgaggcctaaggagttttgccaagcagttccttgagcgccgtgccaaacagaaagccaaccagcagcgtcagcagacagcacgctgctgtagctgcagcagaagccggcacagaagtccgtcaccagagccataaacagcgggactctgtgtgcgggatgaaccacagtacactccattcagtatttcagaccaatcaagagcaacaaccaaaaatccaatttctgaggctgtgcaagagtggcacacgaagaagacaaaacgcagaagatggtccgagcagatcccagtttataaggatctccagtcaagtgcatcatcggagcgcactcaaccatgggtgacactcgagacgtggatgactacttgagcaccctgccagtggactgggcatcccctctcctgtgtgccgacctatggagtctccaccttgtaccagcaaaacttacctcaccatttactctttatcactctgcaacaaatcacagaacccgatcatctacaggcttttcttctggcccttttgtgtccagattctttaatccatttcgtcggtgaacgatctcagactatagataacgtgcgcttggacccctgtggtctttgagagcgttgcaaggggcgattactcccccaagcaggggttgtttttacgcacgcttgtgtcccttgtgcttgttctgtcatctacttgctcccagaacagtgtggtgggaccggccatagcagtggtttgcttggccctggccctcgaattgggtcttctcgtttgccccctcgggcatgctcatggggcccggcgcgacgttaccccttgggattataccctgttggccgcccaggacctcggagtcgcccttaataacg

SEQ ID NO: 613957 - DNA, 456 bp, Homo sapiens
  misc_feature (224)..(224): n is a, c, g, or t
aagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtnaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtccacctgactttaatgaggaaaataaaaatgaatattgaaa

SEQ ID NO: 613958 - DNA, 135 bp, Homo sapiens
ggctgtaggctatgctttaggatctcgtcgtgcagaatttagacgcgttccaggcgggtgtcaatgagcgtggggacggctataagctgcctcttgtccttgatctcgttggacgctacccatgtcttgattggg

SEQ ID NO: 613959 - DNA, 309 bp, Homo sapiens
aggatcccccgctcggtcggggcccaacatgatgagcgaaccaaggagcagataccgaaacgatgctctaatgcgatttatgaccgaaacgaaacccaccgtggaactccttcccgtaaagggagaggtgagaccgaaagaactccagccgcggcattctattggagctgactctgtgccagccaacacagaaaacgaagtagagcctcgagatgcccgccctgcatgacgacagaggaccgaccactcaaccaggatcggggatgacagatatcacgacggaggagatggctgaggtaaacatgtatg

SEQ ID NO: 613960 - DNA, 356 bp, Homo sapiens
  misc_feature (51)..(51): n is a, c, g, or t
  misc_feature (61)..(61): n is a, c, g, or t
  misc_feature (79)..(79): n is a, c, g, or t
  misc_feature (111)..(112): n is a, c, g, or t
  misc_feature (164)..(164): n is a, c, g, or t
  misc_feature (166)..(166): n is a, c, g, or t
  misc_feature (179)..(179): n is a, c, g, or t
  misc_feature (186)..(186): n is a, c, g, or t
  misc_feature (274)..(274): n is a, c, g, or t
  misc_feature (291)..(291): n is a, c, g, or t
  misc_feature (304)..(304): n is a, c, g, or t
ctgaagcagtagagcagcccgtagttcttgagcagtgcgtaatggttgtcntgagtttgtnttagacttgctgtaggtntgcttgacggatctgcccagtgcggcggctgnngtcttccagcctcccgcatcagcgtttggatgccttcctctaggtcctttangnggtgatagtgatngctgttngaggtgttatagacctaggttgttggcgaacatactcctgaggtaatcgcacgggctccagccacgatcgatgagcaggcggcggggngcggtgcgcctggtttngttttctgtggtnttttccgtcttgttggagggtggtgggggtgatatgttaataaggaaaaagg

SEQ ID NO: 613961 - DNA, 333 bp, Homo sapiens
  misc_feature (56)..(56): n is a, c, g, or t
ggtccccagtttgcccaaaaaggccaggaggggaaatgattttatccctaaaaccngcccccccccttttttaacggggggggaagaacggtttcaaaactgtttgtttcaattggccctttaagtttggtagtaaaagcctggtttatggtaccaatgcctggttaaaccttcaaaaggaaaggagaatgttttgtgggcccctttggttttttttttgggggggggccgtttttagtttttagtttttaaaaacgggcctttttaatgggaaccacttggcccaaaatttgttccaggatttttgggcccctttaaaaaggttaatgggga

SEQ ID NO: 613962 - DNA, 2798 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613963 - DNA, 2707 bp, Homo sapiens
agcgggaaacaaaagaggacagcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613964 - DNA, 166 bp, Homo sapiens
agtcatggactgtggaatgtgaggggagtgggtcgctccaccagattccagcaccggtggccagtgcagctcagagccctttggcggactacaggagctgcacagacggtcactcaaagaaagatgtgcctgtgccctactccttggcgatggcaaagggcttctc

SEQ ID NO: 613965 - DNA, 349 bp, Homo sapiens
gcttttcttttcctcttgtgcctagttaagtggtaatgtgatggagataggggaaatcacataacttgtacaagtatggggtaattgcttaaacatgccttggggaagtctgatagcgtctctgcacgggacctctgacaaaggccattccaggagacggggttaagctatttcccacactctcctgttaacactggagtcttgcaagacccagaggagaacccactttctttttccagagaggctccacagattaggaaatgtgtgtatttagtgaaaaatagggttgtagtgaaatagttactatttcatgaaagtagagattttttagagtttttgaaataccaca

SEQ ID NO: 613966 - DNA, 2708 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613967 - DNA, 746 bp, Homo sapiens
gtcagagcgaccttccctctaaaagcattttatagcgttaaatataaagagagcacacccaacgctcgcagccacaaacggcaagaaactcactctggacatcctgctgcttctcccgctactgatcgtctagctccctatagaccttctagaagctcttattcctaatcaggatataatgaagcacccgtgaaagcatgctgattacagtagctgcccatggaatggagagacagactccctatgaactctttaaacacaaaagaaagcgtgctctctagcatataaataagcatggaacggaggaaacacgctccaaatgcatggtactgggtaccaagaatcatacctttgcggtggactgcgagaaccgacaagatattaacggctctggcaacacgctgaaggcagaaacttgggacgctccaaatttagtacataaagctggcgtaacctatacatcagatatgtatgctacacaagatcctcagatcagaaagactatggaagtgtgtgtactcgctcatacttggactacccaggccttctttgctgtgatgacgaggaataaccatgctcacattgtacatgccgattagtacgatgaacatgtttcgtgtcactacttactgagtaactgcacaacaagatagcggttgttgtgtccataaaaatttgacagagtcactgttttgcttacaataactggctacaacgtgcatgtgctctttagcacacgttgcttt

SEQ ID NO: 613968 - DNA, 147 bp, Homo sapiens
tctttccctgaaagctaggtcctcggggctaaacacaaccgcctctcagctctagaattgggtgattttcatcatggcccttaaccggaccaaataatttcttaaatcggctctccctctgtgcggggagaccggcttttacggggt

SEQ ID NO: 613969 - DNA, 2759 bp, Homo sapiens
tattcatcccgggctggtctttaattgttaattacctggccctcggctctacagatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613970 - DNA, 298 bp, Homo sapiens
cagtcggtaggaaacgttgatgagcatgaggtactccattgtggtgtcctctttatatcattgagcagtggttcgtagttctccttgaagaggtccttcacatcccttgtgagggggattcctaggtattttattctctttgaagcaattgtgaatgggagtcactcagtatttggctctctgtttgttattgttgtataggaatgcttgtgatttttgcacattgattttgtatcctgagactttgctgaagttgcggatcagcttaaggagattttgggctcagtcgaacggactg

SEQ ID NO: 613971 - DNA, 3476 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacatgttaaatgccaagagttaattaccaaaaaaaaaaaaaaaaaaaacaaaaaaaaaaaaaaaaacaaaaagaaaacaaaaaaaaaaaagagagagaggggggcggggcccccagaaagagaaattccccgcgggggggcccccgccctgggcggcgcccccccgcttgttttgggcaacaaaaggagggccccccaaaaataggggggacggctatacattaataaacgcagaaggaggcggcgccgagagtattaaacacaagaccgcagcaagagggggggaaaaaccgcgcgtcacacgcgggcaatcctcgcgggaggagggaggaccacccaatatcagcgcggagggggagaagccaaccaccgggggggagcacacaacagcacccctcaccgaaaggagtaatatgagaagcgccccacgcgcacgggcagacacaatcaacaacagcaacctccagagccgcggctcacaacagggcggtgggacacaacacacagcggaaaataccactcccgcggcctcactaaaaagcaattagtgcgcccacccccgggcgtagaaattagttttggcacagacaaagtatatgtacaaccgggggggccgggagtaagtagatagtaatcgggcgcagccacaaccagacatgaagcccaggccgcaccagcgcgcagcgccaaggactaaacaccaaaacgaacgacgaacgcccgtacggcgcagaccgacgcaccagcaccacac

SEQ ID NO: 613972 - DNA, 2684 bp, Homo sapiens
  misc_feature (34)..(35): n is a, c, g, or t
aactatacgggctaggtacgaggctgggtggtgnncaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613973 - DNA, 475 bp, Homo sapiens
ccagtccattagtttcgactccattgcattcgagtgcattccattccgtggctgtccattccattccgtttgatgccattccatacgattccattcaattcgagaccattctattcctgtccattccttgtggttcgattccatttcactctagtccattccattccattcaattccattcgactctattccgttccattcaattccattccattcgattccatttttttcgagaaccttccattacactcccttccattccagtgcattccattccagtctcttcagttcgattccattccattcgtttcgattcctttccattccagcccattccattccattccattcctttcctttccgtttcattagattccattgcattcgattccattcaattcaattccgtgctattccatttgattcatttccatttaattccattccattagattccattccgtacgattccatt

SEQ ID NO: 613974 - DNA, 299 bp, Homo sapiens
gtcctccaatatcttactttgagctatgtcacatgcatcacctcctcagaatgtctgcctgctcttcgcctgactggtcttcccagtgaacctcatctgcgcttctgtatttaccaccacacagctaggttagatgtcctgtctccttatatatcagtacatactgtgtatagccgtgttaaaattcttggcacagggaagtctaatggctgatttaaattctgtgtcatccctttagaagcatgtagagagcagtagatatgttataatacatcatcgtgttcatagatctcagggcc

SEQ ID NO: 613975 - DNA, 2966 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613976 - DNA, 110 bp, Homo sapiens
atgatactctgggagtacacaagggtactgctattattactaatcaaatcttcaagtatatataactttgatagagtatccaataattaccttcccatataaatatgtgt

SEQ ID NO: 613977 - DNA, 2932 bp, Homo sapiens
ttgctcctggtagtacgtagatagtgcgtcgtgcttacaagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613978 - DNA, 462 bp, Homo sapiens
ccttttataggtgggcgggcggaggtctcgctctgtcaccaggctggagtgcagtggcaccatctcaactcactgcaaccttcgcctctagagttcaagtgattcccctgcctcagcctcccaagtagctgggattacagatgcctgccaccaggaccgatttttttttttttttggtattttaagtaaaaacagggtttcgccatatgggccaggctgttctcgaactcctgacctcaggtgatctgcctgcctcggcctcccaaagtgctcccaacggattacaggagtgagccactgaacccagccttaaatctcttcaagtgtgaaccaagcaaaagcttgataattgtccctcatcgcaactgtcggctctcttatccacaggtacaggtaatacacctcttccaaatcaaatggctatataacacagccaactaaatccattccctgacatacgtc

SEQ ID NO: 613979 - DNA, 765 bp, Homo sapiens
taaaggggcgcagcattggtcttaattttcccccaggcgattaagggcagcagcagggccctgaaaattagcaagcagcagcagcagcgaggtggtgcaggaaggagtggagggaaaggacaccaagtttgggggagagggaagggacccttctatcggccttagaggggagaggaaaaccctgaaggtggggccctccccagtcccgtcttcggggcacagatcccaccatgtctggctcaccagtacgggtccccagtcaaagcagaggggtgtgcactgggggttggactggtagtacagccctcaagcaccgggcctccaggctggcaggaatatgagccagtgtctccacattggctcgtgcctcagttgtaacaattggtaaacatagggcactacctagaatacggggtacatttggtggtggtgagtaagaggggaccgcaaaaggccctgggctaagggaaaacgcagccggtcactatgggggtggacgaggtgtcagacttgttggcagtgggctttcacggggggtacagaagcagagagattcccaggggcctcagaagggacggggagcggccggagattttgacacaggccaaggaaagaggcctttcaaacactgtgggcacaacaggtcaggccctgcccccaaggggaaacatcccccataaacaccgggatacaggactctttcaaaagagatatagtccaattccctaaatccccaaaaaaccaaaggccaagtggacaggggtc

SEQ ID NO: 613980 - DNA, 2713 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgagggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613981 - DNA, 341 bp, Homo sapiens
taccaaatgaaaatcgctttaatttaatcgctttggtttggtattttggcaacaaaaacccccgtgttccagaagttcagaactgtgtgtagcttgaactgtggttcagaactgtggaagacaagtggcacgccaggctgtgtgtggagcggccacccccctgtgtgtcgtcccctctctctctctgtgtgggccaaagacggggccccccaaacaccccccagagggtgacacaccagagtgtctcccgaaggcagagtgcccacagctctccactgtgcgcaccggctgtgggccccacccacaccaaacttataaggccgaatcacgagggtctccaa

SEQ ID NO: 613982 - DNA, 2766 bp, Homo sapiens
actagttctagcggacgcgtgggtcgacccacgcgtcgcgcccctcgcgggccccctagatctctgcctcagcccccctgtttttgcacccaccgccggctgcaggctccgctgctgcgctgcacccgggctccctattcccaccccacctcctgctcagaggcccagagatttaatttctttccccccgtgtgctttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 613983 - DNA, 203 bp, Homo sapiens
gcgactaatcaccaccaacaatgactaatcaaactaacctcaaacaaatgataaccatacacaacactataggacgagcctgatctctatactagtatcctcaatcatatttattaccacaactaacctcctcggactcctgctcactcatttacaccaaccacccaactatctataaacctagcatggcatccccttatgag

SEQ ID NO: 613984 - DNA, 231 bp, Homo sapiens
cccaataaatgcaaggcacttgattggtcttgaaaccatccctcccggaccccaatccatggaaaaattgtgttccgcgaaaccggtctctggtgccaaaaaggttggggcccgcttttggaaaagctggaaaaggcaagttaacgcattttcccccctccgtttgaaaggcccatcccccattgtcctcctatccctcaacccgggcatcattacggggttttcttttta

SEQ ID NO: 613985 - DNA, 386 bp, Homo sapiens
caaaatttttcccttaaagaaaaaaaatcccatgaaccatttgaactgatgagccccagaacttcagttgaaatttttttccctttttagcaggctaaaaaaacatctgggtttaaatgttctgtttaaggccccttcataaattcaagccccccccctggtcagttttgtgtgatagaataaaaaaatgttccccccagggtaaggaccgccccctgtaaatttcttttccttaaggggcccagtaaatgtccaaatagttatagccccctgttttgtaagggaggccctttttaatctattattcctaccccattaaaactgtttgcagaaaaaaaagaatttttctaataatctgtaaaattatgctaacttccccaagtggg

SEQ ID NO: 613986 - DNA, 527 bp, Homo sapiens
gaagattgaggtctttctgttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacgaacggtttagcaccacccgctcagtgctgttctcctgatattgagtcctcatcccatctggttgcttcaaagtgtgtggtgcctcccctctatctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataag

SEQ ID NO: 613987 - DNA, 3112 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 613988 - DNA, 326 bp, Homo sapiens
ggcaacttccacctccggggtccaaatgattctccggcctcagcctcccaagtagcggggataacagaggcccgcccccacgccaagctaatttccgtactttaagaagagagggggtacctccaggtgggccaggcgggtctcgaactccggacctggagtgatccaccaacccaagcctcccagagggcggggatcacaggctggagtcaccgggccgggggctgggtttccttataatctccataatgctgggcggtgcctaccttggtaattggtagataagggaaggtgtccaccgggacttggatgatgtccttacctcg

SEQ ID NO: 613989 - DNA, 542 bp, Homo sapiens
ttggttgatcgatgccgctggtgtttatcgatgccatcggtgtaattgatgccacgggtgttatcgatgccactggtgtatatacgatgccacgtgcatgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggcatcgataaacaccggtgtgtatcgatgccaccgtattgtgcttccaggtgccccagaagga

SEQ ID NO: 613990 - DNA, 692 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacaggtaggaatttttcaggactttattagaaataaaatactatgtgagactgtgttataatgaaagagaagaaatattataacagaatccagaatctatatgcaaactgctttctcaagttggtacaaagtattttaaatatgaaggaactaacatttatgaggggatagtttgtaggagaaactgtcctgggtatgttatatacaatatttaaatataacaactctgacttaggtagtattagctcttttttgaaattgagaaaactgatggtattatagaatcacttgctaaagtatttaatcgttagttttccattcagtgaatactctatcttaagaatgatatcgttaaactttatttttctcccagatgcccaatataatgatacacagataaatctttcactcagccatatagattatatcagcggac

SEQ ID NO: 613991 - DNA, 295 bp, Homo sapiens
gaataatcacccgatatgtagtaggagttgggataactgcttggacaaaaatggacatatataaattccagattgtactgaaatacctttaacatccagcaggtggaagcactgagtaacaataccatactaggtcatctaacagaaacataaatccattctgcacaaatcaagaattctgatacactccatgccttgatgattacttcaacagacatccagtgatgctgtcattaataatgaagcaacaacgcacaaacaactcaaacagtgatttaatctctgagtatacaga

SEQ ID NO: 613992 - DNA, 3110 bp, Homo sapiens
  misc_feature (8)..(8): n is a, c, g, or t
  misc_feature (11)..(11): n is a, c, g, or t
  misc_feature (32)..(32): n is a, c, g, or t
aagaatgnatntgctagtacgaggcgggtgtnaattcggccgaggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 613993 - DNA, 897 bp, Homo sapiens
tagggagccgggacctttagacctttcgttacgtcgctaactgtcggtaaacctatatgcggaacgcctggcaggccagagcttccttgggaagatttctacaaccccccagattgcttggtggcgtctcactgcggttcgtgactgaggcccctaggaggtgtcgcctgtccaatcgggccacgtatggcctgcctcgcaccttttcgcccttggggacctcggtggtggcacgcacgatcggcatctaggccaaccttagttccttcccccgtggactacagcattctggggaccctggcaaggtaatccttgacgccactgctcctatgatagcgaaacctacggtgtcacggcggtcccttgaatggaagctcggcttccagtccatccgcacacgtgaatgactgaagttttgcccaagacctctccggtgcatgtccctgggccgcgcgacgcctttcattccctctcctcgcagcctctgtggtgcaagcctgtctatgggagacacgcgtgccatcactgctgactggagggtccatgaacggtgatcccacggcgaacactggccactaggcataccagtattccttcccagagctaaggggctgccttaaaggaaattgtagcctaagtaggtcactggcaagggcctgaggcctgttcctgcacaggcttccaggttaggcactagtgaataggctcagctcctctagagagactgaagccatctggcttctctagattccatctcccagtcctcgtttcccattgttctgttgcatccaccttaatgtctccaaggcctgtaatctcatcaccgttgggacacttaatcatttcaactccttgtaagatttcccggtttggtttctcatacatgtctcgcagtaa

SEQ ID NO: 613994 - DNA, 188 bp, Homo sapiens
gtgaaagacggcgacttcgccctgcgaattatgccctcgtgagatcggcgacaacgctctgctcagtttggatactcggcgtgtgcaacgccgaggcaccataccgaaatcgccgatcttcacgcgtgaagatcggcgactacggtctggaccttcggcgtgtgcagtgtggactctcggcgtgtgca

SEQ ID NO: 613995 - DNA, 3055 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 613996 - DNA, 3058 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 613997 - DNA, 2326 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 613998 - DNA, 866 bp, Homo sapiens
gtttacttaacagctgtagcgcttgagtttttgagcattaaaaaacgccactgcgcagttttccccacgggtaccccaagatgttattcctggccgagacctatatctgtggaggcccgccccttcatctgcccgccggcctgtgggaacgccgaaagtggctgcattttcactaactaaggcgtaaagcgttccccgcttccggtcacaagaactggcctctccaattcacagcggacttcactatgctcacgcacaaaccgccgccatatgggaccgttctatcccgaagagtatttatgtgaatctcctgccccgggacttgcgcggatatcttagaaagccccctccccaaccttgtagccccccccttagggctttacccctaagagcagttcagagtttggggccccggcaaaaccactagtattaaagggtacggaaagaatgtgtgttcacctcctctgtgaaagattcttttatatgtaaaaacgccgttcccaaaaataaagacgggtttgccaggcaagaaaaaaggatgacacagatggtagggcctacccgcaaccggcatgaaatgatgagtaaaaaaagcccgcatacccccgatgggcagtaaataagaacaccaacacaaataccggcccgctgttaccactcagcaccagaatgataacccaagcaggtattaccacacggcagggaaccacccaaaaaggtcaacagagatcatgtagggcccacaaaaaaccgcccccacgcgggaagtcaaaccaacaaattgggttaacaccaacgccccccgggaaaaaaaaagatccccagggggggtatttttaaaaaaacgtaagaaaaatccacaaaaa

SEQ ID NO: 613999 - DNA, 3051 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 614000 - DNA, 3183 bp, Homo sapiens
  misc_feature (2239)..(2239): n is a, c, g, or t
  misc_feature (2266)..(2266): n is a, c, g, or t
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttttggggccccaaacnttggggccctttttttccccccccccntttttttttttgtggggggggggaaaaaaacaatttggccttaaaactaattggcttggaaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 614001 - DNA, 3388 bp, Homo sapiens
gatctggctcccggaagttccacgtcagtcagtctgacggtcagtggatcggtgggtttatctcaaggcctgagtagccggtaacaaacgagggttcccgggattggaccgacgcagccatggtaggtccagatcccgtagaagggagcggggtcccataggttacggccgattcctggagcttctggactgagggccgcgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 614002 - DNA, 1342 bp, Homo sapiens
  misc_feature (151)..(151): n is a, c, g, or t
  misc_feature (1145)..(1145): n is a, c, g, or t
atgacgattcatgcgcatgcctttatcatatcgtaataagctcatcgcacatgcaccgccttaacatggggcgctgtttcgatgcctcctcgcgtgaatgtatcatccgagccgtaggcccagtgctgactgttcgattgtctaaggtctnattaacgggtcactcatcatgtaggccattatgtaacgcattaaaacttaccgatgatacactaatggatgggaagctgcatcgtggaacggccgaggtaaaagcaactcatacgcgtaagggcccacacaagcaacaactcgaggcttccgtcctccaaaggcgcatgtgctaataacggaggcataagtcgcataagtttgattgacacatcgtcgaagaagttgattgaacgatacgactgatgatctatgtcgtagaacccatgtgttccagtccaattaccccatgcacgaaaaggaaccacgtgaaacgaaacgagcttgacttgcaagaggcatcagggaaacaaagaaaggaagggtcaagtttttccccccgacatcaaaaataaccacgggttacgacacgtttcgccaccatcacgtaaagacccacaagttaaaaggccaatgcttaggttcgaccttcttccaggggcagcaataatactggggctaccacacaacgatgaaaaggcaatccctcgccaccataaggaacaagttaaccatacggcgttataacaaagcccgaaggccggaaaaaatggggcaagggattttaacacgtagccaaaccgtgagcactagcaggcacaacgtgtgaacgccaccatactatcccacggggggcggcaacatgtgcaaatttggggtataaaggcccaatacagttccagtgggggttaaacgcaacaagggaggtttggccattggcccgaaagtgctcaccaacggccgataatcgagggcgggaggccaaaacacggacaaccttggggcaatacgacaacagtgggccataacgggaaacacgggaaaaggaacagcgataggacacactgaacaggaagacgcgtaagcggaaattcgagaatgcaatatgatggacatccgcaatgtgcgcaaatttgcaacgggaatagcaggaaattcttatcgcaacgtggcgnaaccgtaacgacgacatgtgcattggtgaatttcaccaccgccacttgaacaactatattttgttataccgcagccttaattcagtaaattttacccaagcgccaaagttcaagacatgttgtgtgggcttctccttggacacgtcccggcagggactgtgtaagtgtaacgtgaatgaaatggtttgtgatacgga

SEQ ID NO: 614003 - DNA, 360 bp, Homo sapiens
gagggttcccgggcattaattacactcacaatgttttacaaccatcaccactatccatttccagagccttttttaaaaatcatcccaaacagaaacttgggacccgttacacaatcattccccatttccactccccccagcctttgggaacctttggactactttttgttttgatgaatttgcctattttagttccctcatagaagcagaatcagaccatcccttgcccttttgcattgggcttatttcacttagcatgatgttttccacccttatccggggtgtagaatgggtcagaattttattccctttttttaagttaaaaaaaatttatccttatgacctggcagtcccatgaga

SEQ ID NO: 614004 - DNA, 251 bp, Homo sapiens
cccttggccccttaggctaatcctggttttatgtgaagtcagccattaagtgttccccctaaaactggcctaagccccttattaatttttaattagggaaggtaggggagaatctaccccttttttaatgcccaaaatctatatatgttttctgaagccctttttttgaagtaaccccccatgtggtcccccccccgttcccccgttaaccaatgacttttttagtgtaataaaatgtttttcctctttta

SEQ ID NO: 614005 - DNA, 106 bp, Homo sapiens
gtagcgctgtaccgcagcgtggcttgctgggccccctttgtctccagtcttgctcagctgccatcactcaggatttcaatggtgcccctgtatgcttgcttgctgg

SEQ ID NO: 614006 - DNA, 231 bp, Homo sapiens
ttcttctctccagaacactaggcaccatctgatctcctatgccttttccttattgtcagatactgaactctcagatacagttccccttcctccctccagggggcgccatggaacgcagggccctcactggccctggggactgggtgacgtcaggggtgagcctctggtgattggctccctcaccctgcgtaagatcaaagggcctaaaagtcagccccgacacccggagcc

SEQ ID NO: 614007 - DNA, 107 bp, Homo sapiens
tactgaaattacaggcgtgagccaccacatccagccttggctgattggtggttctaatggtttatggttgggtagttttataatagctcatgacagtttccggctcg

SEQ ID NO: 614008 - DNA, 144 bp, Homo sapiens
ccctggtctgaacttagtacctgatgaaggtgacagaatgcattctttctctccacttgcttgcaggaagaggaactgcaggatgacatttgcactaccagttagcatctgtgtggacacagacgatgccagggaacaccgtgg

SEQ ID NO: 614009 - DNA, 431 bp, Homo sapiens
  misc_feature (4)..(4): n is a, c, g, or t
  misc_feature (48)..(48): n is a, c, g, or t
  misc_feature (158)..(158): n is a, c, g, or t
aaanttgaaggcttcccccttttaaaaatgaaagggggacgttttgtnaaaaaaacattgtcaatttccctaagtgccccctttattcaaatttttttttcccccctaaactccttcttaaggctctttaaaagataaatcttggccccagccgtggntggtcacgccctgtaatccccagcactttgggaggctgaggtgggtggatcacgaggtcaggaaatccgtagccatccctggctaacacgatgaaaccccgtctctactaaaaatacaaaaaattagccaggcctggtggcgggcatctgtagtcccagctactggggaggctgaggcaggagaatggtgtcccgggaggcagagcttgcagtgagtcgagatcacgccactgcactccagcctgggcgacagagcgagactccctctcagat

SEQ ID NO: 614010 - DNA, 266 bp, Homo sapiens
  misc_feature (33)..(33): n is a, c, g, or t
  misc_feature (225)..(225): n is a, c, g, or t
tggttgataggtaaaaaaatacaattgataganggagtaagttctaatattggatagtatgtaagagaaattgtagttaacaataatttattgtgtatttcaaaataactagaagagaagaattgcaatgttcccaacataaagaaaagataaatgttttagatgatggatatccccattaccctgatttgatcattgtatatcacacacatgtatcaaagtatnacatgtactccaaatgtttgtacaactatgatatatcaata

SEQ ID NO: 614011 - DNA, 879 bp, Homo sapiens
  misc_feature (510)..(510): n is a, c, g, or t
gactactccatgacagacggtctttggaatccaccatgtctacatccatgctcctcgtgaaggcagatgttgatgaactgtgatgatgaactgttacactctcgcgtgatcatcctggagggctctgtggtggccgtgggattctgcccatgacatgatcctacgtgtccgacccataagcaggccacactatgtacgagggaagaaatctagtatcccaggacgataacgccaagaccagagggcgatcacagctgtaggaccctctgcgattaagcctccagtccaagccagtagtgactttcgctttcaggccgtagtagcaaggcagttgaggtcctggaaaggcccccttggagtaagcgaagttgtgcatcttgcttcgcaccaactttgagcaatctctcaccgtccttggcctttcctggtcctactgggtggctccataatagcaacctgacagagaattctcatgagggccatctagagttgcaatcgctcgacggaagnacttcgtgagcgtcgaagaagaattctagcatgagctttcgaagcacactcactgactgcaccactccaaatccagttcccagcggaatggaggcgtgacagcatgaaggtatggaggaagaatgcgactggtgggtcaacagtaggcaactcaagtcgtgcatggaccaggtttcacggcatggattgccaaagagggcctgaatgagcttccgtatagcctttttgggcactgagcatttcacggactcaggtgtcagctagatatagctcatgcaatgaactacgtgatcgacctggacccgtcggcggggaacattgcctgatcgtgagcccaggccttgagtccgcaggacaatgatgggcctg

SEQ ID NO: 614012 - DNA, 83 bp, Homo sapiens
  misc_feature (48)..(48): n is a, c, g, or t
  misc_feature (54)..(54): n is a, c, g, or t
ttgcaacttattactgtcaacagattaatacttatcctcctcctttcngcgganggaccaaggtggagatcaaacgaactgtg

SEQ ID NO: 614013 - DNA, 377 bp, Homo sapiens
gctcgctaccgttggggacgaaagggcgggggactacaggcacgtgccaccacacgcggctaatttgtgtttttagtagagacagtgtttcgccatgttggccaggctggtcttgaactcctgacctcaggtgatccacccacctcggcctcccaaagtgctgggattacaggcatgagccactgctcccggcccggaattttctttatttctatacattttacttccgttgttttttccttttttgagacagggtctagctcttttgcctaggctgaagtgcagtggtgtgatcacagctcactgtagctttgacctccagggctcaagcaatcctcccacctcagcctcctaagtagctgagattataggtgcac

SEQ ID NO: 614014 - DNA, 597 bp, Homo sapiens
  misc_feature (34)..(34): n is a, c, g, or t
  misc_feature (367)..(367): n is a, c, g, or t
gtacggttcgcatgttccaacatcatttattaanatagcggatcttccccactgctagttttgacaggtctgtcggagatcagatggttgcagatgtgtggcattatttctgaggcctctgttttgttccattggctctatataactgttttggtaccagtaccatgctgttttggttactgtagccttgtagtatagtttgaagtcaggtagcatgatgccgctagctttgttctttttgcttaggattgtcttggctatacaggctcttttttgggttccatatgaaatttaattctgtgaagaaagtcagtggtagcttgatggggatagcactgaatctataaattactttgggcagtatggncatttttacaatatttattcttcctatccatgagcatggaatgttcttccatttgtttgtatcctcttctatttcattgagcagtggtttgtagttctccttgaagaggtccttcacatcccttgtaagttggattcctaggtattttattctctttatagcaattgtgactgggagttcactcatgatttgggtctctgttggtctattattggtgttaagaatgttgt

SEQ ID NO: 614015 - DNA, 380 bp, Homo sapiens
ggggcccccggggggggccccccctttttttttaaaaaattgggccccccatagaggttggcccccccccggggaggcccaaaattaaaggcccgggtcccctttttttttttttttcccgggaaaaaggccccccagggggtaaaagcccctttttaggggcccaaaaattttgcctttttaaaccccggtgggctttggggcctctttttttaacgccaaaaaaaaaaaaattttgggggggtttaaaaggggtttcccgcccccggggggccccctatccccgggcccgggggccccctgggaatttgggtttttttttaaaaatgccccccccccctttttccccgggttttattatttaggggggggggttttga

SEQ ID NO: 614016 - DNA, 586 bp, Homo sapiens
  misc_feature (514)..(514): n is a, c, g, or t
  misc_feature (578)..(579): n is a, c, g, or t
aagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaagggtaagctacactaatgtaaaattaatttttcagtttttctcacgatgtgttgttatatgttacagcttgtgtgttcaaggttctctatgaacgtaagttgtgcagagatggggctaatataagttgttgtattgagtgctcgctaaatgtttcgtggggattattttatgcttgtgtaatgtttgatagtgctcagttgttccactttatagacgactataccactgagactcctcttatggaacagtacaagagtgnctatatatatgtgaaaaaaataaagagaacaacaaagaatataacaaagaaacacacccctatnngcgggcc

SEQ ID NO: 614017 - DNA, 472 bp, Homo sapiens
taatgatgggctcatattaactaattacatctggcatggactggtgtttcccaataaggtcacattttgaggtactagggcttggacttcaacatatggatttggcagggggcataattcaacccataatacacaatttagaaaataaaatcatagagcgtggggccagacatggtggctcacgcctgtaatctcaacacttggggaggctgaggtggttggatcacttgaggtcaggagttcgagaacagcctggccaacataatgaaaccccgtctctactaaaaatacaaaaattagctgggctggggggggcatgcctgtagtccgaactactaaggagactgaggcaggagaatggctggaacctgggaggtggaagtggcagtgagccacgatcacgccactgcactccagcctgggcgacagagctagactctgtctcaaaaaaaaagagtgccaaggtagagaa

SEQ ID NO: 614018 - DNA, 488 bp, Homo sapiens
ctaatgctttagaagaagctcacagagtgatgaacccaaacaacaaagaaaccatgtttaacactaggtatcttcatcagtataggtaggtgttcacaatttttgatggatcaaaaacttgctgtaatacaaatagagagtggaggtactaaaggccttgcttgtggaaactgaaagaggatacaccgctttatggtaaaactaaaagttaggggagaatgaaggaaatccgacatatgaaaaaattctacaggaaccccatcatcggggaactgaactgatgaaaacttggaacaccccagtaaattttgttggggaatgcactccggagcaagtgataaacatcccatcctgtgggtcccatgcaaaaaatcacgagcctccatctcataaagttctcccccccttcgattaaagaaagttagttctaatacacggacagctttgtactcaccaagctatattgccaagatctaattctaccccca

SEQ ID NO: 614019 - DNA, 296 bp, Homo sapiens
gcggggcatattccgtatctcaaactggcatctcagctgctggtgatgatggctatacattttcctcagtatacaatgtgcgtatttagcgttaacagtccacccattggctgaggcaggtggatcatctgaggtgacgagtttgagaccagcctggccaatatgtgaaactctgtctctactaaaaatacaaaaattagccaggcatggttgcagcacctgtaatcccagctactcgggaggccaagacaggggaattgcttgaatccaggagacagaatttgcagtgagccgag

SEQ ID NO: 614020 - DNA, 749 bp, Homo sapiens
  misc_feature (159)..(159): n is a, c, g, or t
cacagtgttcaaaattttatgaaaagtaattgatctaacgtgcctctgatactagatgtggtactgccttctccctggtctgttgatttatccttgaatctagactcaaaggatatcacctttgagaattaattggcgttaagccctttagctttaagntctaaagactcaaaataatgactttttttttttttggcgagggagttctccactcttgtgttccaccagttgtgtccacccaggctgaagtgcaagggcattgactcctcggctcacttgccaccctccacgttccgtgggttctcaagcaattttcctggcctcagcctcccaagtagctggggaatacgggtgcacaccaccacaccggggctaatttggtattttagtagaagatgggggttctcaccatgtgggccaggatggtcttgaactcctgatctcagggtgatcttgcccacctggggtccccaagtacggggattacagggcgtgagccaccgtgcccggcaaaataatgactttaaatgtgatatcagtgtggattaccatagtaaattaatcctattagaaataatagaatgcttatcacgtgggatggtgaaataaaatatatcgtatgcgagtaaatggtggggtgccctttcatggtggggacaacgtttcttgtggtttacactgtcggaatgtgcctgagaatcctttgctttcggaatacttaaggaatctttgcaacaaaggaatttagg

SEQ ID NO: 614021 - DNA, 1239 bp, Homo sapiens
  misc_feature (737)..(737): n is a, c, g, or t
  misc_feature (739)..(739): n is a, c, g, or t
  misc_feature (741)..(741): n is a, c, g, or t
  misc_feature (753)..(753): n is a, c, g, or t
  misc_feature (756)..(758): n is a, c, g, or t
  misc_feature (1008)..(1008): n is a, c, g, or t
  misc_feature (1017)..(1017): n is a, c, g, or t
  misc_feature (1089)..(1089): n is a, c, g, or t
  misc_feature (1108)..(1108): n is a, c, g, or t
  misc_feature (1171)..(1171): n is a, c, g, or t
  misc_feature (1173)..(1173): n is a, c, g, or t
  misc_feature (1222)..(1222): n is a, c, g, or t
aaataaacaatccaccgaagaaaatatcaatgggctagagatagatataatgttttagaatactgaatgggtggaggaagcatggggcaagataaaggaattgggcactccccacccccctcttactcttctcccgtgggacttggagtcgaatggggcgggacttgagtccctgaaccagcagagagaaaagagggagccccagaaatcacaggtgggcacgtcgctgctaccggccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacgagcatacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacgcaaacgcacagcacacacanangnaagcacacacgnaannnagcacacacacgagcacacagcacacaaacgcacagcacacgcacacacatgcacacacagcacactagcacacagcacacacacaaagacacagcacacacatgcacacacagcacaaacacgcgaacacagcacacacgaacacagcacaatcagcacacacacaaacacagcacacatgctcacagcacatgcacacacagcacacacatgaacacagcacacagcacacacatgcacacagcacanacgcatgcncagcacacatgaacacagcacacacaaacacacagcacacacatgcacacacagcacacacactcatgcgcnacaatacatgaacacagcncacagcacaaaaacacgcagcacacacgttgcacacgctagctcccacctgcacacacacatncncccacacacgcacacccccacaaaattggatgaaacaataagctatctnagcactacgatatctgt

SEQ ID NO: 614022 - DNA, 657 bp, Homo sapiens
gacgtgctggtgtcctctggtgcaagaattccaggaatatgccttgcgggtctgtctcggctagagagctgttaattcatagttgtgtctgacataccactaccgagcactacagaaaccgtgtaatatcatcgtgccgctgaaggggactcagaagggagcaggcatgagaccatgcactgtcccgactgactcggtgtgggttgactagtggtgatgggcaccggtcaatcagaggaggcagaatctagaggctcaagtccaggacaccgtgtcctatacctaggcaggtgggttccattctggacgagccggaacaggtcaaaccccgttagccatagaagcatgcgcggtagtgcacgtaagtcagtctgtctcgaaaggcatgacatgcgagtgacgttccacctaaagtaggagagcaacaattacaaaggaggcagcatggacttttacacaggtggtctccgtggccccaaggtggtcaacgagggggaagctctagtgttaccggccacagtagggggaagggtggctcgcacacaggcaagcgtaatgactgggggcccctcccgcggcaactttggagcattttacaacaggtgcgctttgagtcgacgtcagagttatgcactgctttgaccttgtcgtacagca

SEQ ID NO: 614023 - DNA, 1071 bp, Homo sapiens
  misc_feature (569)..(569): n is a, c, g, or t
  misc_feature (571)..(571): n is a, c, g, or t
  misc_feature (573)..(573): n is a, c, g, or t
  misc_feature (585)..(585): n is a, c, g, or t
  misc_feature (588)..(590): n is a, c, g, or t
  misc_feature (840)..(840): n is a, c, g, or t
  misc_feature (849)..(849): n is a, c, g, or t
  misc_feature (921)..(921): n is a, c, g, or t
  misc_feature (940)..(940): n is a, c, g, or t
  misc_feature (1003)..(1003): n is a, c, g, or t
  misc_feature (1005)..(1005): n is a, c, g, or t
  misc_feature (1054)..(1054): n is a, c, g, or t
tattggtaatgctgactgagtcctgacagaagagaagaaggccagaatcacaggtggacgtgtgtaggccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacgagcatacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacgcaaacgcacagcacacacanangnaagcacacacgnaannnagcacacacacgagcacacagcacacaaacgcacagcacacgcacacacatgcacacacagcacactagcacacagcacacacacaaagacacagcacacacatgcacacacagcacaaacacgcgaacacagcacacacgaacacagcacaatcagcacacacacaaacacagcacacatgctcacagcacatgcacacacagcacacacatgaacacagcacacagcacacacatgcacacagcacanacgcatgcncagcacacatgaacacagcacacacaaacacacagcacacacatgcacacacagcacacacactcatgcgcnacaatacatgaacacagcncacagcacaaaaacacgcagcacacacgttgcacacgctagctcccacctgcacacacacatncncccacacacgcacacccccacaaaattggatgaaacaataagctatctnagcactacgatatctgt

SEQ ID NO: 614024 - DNA, 102 bp, Homo sapiens
tctgactacccggagacataaaacaccccaaataggaactttagagggattgaaatctgttgcctgttccactaggaatattgtttgcaaggcacaaggtgt

SEQ ID NO: 614025 - DNA, 1085 bp, Homo sapiens
  misc_feature (583)..(583): n is a, c, g, or t
  misc_feature (585)..(585): n is a, c, g, or t
  misc_feature (587)..(587): n is a, c, g, or t
  misc_feature (599)..(599): n is a, c, g, or t
  misc_feature (602)..(604): n is a, c, g, or t
  misc_feature (854)..(854): n is a, c, g, or t
  misc_feature (863)..(863): n is a, c, g, or t
  misc_feature (935)..(935): n is a, c, g, or t
  misc_feature (954)..(954): n is a, c, g, or t
  misc_feature (1017)..(1017): n is a, c, g, or t
  misc_feature (1019)..(1019): n is a, c, g, or t
  misc_feature (1068)..(1068): n is a, c, g, or t
ccacacaccacaaaacaccacacacctcaaaacatcacacacaccacacacaataccacacgatatatacataccacacacacaacacacaccatacaaacacagcacgcaccacacacacaacacacaacaccatacatgatatatacatacctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacgagcatacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacgcaaacgcacagcacacacanangnaagcacacacgnaannnagcacacacacgagcacacagcacacaaacgcacagcacacgcacacacatgcacacacagcacactagcacacagcacacacacaaagacacagcacacacatgcacacacagcacaaacacgcgaacacagcacacacgaacacagcacaatcagcacacacacaaacacagcacacatgctcacagcacatgcacacacagcacacacatgaacacagcacacagcacacacatgcacacagcacanacgcatgcncagcacacatgaacacagcacacacaaacacacagcacacacatgcacacacagcacacacactcatgcgcnacaatacatgaacacagcncacagcacaaaaacacgcagcacacacgttgcacacgctagctcccacctgcacacacacatncncccacacacgcacacccccacaaaattggatgaaacaataagctatctnagcactacgatatctgt

SEQ ID NO: 614026 - DNA, 112 bp, Homo sapiens
ctcggcaccccagcgcgatgcgtacgaagtggtggcatggtgatcccctgtgcggtaggggccgggttctcgtgtcgggggactcacacggcccggtatttccgttcatgag

SEQ ID NO: 614027 - DNA, 1220 bp, Homo sapiens
  misc_feature (718)..(718): n is a, c, g, or t
  misc_feature (720)..(720): n is a, c, g, or t
  misc_feature (722)..(722): n is a, c, g, or t
  misc_feature (734)..(734): n is a, c, g, or t
  misc_feature (737)..(739): n is a, c, g, or t
  misc_feature (989)..(989): n is a, c, g, or t
  misc_feature (998)..(998): n is a, c, g, or t
  misc_feature (1070)..(1070): n is a, c, g, or t
  misc_feature (1089)..(1089): n is a, c, g, or t
  misc_feature (1152)..(1152): n is a, c, g, or t
  misc_feature (1154)..(1154): n is a, c, g, or t
  misc_feature (1203)..(1203): n is a, c, g, or t
aaataaacaatccaccgaagaaaatatcaatgggctagagatagatataatgttttagaatactgaatgggtggaggaagcatggggcaagataaaggaattgggcactccccacccccctcttactcttctcccgtgggacttggagtcgaatggggcgggacttgagtccctgaaccagcagagagaaaagagggagccccagaaatcacaggtgggcacgtcgctgctaccggccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacgcaaacgcacagcacacacanangnaagcacacacgnaannnagcacacacacgagcacacagcacacaaacgcacagcacacgcacacacatgcacacacagcacactagcacacagcacacacacaaagacacagcacacacatgcacacacagcacaaacacgcgaacacagcacacacgaacacagcacaatcagcacacacacaaacacagcacacatgctcacagcacatgcacacacagcacacacatgaacacagcacacagcacacacatgcacacagcacanacgcatgcncagcacacatgaacacagcacacacaaacacacagcacacacatgcacacacagcacacacactcatgcgcnacaatacatgaacacagcncacagcacaaaaacacgcagcacacacgttgcacacgctagctcccacctgcacacacacatncncccacacacgcacacccccacaaaattggatgaaacaataagctatctnagcactacgatatctgt

SEQ ID NO: 614028 - DNA, 143 bp, Homo sapiens
  misc_feature (40)..(40): n is a, c, g, or t
ggtcggcctgtgttagcacaaatatgtatatggtggtcanctaatggctcatgccagcaccttgagaggcaaggtgggaagatgacttgaggccaggaattcaagaccagccttgtgtaacatagcaagtcctcatctctacc

SEQ ID NO: 614029 - DNA, 239 bp, Homo sapiens
agccaaagggggaggatcccccttatcccccaagttcaagaccagcctaggcagcatagtgagaccccccatctctataagaaataaaaaaatcagctggatgtggtggtgtatgcctgtagtctcagctactcgaaaggctgagtcaaaaggattgcttgagcccaggattggaggctacagtgagccatcatcacacccctgcacacctgcctgggcaacaaagcgcaaccctgtca

SEQ ID NO: 614030 - DNA, 491 bp, Homo sapiens
ggggggcccccccggggggggggccctttaaaaaaagggggcccccccgggccccgaaatttggcccggggggggggggtccccccccaaaaaaaaaaaagggggccctttttttttttttttttaaaaaaagggggggttttttatgttttttccacccttaaaaaaatttgggggggggaaaaaaattttaaaaaaaaacccccccctttagggggttttgggggggggtttttttaaaaaaatttgttgggccccttttttttcccctttttccccccaaaaaagggggggggtttttttccccaaggggttcttttttttaaaaaaccccctttttttttccccccttcttttttttttttttccccgggccccccaaaaattttttttttgggggccccaaaaaaaatattgggcccccttttgggtttggggggggttttaaaaaattgggaaaaaaaaaaaaaaaaccgggttggggtttccca

SEQ ID NO: 614031 - DNA, 359 bp, Homo sapiens
aaacaggtgctggtcccagcgtgcaactctgatcacattatactgatcgttctgggtggatgttagcatagtactatttaccatgcatcctgagtactagttggaagcaacgttgtcatctataaacagcaggttttgatcacaatctgttctacatcttaatgatgtgatcttctcatcatgagaatagcctgaaagccatttacttaggactacattgtgctctgatgaactatcccctgcgctttgaacgtgccagcagcccttgtttatatgcccattcttttcacttcctctccacaggagcctctgcagtcgcttgccaaagcagattttcctaaggccactgttttaaaaga

SEQ ID NO: 614032 - DNA, 136 bp, Homo sapiens
  misc_feature (129)..(129): n is a, c, g, or t
gtggttgtgggtagagccatctgcgatctgcatcatcatgctcttttctccatccacctcaccagactgtttctcaagagatggctttccaggagtgagtcggtggaggaagagacgtatcagaggtgncccaggg

SEQ ID NO: 614033 - DNA, 537 bp, Homo sapiens
gtctacagctgtttagaagtgaagggggcagtgatgtgtgcaaggggaggagcggcaacaggatagcagcagggggaggcctgtgactcaaagaggtgtgaggctgagagtgcttgatcagatcatgttcggaaaagatactgtagttgtgggatagcagatgaattggagggaagagagcagaccaaggagagcatcacaagagtccatgaggagatactctacaggagtgctccggaggcagaggaattgccttgaaagacgtggcgtgtcaggaaacataagccaatcactcctggttatcacttcacacggcgacattggcgattactgattgctaactgctaccttcgctgtttgccctgtggctttctattttttagaggcagagctctctgttggcccaggtggagtgaagtgacgcgatctcggctcattggcacctccggcccccggtgcccagtgattctcaatgctcagcctcccaagtagcttggaccacatgcatgcacccgggggtaccgaagctcgaaatcg

SEQ ID NO: 614034 - DNA, 416 bp, Homo sapiens
agcgctcatttatggctagagtcctttcccctgtgacatgcgctacgccatgagggtcttgtacatgatgaaacagatttgggcgtgagagggcattcagaactgtagagcagcaggaggcattgggcaccttgccatcagggagcctggaccctggacactgagccaggtgccctacagaagatggctgtccctctcgacaggtagagacccctgagataacagcagcatctaccgaaagattggcgagaacagcacggtgagtggacagggtgaggcctcagactatgactgggatcagggttacgtctgtacccaaggacaggtctcagtgtgtgacccaggttggggctcactgtctgaccaggatcagcgctctgtgtgcccaggctcaggctccggtgtgtgtctgcgat

SEQ ID NO: 614035 - DNA, 287 bp, Homo sapiens
tcgtcagtgccttgacatgaaaagattttggtcaggctaattacagtaattgtatttagtcattctgacttggtataatttcctgtcttgtcggtaatgtatagttacacctaaacaaaacagagttaatctcttttaagtaagagatggcatggctcctttgtagtgtgcgtattaacctaaatgggaaagcctacataggactaggttctagttcaggaacactcctgccttggaataccccccgagggcctgcagagcgaatgaatgctccctgtgtgtgagtt

SEQ ID NO: 614036 - DNA, 111 bp, Homo sapiens
  misc_feature (78)..(78): n is a, c, g, or t
ggtgaaaaagcgaaacgaatgcggcaggcgcgcgctttatccgcacgcgaaaataatttccggagtaaacgccgaaanagtttggccgcaaaaagtaagttacccacccag

SEQ ID NO: 614037 - DNA, 748 bp, Homo sapiens
agcgggtggctgggtgccaccctcgtggaaggaagagtctgtcgcgagcgcgagcttctgagctcgacggtgcctgagctggcagctggttgtgtgcttacaacttgagacgagcatggacaggtccttccacgtgctttctggcggcagacatggagcatggaggagttgggggatccgagaggaatgtggcgtgtacgggatgcataagactcagagagagtgagaccaacgacaagcatgggatgtaaccgcactgtgatcaacatctggaggactcgtggtggctagcagacagcgagggtcacggagaagtgcttggtatcagtgactacgtgatgggagttcggtgcaaacattcaaatctacaccaagggaatgggtctagtaaaatcaacgtactattactgaagacaattagaacaaaagttatatgtattcacatcttgaaaattggaacacaaccagagtatgcacagcacaggaaacatgtgaagctaggaaaattgtcagaaccttcagttgtatgaaacacttcatggggaaccgaataagcattgatagcaacaatacacatgagacgaaactaaggataaaatgccttgactcgaatttaagtgaaaaaaagatttcttgaggtcataggtaatatgggtcctggtctaaaaaagttactgaattcgatgaacatggatatacccacaaataactggcaggtatacaccactcctacaagaacgaagaatga

SEQ ID NO: 614038 - DNA, 1042 bp, Homo sapiens
actccttaagtgctgggataataggtgtgagccatcatgggttgaccataaagccttactatttcttgtggagacatagctcgttgctcatgtccaagtctgaaatgcagtgatgtgatcatggctcactgcatgcttgaactcccaggcttaggagatcctcccatctcagcctcctgagtagctgagattataggtgcataccatcgagccttgctatgatcattaaagaatttctcttaattttcataccaacaaatgtagttcgctgtatgggagctgagggttagaagggaaagatgctggagaaaatgagaatcatacgcagggtgtatactgtcagtgaatacggcataagacgtagttaatatgaacgtttctgttctttggaagtactaatgttaggtttgaccaaaacgtaatttgctgaggggaaggagggttgtgtatatatgttactattctgaatgttttgcttccgatagatatctgtgtacgtaattacagcttgtcgtgtagtgctgtaattacgctatctgcgtgtgggctaactccttttatggagagctgtctttttattttgtacagggggcctgtgtccggttccacatagttgctctgaaatgtgtatataacgcatggactgaactggagaactagtagcgtgacactaaggtagatttaaaggatgtttagagacacagttataggataggcctgattgctccagataccctaaattgtattgccttcaggtttgtgtgaaaaaacagcgagaaggctatatattgctgagtgaggctaccatttgatacgtacattcacgtgatgtggcgtcaacataattgtagcgacgacttacaaagggggatccccatcctgataaatagacgggcaaagagtgaaggaagagacaattgtaatatagcaaagaggagtttgaaagagcatgcataagtgactaagaaaagatcatagaaaaagataggcgcctgaaagagagagcacaaaagacaaagagaaagtgagggaatactaagcg

SEQ ID NO: 614039 - DNA, 446 bp, Homo sapiens
gaaagaaacatttgggcttgagaatgagtttctaagaaggtagagtggatcagcactcttttcccagaaatttccatcttgatcttgattcctgactcttgtagcctgttcttcgtatattttacaataaggaatgccaacagtgtactaggagccagggctctcaggctagtgttacagagttgtagggaaattctaggatgaagtttttgctgggacaaagcagatgaaagagttgagtttttccagatctggagcttacctgttggggatgctgtagacatctagaggcagcagggatatcttcagtctttattgtgtagtgctggtttgtttattcagaccttctttaatcttactaataaaactcttcacttgaagacctttcagtccttgcctgtgaaaggcatgattgttcttcttgaagtcacatgcttttgatttct

SEQ ID NO: 614040 - DNA, 357 bp, Homo sapiens
atggaatggaatggaaaggaaaggacttgaatggaatggattggacccgaacggaatggaatggattggaatggaatgcaattgaatgttattgactggaatggaatggaataccatggaatggaatagaatggaatgtaatagaaaggaatggaatggaatagaatggaatggaatgaaatggaatggaattgagtggaatggaagggaatgtagtggaacggagatgagtggaattgaatgaagtgtatttgaatggaattgaatggaacggacttgaattgaatggaaaggaatggactcgaatggaatggaaaggactggaatggaatggaatggaatttaatggaatggact

SEQ ID NO: 614041 - DNA, 208 bp, Homo sapiens
atctcgcaggagaagtagaagccatcagaggggaccgtccttcaaagtacggggcaccaaacctcagcatgtacctggacccactctgtcgtcctctgtttccttggggattgaataagagaggtgccgctcgaagccggggccggggtgggagtcggggcgtctatcagttgtggcttcttttcggatgatgtgataatccgcgacc

SEQ ID NO: 614042 - DNA, 350 bp, Homo sapiens
  misc_feature (5)..(5): n is a, c, g, or t
  misc_feature (32)..(32): n is a, c, g, or t
  misc_feature (43)..(43): n is a, c, g, or t
  misc_feature (49)..(49): n is a, c, g, or t
  misc_feature (65)..(65): n is a, c, g, or t
  misc_feature (78)..(78): n is a, c, g, or t
  misc_feature (87)..(87): n is a, c, g, or t
  misc_feature (121)..(121): n is a, c, g, or t
  misc_feature (223)..(223): n is a, c, g, or t
ctgtnattctaaaactctgcttttaagtgctnaactgaagctnaccttntattcattttcaaaanacggtcctgctgnagaaatggngccattcacatcttaggaaactatcacatattanatgtgctgcactcaatttacaaatagaccacacatcatcaccggtttccaaatgacagcagatgggctgtattattcaaatactcatcacaccacacaatanggaaaaaaagattcatgacctggtcatggctcctggatgcttgaaagcatcagaaacagaagttgtggtctgggagttcatctcctttccttggctctgaatattaggaactttttttttttatttg

SEQ ID NO: 614043 - DNA, 169 bp, Homo sapiens
gcgcggatgagaatggcttctaaaagtggatcttggggatccgtgtgaatttgcacacctctgtcccctaggatggggaactaagggaaaacgtctgttgtatcacatgccgttttttagtttaagtttattataccgtgtctagaactaaaaattggcaagagttttt

SEQ ID NO: 614044 - DNA, 470 bp, Homo sapiens
  misc_feature (131)..(131): n is a, c, g, or t
  misc_feature (133)..(133): n is a, c, g, or t
gaagtgtgaggtgaccttgcaggtcccagagttgattgaagaccccatccagaaagaaggcaccctgtgggagagattgcaaggcctaggtctgaatccggaagcttccaccccatggagaaggggctggncnacgcctggggctggcattggagctgagctttggagccaaggactgtactgcagtgcagggagagtgaggccagaaaggctgagacaactcagggaaagaaaacctcccttctggctaatagtcaagcaccgcctgagtagaccaacactctcctgtccacaggggcagcagatgaagacacaaccagagaggactaacaggccccctcagctctcagtcagagggcagagcaacacagaatagacattaaaggaacagactttgaggccaggcagccttgggtgtgcatctgtccctactaagccatgtgacattaaacaagtgagtccacctcaaa

SEQ ID NO: 614045 - DNA, 378 bp, Homo sapiens
atacagtgtacaaaggaatcttacgaatgagaaatgagctgaactttaagataggtatagaactcctggcttcaaatgataccacccaactttggcctcccaaagtgctgggataacaggtgtgagccaccgggcccagatggatacatactattgatatactgcttttaattgggctattcgctcgaggtgaccccatggactggtagatcaaattggctttcaagctattagtttctaagggacatccttgcactatctgactgtttcctaagaagagcgttaggaaaaatttacaccagctaagaaacaaaattaagacataactctgaaatgtggctatggtaatctatactttaaatatgggaaatgaagatc

SEQ ID NO: 614046 - DNA, 101 bp, Homo sapiens
ggttggccaagaggagcggaagggccgaggaggaaggccaacgttaacttccggaggaagagaccaaggaccagggagagaggacacacagcgcgccccag

SEQ ID NO: 614047 - DNA, 1291 bp, Homo sapiens
  misc_feature (770)..(770): n is a, c, g, or t
taacaattttcctgggaaaatcatgcaaggctgtgccagaattgtggatgtgcaacccgggggccacaagttctgtgcaaacctcctttgtgcatacgtggctccgtgttaagtggcaaaaccttttaactcttcgcctttaatgtgtcacttagtaacctccgtgcatttatcttctcaaaatataaaagaaaccacgcgcccatctctttttctagcggatatgtgactcttctgcggtgtgtctcaaatgtgacccaccgtggcgtggatgtgttacccttttattctcgtgaagccctcgtggtgtatggccctttcttgttgaagcgtggtgggccccctttccacccgtgtggttttccccccaccaccccgagccgagcgcgggggcagagtcctgtgtgtctccagccgcgtgtcgcgttaccacgctgtgggcccggggggtttcaactcgcgtgagaggggggtgcgcgaactccctcgccgcggcgtatggggtgtgtcacccgccggttaccctcggggggccccccagcggtctcacgcgggagaagctcgtgtgctcccagagcacacatgtcggggttcccgccgaagcggggctctacaacactgtgtgggggcgcgccctgtgtgggagcgcgccctctgtggaggctcgtgtgtttgtgtgtgggcccccccgccgatattggggggcgagtgtagaaatacccgtcgggacatcgtgtgggttcaccctctttaaaccattaccaaagttnggcccacaaggctcttatcagcaagacgaggagacactacactcttcaacatctaacccaacaagaaaaccgtcttttctaacacgaggacattgtcggcttcctggggcgtgacccccctggggggggggcggcgcataaaggatctctcactttccccaaaccacctataaggaacaaccccgtgggttggtcgcacctcctgtgggtggaggcgaaagcgcacgcctaaaagacccctcttccagagacgaatggttgaccaccatcaggagtgagagaaataaccccccagcaagagggtactcaaaacgatatctacaggagggcaccttactctatatagatattcttctctccgtgcgaaacacacacgcgggctgttcagtagtactattattcaaaaggcgacgcacgcggtgtggactatttataaacacgcctacctttgaaaaccctgtggtcctcagggagccccgcggagattttgtaacaacacgcacaagggaaggaccaatgtc

SEQ ID NO: 614048 - DNA, 308 bp, Homo sapiens
caaagatccaggaaaatggtttttttgttttaaaaaacacaaacatttgaccaaacaagggaggcaggtcttttggcctaagggaacccaaggggttttgcggatgtggctcctccagggatttgggggttccccaccggctggttaggggtctaggttttggggaggaccttattttgggggggctccaggttttggggttgggggctttttaagggtttatggcctttatcccctaaattcctcccaattgggggctccaatttgtcgggttttccagggcctggttaaggggtcctggggggagg

SEQ ID NO: 614049 - DNA, 665 bp, Homo sapiens
ccagaccgtgtatcctgctctccccacatgaccccccactcccgtgggtaccaatcggccacagaagctccagaaccagttatccagatgctgaagaaaagttggacccggagcccatgaccagtcggacaggggcccatgaccagtcggacccgccagcccatgaggaactagaccggggccccgacaagtcagaccggggccacgacaagtctgacaagggatcgagagcgtggctatgaccaggtagacagagagagagagcgagacagggacgggatcgggaccccgggtatgaccaggcagaccccggaagagggccaagaacggcggccccaccaatcgccggggaggagctggctccctattcccagagcacagaaggccgtaagccgaaaggatgaagagttagaccccctggaccctagctcatactcagacgccccccggggcacgtggtcaacaggactcccccagcggaatgaggcccagactggcgctgacaccaccagcagctgggcccctcttccagcagcggccgtatccatccccaggggctgtgctccgggcccatcagaggccttccgacccagcagcaggattgaagcttcggcctcctggcctgggttaaaataaaagctttttggtgatcctgccccacacca

SEQ ID NO: 614050 - DNA, 972 bp, Homo sapiens
ctgccttctctttgagcgccgccgtttctgtgtaagagttgttccccggtgtagtctgctgaggaaactctttgtggccgcaatacctgtggtgtgccgggcctctttggagggggtgttgcccgccccccgtgggttaagaggacccccgtggctcagtaacagagcgccggacctgtcccccaacgacagtggccgaagctcctggtcgtgttatggcgccccacacgctccgggcaacaatttggggcaggcccctgcccctgctagcggggatctcttgccccgttcaccccgtgccgtgtgtccctcagcaggtgcttgtccttgagacacctggttcttacagccctgcgcgtaccatcgcaggctcgtggccccgctatgggccacatcccccaggggagtgttcttccttggttgccccctccccccaggggtagagggcgcttttatttttcccttccgagtggcgcagcaggcacctgtttattctattgaacgacggaccacgcgctcctcttttgtgactaaggtcgagccccaagtgctgcccgcgtcttgtaaaggcgcagagtcgacgcaccactgagcatgtctctataaaggcctctaaaatcatctccccgggtggtccgacagacactacatggcgaaaaaacaccttctctgtgaccccaaccaatagtgtacaattatatcaccttcagatggagtataaaaatatattatggcacctcagtatacttgaagtgagcaccacgtcttcgcagaagcctgtaactccccactggagtgacaaaagaaggtaacaattgtcaaactatacatcttgaactttctgattcaactttttgaattttctttcagatagaaaataaattcaaatttttccggtcccttttacaattcatttttaccaatagtagcgggccctttaaaaaaaattgctttctacccccccacataaca

SEQ ID NO: 614051 - DNA, 188 bp, Homo sapiens
ttcacaggatctccaaagatctttgagcatacctcaaaaaagaaaagcatccccattagcagtcattctccaacctccattccttgaatccctggcaaccactaatttactttctgtttctatggacttgccaatcccataccctgactttttttttttttttttttggaaacaaattctcattctgt

SEQ ID NO: 614052 - DNA, 730 bp, Homo sapiens
cgcagagaggatgagatgaaggtaagtgagggatttatattcaagaaatggtgtaggtagattgtggtagggtaggcgtaggttattataaaggagaacgatagaagagatggaattggcgaagatggttaaagacaagcattgagatctatgaagggctgatgctacgatgaatggcgtccttaaagaggttagcctggagtgatggcaattagggctccacttgggaaccagtcgtggacgacgggttctttcataaggactatcaggggttcgtgaaggttataatataagtagcagtgtgtaagagtctgttaaagattaccagttaagcagaattgagacaaaatgggccaaagaccaggtcttcagaaagacggctttgtcaagtctttgcaaaatatcttcacaagtccttcacgaggtgtttaggaattagtctctatgcaaagtctctagatgaaaccgcgtaagagtttggtagggtaataacgacagtgtataatggcttagataggtgaatggtaaatggaatcgtatatgcattaggtcacagtttagagcgggcgtagcactgcgattgtactgtttctgccacaagccaagcagtgaaccttcagatgttgtcctactcagttcagggcgaccagctatcatgtcatcagtacagctctacttgtattgcagatggaagatttcagaataccgcttggatcacatgcaaatgtcc

SEQ ID NO: 614053 - DNA, 746 bp, Homo sapiens
  misc_feature (496)..(496): n is a, c, g, or t
gccctttctttgcggaatcaccatggcggttgggaccctgtacacgtatcctgaaagactggagggccattgcaaggctctctatcgtctgtctcagtaccagcggggctcaggtccgctgtgctctccggcaccactcctcaacgttccaattttatggccaaaagctaactcagcagccccatgaacatttcgtccagtcgagaaatttcggtgcacggacaaaggtcgccagcaatttgagggctgatgatggattctggtgatgttctgagaagcgaacgcccaattgccgtacgtatggtgagcgaatgtaggacgctgcgagggtaagtgactccaagaggtcaggcagcgcacgaaggttggatgctaggtgtgagttgaagctattagtctagagtttcctgcatatgagtgcgcaccactaagcctagctaccataggggtgttgcccgcgaccattgggtcatcaatgcagcacaaagaacaaacnaggccactgagcacatgcgaaacggacggaaagtcgagcgcgacatgtctcggaggctagcaggatcgctatactttgtagagaccgaggacgtgtgaacgtggagtcgggcgcaaggagtgaccattaggctcgacatatcacagtttgtcttgcacccgtggttgtggctctaataagcaagggttctcagagcccttctttccggccaggccctttccacaatacccaaccgctttggtttcctcca

SEQ ID NO: 614054 - DNA, 701 bp, Homo sapiens
  misc_feature (172)..(172): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (187)..(188): n is a, c, g, or t
  misc_feature (190)..(191): n is a, c, g, or t
  misc_feature (213)..(213): n is a, c, g, or t
  misc_feature (229)..(230): n is a, c, g, or t
  misc_feature (237)..(237): n is a, c, g, or t
  misc_feature (241)..(241): n is a, c, g, or t
  misc_feature (259)..(259): n is a, c, g, or t
  misc_feature (273)..(273): n is a, c, g, or t
  misc_feature (321)..(321): n is a, c, g, or t
  misc_feature (337)..(337): n is a, c, g, or t
  misc_feature (345)..(345): n is a, c, g, or t
  misc_feature (350)..(350): n is a, c, g, or t
  misc_feature (375)..(375): n is a, c, g, or t
  misc_feature (400)..(400): n is a, c, g, or t
  misc_feature (449)..(449): n is a, c, g, or t
  misc_feature (451)..(451): n is a, c, g, or t
  misc_feature (464)..(464): n is a, c, g, or t
  misc_feature (468)..(468): n is a, c, g, or t
  misc_feature (481)..(481): n is a, c, g, or t
  misc_feature (487)..(487): n is a, c, g, or t
  misc_feature (498)..(498): n is a, c, g, or t
  misc_feature (517)..(517): n is a, c, g, or t
  misc_feature (519)..(519): n is a, c, g, or t
  misc_feature (525)..(525): n is a, c, g, or t
  misc_feature (559)..(559): n is a, c, g, or t
  misc_feature (582)..(582): n is a, c, g, or t
  misc_feature (599)..(599): n is a, c, g, or t
  misc_feature (609)..(609): n is a, c, g, or t
  misc_feature (618)..(618): n is a, c, g, or t
  misc_feature (631)..(632): n is a, c, g, or t
  misc_feature (690)..(690): n is a, c, g, or t
ggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggattgggggctccccgctgngccgngnggngcgcnncnnaggatgcgtcccgccggggtcncagtctccgcggcccnnctttgcncgcngcgcccgccccctggggngcccgcccgctgcnctgagaacccaggcgtccgggctgggagaggggccgggagcgtccgcngtggcgctggcccggntctcccgnccccnggaagggatcccggagcttcctggnggcggcgggcggccgtgtcgctccngggaaccgcgctgcccgcggaaactccgcgcgcctccgcggatgccccncnccccccccccccncccncggggttcggggncctgcnaggtccccccntcccccgcggtgcttcccnanctgggntaaggcggggttctcttcctccctcctctgtcgnctccttttcctccccctcgttcnccttttccttccctctntccatccagngccccgccncagggggcacctnntctttctcatccttccctgctcttcccttcctctccacctcctcctcctccttggggncaggggcccgg

SEQ ID NO: 614055 - DNA, 693 bp, Homo sapiens
tgcgacctttctctggagaccttggcgcctttggcctgtggtcgcgactggcggcatggtaacctcactgccccgtcactcccttccaaggcgaacagtacccatgcccacgtccggagcagcgagcgtggggtcagctccagcatggctcgggtcagtgcctgtgtctggtgtgggccactcagcgagagttgggttttcaggccagagatgggcttgattccacctggtggggtggggtggaccctggagactctcatcgtgatgtggccagcctgccccaaggctctttactgatgtcagaactccattgtttgcgacctgctgggtatggcctttggggcggccggcccggtagggtcttagtctaattaggtgtgtccagcttcttggccacctttccctggggaccctaacaggcccgatagccagagcccacttatctcccaggtcagactatctgctcaggccctctccctcccatgcaggccgatgtacgaactgcagacctctctggacgtcgctagtccagactggggacaactgtgggttcctgtgggtcctcccgggtaccgttctgaccccatgccaccttggcgtggcatttagaatgcctcggggtaaccctggtccttggttaagcctccttggttagtcaccagctaattccgtcccgtgaacttttggcccgtc

SEQ ID NO: 614056 - DNA, 466 bp, Homo sapiens
gtttagaaatattgtttccatattacaagtttaaggaaaagtttatctgccaaaataataacatggatttctagagcaccccataccataaggaggagccagaatattttccagctgaattccagtcttactcattttccttgaatgatactgaaatctaaattatccttgaacacaaacaatgacaaagaaatacaaatgttcatgcagtgtaattttcaacaatcaaattggccaatctgattctaattttaagctttgctgaggatgccaagcagaagccacgtgagcacactgctgaacacccaggatctttccatgtatggcagccttcatgtgagttctcttctcaccatacaatgttgtggatacagaagggaaggaattggatttggatgagtactgagcaccgatcacaggacagagcctcaaagttgctttttggaataaatttcttatagtaaaa

SEQ ID NO: 614057 - DNA, 1174 bp, Homo sapiens
gcgaactgaccgtggtcgtgggcggacggcggctgcagcgcggaggagctggggtcgctgtgggtcgcgaagcagagcccgggacgtgcgcgcttgtgtgcacgatcctgaaggggagctcctgagtgggccctgtggtctccatgggcttgctgctggcctattccctgtgagccctggctgctgggggccctgctgatgatacttggtttagtgccgtccctagggctcctgtgtgcgcaccctgtgtggcctgctgctggcagcggaggggggagcgcggctggcggctggggcgctcgagaggacagggctgtttatcatccgcgtgaatgtcttctcccgtcgtgggcaatgcccaggttgcgcgacaggttggggacgccgggagcgggccaggcgtggtgcatggcgttttcttctccggcagggttcggggcacccattgcggccccttgccatgcgccatgactgcgggggggccccatggccttgtggccttggacacatcgtggaccttggtggccggtttggactttttggccttggggcctgtgtgcttggaacaaaggctgccttggcggttggaacaaccaatggacgtgggacacaaaaaacctaaacttaatgcgttccaggcaactgggccgttgaagaccagtatggcgaggaaacatttcaaaaaaacggactggttagaagaacccccttccgggaatttaactgggaacaaataacctttgtgacctattggggccccggattacaacaggtggacagggactggttaaattagaaatcggagtgaggccccttttcgaaatttaaggagaggaaggaatttaagaggggactcattttttgtggcgcaggaaaaagttggaggggggagattaagctgtgggacagtggagaggttaagattttcagcattccggatttacccgcacgagtcgggccaagggcacggcgatttcgttggggaacaggccaattttgacggttgcgcggaaaaccaactggccaatttggggggacccctatggacggcacgtgcgccaccaagggtagggacgttgcatggactctcaaagttccaccaaagcaaaggaaaaggttaacttttggggccgagaaaaggccgttgggggaacacttctgtaccagtggggga

SEQ ID NO: 614058 - DNA, 1329 bp, Homo sapiens
  misc_feature (338)..(338): n is a, c, g, or t
  misc_feature (487)..(487): n is a, c, g, or t
  misc_feature (626)..(626): n is a, c, g, or t
gaacccatggactgtcagactcctctgtgttcatgcgcttatcacactgggcaccactgataacacctatatcgtcggagctgcctgttgatcatcaccgcgactacgtctgatgagctgcgtaagccacactctacgatctctcaggacctaggcctgcattgtaggacgtgaccctgtgcacacaggaggcaaagtacagtatgtgcatcggcgctgattcgggcctggctcaggcacggcctaacgagaccacagactgttacgcacacgtgatagactgaacagggcgtagggtccaggcgtgaccacaaggactgatccgctgtaaccaccgngtactactacgatcgtccgtgaggaacgaggtttgcggtattgtcatgtactagcgcgcattgtatgctctctccctttgtgcttgttcccacgtggacggctttatgggcgccactcacaagggaagacccaccccaagaacgcatgntagctcatttgatcgtagtcacctcgttgttcactttgaggggaaaaatacgcggaggcagtgtgagagcctctttttctttgactttggctatcctaagtcgttcgcgaggccaccggccacgttgggctaccacttngttctcgagggagaaacgcccaagggcccttcaatcgaaggggtgggcaacgggcgttgacgccctttggtgtccatgcccacacgggggtcgtcgtggtccctatctcaattcggcgcaatcggaggctttccctgaacgccatcaagggcgcctatggggggcaccggggcgtacagggcaatatgcacgccacaaattgtgtctccccttaggggggcccaagttgtcgtgtcgcgtttgtgggagcccccagaaaacggaagagaaacccgcatgctaaagtccggcaatgtacggcgccgcggtattgcggtaacgcattaagcgggaggctcctggcgttccgcaaaaaaggcggtaaagcacatccgttgaacagaaaacaccgtcgccggcataaagaggttccgtggtggaaagcgccaacctgccgggtaatagaaatagaccggttgtggcgcaccaagtgggttcttgcaataggcgcaccattggaacaccgggcggcagacgacattagaaacacacacacgtaaggggcacgcccccttttttaccttttcccacccgggggttagaaacgtttaccccgctctccaaagtttctgtgtttccgctagaaccccacagaggtgtgtgcaccccgtacacaccgtactattggtccgagagacacccatattttggtaccattcaccgc

SEQ ID NO: 614059 - DNA, 642 bp, Homo sapiens
  misc_feature (73)..(73): n is a, c, g, or t
agtggttttgcttttatctcactccatcacagtcacagagtgacctcctcagaagctggtgttttgtgaaatnatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacatattcattgttgcccaatgatatatgagggtgcaacattaacataactaggtaaatcacactatcatgctcatacc

SEQ ID NO: 614060 - DNA, 103 bp, Homo sapiens
tgcctgttatatactatcacaaacaatttctcaacaatttaccacaatctgtaaatctagaccttgcaataaatagtcactcaaacgttattttatatagggt

SEQ ID NO: 614061 - DNA, 934 bp, Homo sapiens
  misc_feature (2)..(2): n is a, c, g, or t
  misc_feature (179)..(179): n is a, c, g, or t
  misc_feature (318)..(318): n is a, c, g, or t
  misc_feature (322)..(322): n is a, c, g, or t
  misc_feature (376)..(376): n is a, c, g, or t
  misc_feature (391)..(391): n is a, c, g, or t
  misc_feature (459)..(459): n is a, c, g, or t
  misc_feature (461)..(461): n is a, c, g, or t
  misc_feature (478)..(478): n is a, c, g, or t
  misc_feature (518)..(518): n is a, c, g, or t
  misc_feature (531)..(531): n is a, c, g, or t
  misc_feature (589)..(589): n is a, c, g, or t
  misc_feature (615)..(615): n is a, c, g, or t
  misc_feature (627)..(627): n is a, c, g, or t
  misc_feature (673)..(673): n is a, c, g, or t
  misc_feature (739)..(739): n is a, c, g, or t
  misc_feature (746)..(746): n is a, c, g, or t
  misc_feature (797)..(797): n is a, c, g, or t
  misc_feature (812)..(812): n is a, c, g, or t
  misc_feature (829)..(829): n is a, c, g, or t
  misc_feature (863)..(863): n is a, c, g, or t
  misc_feature (904)..(904): n is a, c, g, or t
gnacacctcgagggtggagaactaacatccaagcccacctggatggtggatgggacccacttctgggtaacctgatgaggaagctctagtgaagaaattcaggacgcggtcttcagagcagagggcttggttcaagttcctgttctgccactaactaactgcatgatcttgagcaagcnacttaatttctctgctccttctctgttaaatgggtacaatgtggtcagcagtaaaggaactaatacatgttcagcacttagcacaaagcctggtacaaagcaggctctcaccaggtgccattttcagcacaactgcttngttnagctactgttgcagttgcaggttgtgccccaagggggtgggctcaggagccgtncagcaagagggagtnaccaaggaggcaggggacaatagccctatcttttcaggatctctgccttggacctggagaatggaganantttgctcctattacgtnccaagttgggaaaactaaggacgaagccggtgactgaaanctgaaatggaatnctctgcatctccaagtggccctatacctgaaaatatcattactagtgaaaaccaagtnacaaacacactcctcgacccccagtncttccacatgtnccattgaggagagcccagccaattacgcagagtgtatttatgcgcngggctggctaaacaggctggctacgagttcggaacagtgttaggatctggcttcccattggccganatgacanaatccttctcgcgttgctctctgatgttctggtccaacagggtggtcagcnggaggggctggtgcnggagccgggagttggtnttggctgttaaggaggttagggctcctacaagcnccccctgccccaggggcagggtggggagcttggagttgttnaaaaagccctgcctgccggaggatggtgta

SEQ ID NO: 614062 - DNA, 668 bp, Homo sapiens
aaggttcggtgattagcagaaattgacgtcttcaacgtggggactagtgcaactttgctaagtggattcggttcagtacagttatgcctggtcatggtcactctagacgacatggccatgtacgtcatcagtactttggggttgtctggatcttaaagcacattgtggtgagcgcaatctagggccaccacttaggtcagcatgtcatgcgtctcttggtctagcagtagacgctatggttcagtactacccgtcgatatgcttcattggtcacattggaatgccaattggccctctctcagctattaagccattgtttactatccaagacccatgatgggcgtaacaaggtttcggtcaaagattcagtcagagtcttccttagtcacgtccagaaaggggtccagtaggctacgactgcagttgttgactgtcaggagcgcgagtcacttgcaggtcagcgagcgtttgctggcagagcacagacccatgtccaggcacacgggttctatcacttggcgcctccaggactagcatgaccagatccagcctgagtggaggcgagcagcaactgatggggtgcgcaaatcgcgtgtagagctggggcgtcacgagaccgatacctccgccgttcaacagcaacagctggcccggaatttacagctccc

SEQ ID NO: 614063 - DNA, 295 bp, Homo sapiens
  misc_feature (74)..(74): n is a, c, g, or t
ccgtagaggatcccccacaggtcaatggcagtttttgttacttttaaatgacacaccaaaaagaaatatgatgnctattcagtcattcactggcagtttaaaaatggttttctaaaataattcccaggaaggctaattaagggatatgtatactggataatttccccttcaaattcctatttcttaagaatgggttatgttaccaaattccaggccaaaaacttgggaaaccaggaaaccaggggtaacggaaaggcacaataagcaaactggctttattccaaaccaaggtaaa

SEQ ID NO: 614064 - DNA, 354 bp, Homo sapiens
tggaacgaacaggatcaattttgtatcttcctcctagagttcgagtctcataagaaagaatcgtgttaatagcccccgttatgttttgctggagtttatcagtcggtagaaatctactgagcaataagaagatgtttcatagccttggtataggaatcattgcgagcttgcaggttcacccatacaaggaacttctaaggttacaagtatgtatgaaggagaatgcttcttctcttgagacataaactgtaagtaaatggcacagtcagaaggggactgtttagttattggaccttggagcaatactaagaagacataaggggccaaaatgtatatgtattgtcctgacagaga

SEQ ID NO: 614065 - DNA, 245 bp, Homo sapiens
aattcctaagtaattaagaataaataagttccaaaagaaattgtaggtggaattttaataacatttgtgaggggggtgtttgggttgccccccccatgtccttagatttaatttggggtccctttttaactcccagcgggcttattgaaggggttcttttcagatttagttgttttttcccccaaatgcatgtcatgttttttcaatagggtgtattccccccagtcaataaatgaccccccgta

SEQ ID NO: 614066 - DNA, 800 bp, Homo sapiens
gataggagcctctctccctactgctgctatacaagaccctgagagctgacctgcaggatgaaaccatgaagagcctgatccttcttgccatcctggccgccttaggcgggtagtaactggtgtgttgatgaagtcacatgaaagcatggaatcttagtgaacattggaactcgccgtatcattgaaacaggagtaaatgcagaataggcgttcgaggtatcccgctcgagcagagatggacgagcctaaagtccaagagaggatccgagaacgctctaagcctgtccacgagtctctagatagggaagcctgtgatgacgtacggacatttgcagaacgcatacgccagtggtttatggatactatgctgccctataatcgctacgttcaggaagcgccgaggggcctaacatgagactgagggaagaaacaaaaatctctgtgtctttctggaggctggcaccgtgattttgtatccccctgtagcagccttactgaaatacataggcttatatacatatgcttcttgcctgtatattctcttgtctggtgtgctccccttgttcccgccccagattgatacagtatgaagtgcactgccgtgagggtcacatggagagtcagatatgtgatgtccataataaacttctggtgtgataactttcatcttgtaatctgtttctgtgggaagaaatgggatattgaatcctgggccacttagccaaatttggagattctgccactccaattgggataatggaacacaaactacttaaagaagagaaaaaaaggccaactag

SEQ ID NO: 614067 - DNA, 146 bp, Homo sapiens
tcagtcctgcagttcctcttcatggatttgtagcctctcttccttcccctcatctggtatactcagactggtccttcagaactcagtttagggtctaattccccaaaaaatttcaattaggttcgctctctggatcccatccctca

SEQ ID NO: 614068 - DNA, 139 bp, Homo sapiens
agcatacatatggatagtggtaagccaggtagtacagatcagagccgcgtagtcgtatcgagccgcgtaggtcgatcaagccgcgtagatcagatcgagccgcgataaatcagatacgagccgcagatagctcagatcg

SEQ ID NO: 614069 - DNA, 579 bp, Homo sapiens
  misc_feature (255)..(255): n is a, c, g, or t
  misc_feature (301)..(301): n is a, c, g, or t
  misc_feature (396)..(396): n is a, c, g, or t
  misc_feature (415)..(415): n is a, c, g, or t
  misc_feature (490)..(490): n is a, c, g, or t
  misc_feature (504)..(506): n is a, c, g, or t
ggtgagggttcccagtggtctctcgatccaactagaccctgggagggcccattcactttttaaaaatggccaaaacctccatgcggtgatggcacacaacacagtgcattaacaagacaggaaacacttttgggcccaaagtgcactgaactggaagcacctcacgcagcctaaagtcagtttggaaggttccagaacatttcctaaacaccttcatctctgaatacactttaactccttgggtcccagcaaggnctctgcctggtggtgaggggcagccaggggattaagggcacggccngacctgacgctcactcatccttgggccacagtccccgcagagctgcagtgaggatcagaggtcagtgaacgtggagaaccttctgcaaacacccnatgtcagtcctgcataaanctttttgtgtgagtttcatctgcattcatacagcaaatagtggttatttttcagagtgtgctaagaatgtattantctctttagcaaannncagccataaattttgtttccaaaaatctatatcttacttgacaagtgggtggagactgcctcgccaaatgggg

SEQ ID NO: 614070 - DNA, 312 bp, Homo sapiens
tagtggtggtcatactgtgcacagtccagagttgagcacgtacgtctgtgccctggagcatgaggcatcctcgtataatgagttgtctcgagttgcttcatacgtcaggttgaagggcaggtgggtgatgcagcgttgactctcatactcctcagcatccaagtagagcatctcgagccgatcattgatggcaggaatccggcttggcccaatcaccctgccaaagtcatcagggagcttctctgccaagatatgaacggcactcatgtcacggatcggatcccgatgcaattgtgcatccacccatcatcc

SEQ ID NO: 614071 - DNA, 1254 bp, Homo sapiens
gatggagatcaggcttccagtggctcgcaagacctcttcagcgagagaggtgggccgcagagactaagacatacatctagttggtgccgggggataccatcactacggacacaggattctatgcggggccatggaacgtatagtgggatgaagagaaggctcattgcctctgttgctaggctctgtggagagagtaagcaagttgatctgtgtgaaagctttgaagaccagatccattcggtgaagtaggagacatcgtagctgggagcgacatctcacgagtagggttgcaatcgagacagaaggtcggcaaggttggcgtaggaaccaaatctacgcagtgcttcgggaataccgcgttgctgtcgcgtgtcgtctcagatgcccaatgatagctcgttcacttgagagggacgacgcatgatgcgacgatagtattctggcccgcatatgactgaggcttgcagactgaggaaggctttccttgaaccgtccacctgggggaccctttagtctggtgggcgtgacgagttcccatgggcccgttcgttttctctgcactcggtggggctgttgcatcgtaaggcgactatcgaagggagggtccctctcctgtcttgggatatgaacctcgggatctaaagaggcgagatgtcttgagttccccacgagggggtttcaccgcctcagtgccccccttggggctgcaaagagacgcggcaagcaaaagaaaaccgtcacatagggcagtgaaaatttgtacaactagtttgggatcgcgcgttacaaagctgcatttacatctagacaagcgcaggtggcctatacattgctcgggattgtcaaaacaccacaggatccctgagggcaagcataacgaaaaggtaggggaacttggcgtagagaagggtcgacacagaattggagaacaaccttcgcgtacgctcgtggtgctacttcacttcgtcgtgtactcacaggaagtagtcgtctggatagaatacccccggggggtcacgggaacacctgggcattccatccgtccgacaggaggttcagtatacacagaagggaatttaagtcgcctggataatgaacctacggcagactattgccatgggtaccgtgccatactgatagcgcaatcccccggttgcgagccttcaagaggttcgaaaggatacaccgtcattgaaagggccccagaacacttaccacgagcaaggaagcatactgcgagatcctggaaacgag

SEQ ID NO: 614072 - DNA, 223 bp, Homo sapiens
ggagctcggtacccatcgggactgaggtcacgtatccaattgatatcgcagacattgcggagcgtcttaaggtgcggttgtagacaaatccacacccatgtcgagctaaggtgaagatgacgctttggcgcgggtcttggcgtcaggcttcgactaccaccacagttggtctccatggttctcttgtgtaagtacattcaattataatattggtcaaacgacg

SEQ ID NO: 614073 - DNA, 204 bp, Homo sapiens
cttgcgcttctgcctccaggattcaagtgattctcctgcctcagcttcctgagtagctgggactgcaggcacgcaccacaacactcagctaatttttggttttttgttcgcttcctgcttctgcctgcttcctgcttctgcctgcttcctgcttctgcctgcttcctgcttctgcctccagacccttgcttcctgcttctgccc

SEQ ID NO: 614074 - DNA, 1029 bp, Homo sapiens
  misc_feature (68)..(68): n is a, c, g, or t
  misc_feature (72)..(73): n is a, c, g, or t
  misc_feature (75)..(75): n is a, c, g, or t
  misc_feature (81)..(81): n is a, c, g, or t
  misc_feature (92)..(92): n is a, c, g, or t
  misc_feature (95)..(95): n is a, c, g, or t
  misc_feature (104)..(105): n is a, c, g, or t
tcccgtctggcctttatgttcgttgtcgttaccataatcgcttcaggtgcatgccccagtctctttgnaaanncnaagctntgcctacatanaanacttttttnnttttaaccaaagttactgttgtttacagtgagtttggggaaaaaaaataaaataaaaatggctttcccagtccttgcatcaacgggatgccacatttcataactgtttttaatggtaaaaaaaaaaaaaaaaaaaaatacaaaaaaaatttctgagggcaaaaaaaggggcatcctgctgaacggtgtgtggtttattgttgtcctttcacaatcttgcaggagcgccaaaaagttcgccaagtggtgaaacagaccctgttcactgggaaaaggcctgtgcagtaaaagtgtagaccctttcatgtcactgtactgtacacctgatactgtaaaacatactggtaataatattgtctccacttggcacccgaaaacgctgggtcagaaagcaagcatgtagttttaaaactgtttcagttaaccgtttgaggggaagaaaaaaaagtaagggttttccccccaaaagataatcattgtggtaccctataaaacacctgtgaactcttttgtctccatctagtaattgtattgaaataaccccctgaaaataccttcttatagaaactgtggcttaaagctttaaggtagcagggactaacatgcaccgatagtaaacagaagtgacgtgtactgtgacaattccctggtgttcccaacatgaggtctcctcccagttacccttatatattgaacaggtccaggtggtaactgcaaagggaaccaccaattatcttggcgaatggccttggatggagtaaagggtctgcaaagctgcgctcaaccaacaaatgcataaaaggatgagtgactaaaaaagtaaatagctagcggtaagatgactgggacggtgtgacagcaatagtccttcgaaaacagaaatcatggaatactgaaaaaaaaggcgtgtgattatgtagtgacg

SEQ ID NO: 614075 - DNA, 464 bp, Homo sapiens
ctactactactaaattcgcggcagctcgaccaccggtgatgatcgtcgtcgtacccacgacatgaacaccgccaactggatcccagacctgttcatgaagcgtgtcttcgatgacggcccgtggaccctgttctcgccatccgaagtgcccgacctgcacgacctgaccggcaaggccttcgaagagcgttacgagtactacgaagccctgtcccagtacccgggcaagatcaagctgttcaagaccatccaggccaaagacctgtggcgcaaaatgctgtccatgctgtttgaaaccggccacccatggctgaccttcaaagacccgtgcaacctgcgcagccgcagcagcacgtgggcgtggtccacagctcgaacctgtacaccgagatcaccttgaacaccaacaaggacgagatcgccgtttgcaacctgggctcgatcaacctgcgtcgacgcggccg

SEQ ID NO: 614076 - DNA, 231 bp, Homo sapiens
gtgcagaggggcagggagaggcaagagaagcaaggaagaagctatgcagttgatcaagtaagatattcggatgtcatgaagaaagcagacttgagagagaatgaagtggaatagatgagttgtgacctcctggagattggagaggcactggggacccatgttgggagtccaggagggagagcaaggctgtcgggcgagtcggggcagtcggggctgtcgggctagtcgggg

SEQ ID NO: 614077 - DNA, 421 bp, Homo sapiens
cggcacgaggggtaaaagtagcaaacaaattcaagtgaccaccaattttccctcagaagtctcagaaacttttattcttctgatcatttttattctctcatcttgcatttaacaaatattcaagtagtctataagcctatagtcttgttgtaacacagcaacaaaatgtgaaataaatgattatgaaagatgacctggaaccagaaaaggattaaggatctttgtgcttcagttctgtagaatttctgtttctttaaaatccagttcatctatctctacttacctttattttgttcttctaggacaaaaccttgatctttgagtcagaatgaaattacagtaaacagactatttgtctccacataaacacataccaggtctatcaaaggctaggggatctactctgatgttggagcggccg

SEQ ID NO: 614078 - DNA, 156 bp, Homo sapiens
caaagggtatcatctctgcctctctgctgatccccatgttcgtcatgggtgtgaaccatgagaatgtatgacaacaggctcgatgatcatcagcaatgcgctcctgtcaccagcatactgttagcacccctggccaaggtcatccgatgtacaact

SEQ ID NO: 614079 - DNA, 619 bp, Homo sapiens
  misc_feature (180)..(180): n is a, c, g, or t
  misc_feature (182)..(182): n is a, c, g, or t
ggtgaatggaatcacaagcaactttgaagaattgctagagattgctcagctcactgagtcaggacaaaggtcgttcgtaaaatcatagattgttggctaaaactagcagatttggtactgaaccgatggcggaaatcacacagctttcttagcccaagtttgcagactaggttctgggtnanggcgcgcagccgcagtcttaatgggaagattctagaagtaagagaaccatggaagggctgagatatgctgcccacccctctctgcctgtctgccacactacactatgcaagtgtggggagacccaaggcattctgataaatgaaagccaacacagacttaaaaactgtatgcaaattcaaatgtgtttctcaacccgtgaacaactcaactggaaggttagaagccttacaaaataaaatatctgattgcaacccctgtccaaatcactggaactgatcatcaaaatctacagagatagaaacaaccccaaggacctaaggaaaaaaggaaaacaaaaaagggagcataacacatcaacagttgagcttcgtagaagagatgaggttttccagggaagcttcctaaaaatagtccaacagccctgaggaaaaaaaaa

SEQ ID NO: 614080 - DNA, 151 bp, Homo sapiens
cagatataacaagtagtacctactgggtacatgagagaggtgtctagtgaagttttagggcgctatactgctgtatatactgtgttttgtcccacaccgcaccgactaggcagtgacgagtaacgggacatcttatcaactgcagctcaca

SEQ ID NO: 614081 - DNA, 320 bp, Homo sapiens
gaggattccgagtttaaagcgggcacaggaggaggcgagcgcctaaaggctgaccgtatggctgtactgggggtctaaggagtgagctggagagacaggcgtgtggatcagataaggagcctggagtagctggctgcggagcttggagaatacactgtcaagattgccctcctggaataggcgcggtggcgcaaggaggatgaagttgaagagtggcagcacaggggcgaagaagcccaggatgagcatggtgaagatcacggaggagctgcccctggtgatgacagcatccctcgtccccaccaccccgcttaaactcg

SEQ ID NO: 614082 - DNA, 481 bp, Homo sapiens
aatctcaaggaaagagctttcaatatttcatcattaagtatgttgtttgctgtataatgtttataggtttttaaaatcaaaattaagaaaggtcttatctacttcttatttgctaaaaatgagaactgaagtttatcagagctttttctgcatctgttgggatgatcatattttttttcttttattctgttttgtggtgaattacatcgattgatttgcaaatagaaaaccaaccttccgctagataatgattaaattgctgaggatagaaagcattctgaagagcaaggatggcttcttgttcttggtaggggcaaagaacttattactggagaccgaagatataagatacccacagttttctgccactgtctaatacttagcaatctccagaggcaagaaatttaattatcacacctgcacttcatgtcagatgagcacctacccagccaagaaatcacaggggtagagtaactgcaga

SEQ ID NO: 614083 - DNA, 998 bp, Homo sapiens
aggctggtcctggtcatgggtttaatggatcgagctggtgagcgctgtgcctgtgatgcctgggatgcctgagcgcgccggtgctggggtcggggccggagcggatgctggagagtggagcgcgccctggcccagccccgagtcccgccgccttccctccctgccgcagctgcgggcccaccggccgcgccccagccatggagcaagacaacagccccctgaaagatccagttcacggtcccgctgctggagcctgcaccttgatccccgaggcggcggagcagattcggagagcgcctgcccaccgcctgccaccctcgttgctgaccagttgaccagtcatccccagagatagatgaagaccggatcccacaagaccagcatctcaagagctccagcatgatggttgaacagtcacactgtgtgtgcaaccagcaagcaaaggagaggaacctgtaggtgggccgctgagtagccacagtgaatccaatgagtcaccgaccaccctgtgagatcccagacacagaagtggagtcaaggctgggcacctcgtgggacagcaaaaaaaactgacagaactgcatccctaaaaactcacgagtagaggcagtaaggaaccacagcagcaaaaggaacccatcaagccaatagttacacaacccagatactgataacccaatggtgacagcccaactacgaggcaagaacaaacaagagaggacaggtaatctcagaggaataccaaagacattgcaagactactgagagaacatgcacaattgaggaacacaacaagagaaaatacatgaaatacattataattaccaaaatcagacaacaatataagcaggagacaaaaaatcagtcaatcaggtacattaaagaacagcacaggcaatacaatacaaaggaaagaataagactccacaacggaccaaccaaacacagaacaaatataccagcacatggagcacagcatccaccacaatcatccaatg

SEQ ID NO: 614084 - DNA, 399 bp, Homo sapiens
ttttccacatcctctccagcatctgttgtctcctgactttttaatgatcgccattctaactggcgtgagatgatatctcattgtggttttgatttgcatttctctaatggccaatgatgatgagctttttttcatatgttgttggctgtatgaatgccttcttttgagaagagtctgtccatgtccttcacccactttttgatgttttttttttttttttgtaaatttgcttaagttctttgtaggttctggatattagtcctttgtcagatagatagattgcagaaaatttctccaattctgtaggttgcctgttaactctgataatagttttattttatttatttattttttatgaaacagagtttctccctggttcccaagatcaagccattgtac

SEQ ID NO: 614085 - DNA, 1698 bp, Homo sapiens
aaaatttaagaagtcgaagtaaattcactttgttctccaaaatgccactgaatatatactatttaaaaattctatttaagacagtgagaaacgttttttttttttaagattctccttaaagagtctctattatagttacacaatatcaagacatgcatgtaggtctcgatcacaagttaaacattttaaactcatttttaattgacaatcttggaatgagaggtcacaaaagggcactaatttctatttttcaactgcagccaagcaaaataaacatgtgttgtggctctatataccccactctttaagctacctgccaggaagaagaatttcctcataaatactaagcaactttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtca

SEQ ID NO: 614086 - DNA, 165 bp, Homo sapiens
ggatcacagatgaatctgtgccttagtgtgggattacagggtgagcatgtgtcggccatacttctttattattaaaggtatgatcctgtttggattctatcagtagtgaaggcccgggatactgaaatgaaaatgtatgcaggtgttatataaatgtctcattcc

SEQ ID NO: 614087 - DNA, 473 bp, Homo sapiens
  misc_feature (2)..(2): n is a, c, g, or t
  misc_feature (65)..(65): n is a, c, g, or t
  misc_feature (70)..(70): n is a, c, g, or t
  misc_feature (122)..(122): n is a, c, g, or t
  misc_feature (186)..(186): n is a, c, g, or t
  misc_feature (207)..(207): n is a, c, g, or t
  misc_feature (221)..(221): n is a, c, g, or t
  misc_feature (224)..(224): n is a, c, g, or t
  misc_feature (253)..(253): n is a, c, g, or t
  misc_feature (319)..(319): n is a, c, g, or t
  misc_feature (321)..(321): n is a, c, g, or t
  misc_feature (325)..(325): n is a, c, g, or t
  misc_feature (331)..(331): n is a, c, g, or t
  misc_feature (334)..(334): n is a, c, g, or t
  misc_feature (347)..(347): n is a, c, g, or t
  misc_feature (368)..(368): n is a, c, g, or t
  misc_feature (387)..(387): n is a, c, g, or t
  misc_feature (389)..(390): n is a, c, g, or t
  misc_feature (421)..(421): n is a, c, g, or t
  misc_feature (428)..(428): n is a, c, g, or t
  misc_feature (437)..(437): n is a, c, g, or t
  misc_feature (447)..(447): n is a, c, g, or t
  misc_feature (452)..(452): n is a, c, g, or t
  misc_feature (454)..(454): n is a, c, g, or t
cnggttgtagacacagacaaatattagttaaaccagaaccatgtctacacagaagtgggcaatgncatgngccattctatggcacacggtgtgcacttaatcatcatgttttagcattttgntcttctgcttatggcgctcaatttccttctgcagacgctcaatctccttcttatgatgaacganttcctcttcatggtgtttttncaaagctgccagtngtnctctactctgtgctctacaaggacacggnggctcagggtttaatttcaatccttcaccccaaagacatctcaaagcataacctgtaatgtctaancnaggnataggngtnccaattccatggnagtctagctggtcatcctctnctactcctcaactagtganannctaccccatcttaaattgacgtgtaggcatnttaagangaggaaagnccttattgcnttcanantcctctttaaaatagaaaa

SEQ ID NO: 614088 - DNA, 193 bp, Homo sapiens
ttacatagagggacagcaagaggatgcacggttgagtatttggaggtggtatatttggccagactttatcccgcatcgattatgctatttcttgctggacttgtttagacagctcttctgcagcagagtgagcccatttaaacaatatccggaggtaccaccattaagagtgcaacagagttggtagtcacaa

SEQ ID NO: 614089 - DNA, 171 bp, Homo sapiens
  misc_feature (84)..(84): n is a, c, g, or t
  misc_feature (112)..(112): n is a, c, g, or t
  misc_feature (143)..(143): n is a, c, g, or t
  misc_feature (151)..(151): n is a, c, g, or t
ccatatcattaaacagcctgttaagaccaccccatttttgtagggagtctttatctttatgtatcataaaggaaaggaatgccngggagttttaattcaagttcaaggccantcaacagcagtaggtacttaagagagagttncttggagntaaaggtggccacttcctct

SEQ ID NO: 614090 - DNA, 303 bp, Homo sapiens
aggatcctcgctgtcttctcccatcagagatcaacgaccttctagtagagtcgcgaatcaactgaattttccactaactgaaggaggatctacttttatatgaattgtagagctgcctacttaactggccgcaaaatcagaatggaaaacattatttctaaagatcaactttacttagctcttcagcatgcaggaagaaatccatcccaaaagaccattaataagtattggactcctcaaactgccaaactgaattatgatgatttttgtataattttaaggaaggaaaaacctacttcgaaa

SEQ ID NO: 614091 - DNA, 328 bp, Homo sapiens
aaaagccccccccccaagaaggggaaaccgtttgttttttacctaggggccttaggttctttctgcccaggattttttccggcaggttttccccctttaaaaatttaggcagggaggcccttccatttttatattaggcccaaatccggtctttttctttgggttttctctccttttaccctcccctttgggttttggggtcccctccaaaggttgggtttgggggaaggccccccctttcccggtttttaaccggtttgttttgtgctggggtttttaaaccggggccgggcccccggtagccccccattaattttttttggattga

SEQ ID NO: 614092 - DNA, 728 bp, Homo sapiens
ggagttgcaggttgtgggcgacaaagtgggtaaggtcgccgtggcggttcactgtgccttcgagctccaggggcactcggagatggtggcgcgggcggtccgtcgccgcgcggccggactcggcacatccctgtaggacgccggagccaactcggagcgaccatcgccttgcagtccacgtcgcaggcgtgcggcatgtccgtgaagacgggctggagaactgatgcggcctggctcgtagcattggcgctgcggcctgcacttgctcttcagatcggtgggtcgtatcgcgtctctcacgtggtcttggcatcgaagcaattcacatctcgcggccaggccgtggatcccaccgtctggactggggctgtgccgcatcccggggacggagggggctttggcgcgcatcttgggggcgcgagatggcccgggggtttgcttgctgtgagcccaggagaggtggaccacagggaagacgggttgcgagattgtcggtcctgagacgattccgagccagggacgacacccccctcacattggcgggggaatacctcgcggggagacccctctaagagaaacggacggaccggagacgcttcggggtctggtaccccaaaaactggaaaccttgaggtgggcgaccctttggaaatctggttttccacggggttttgaaccaggggaccccagggcaaaggtgggttgcaccggggtacattccagggggg

SEQ ID NO: 614093 - DNA, 826 bp, Homo sapiens
agcgggtgacgccgcgcgcgcgcgccgcaacacctatggagcagccgtgaaggcggctcgttgggggctggggcggaagcgccgggagtgggggcggaatgggcggcggggcggaaggcagaggctgccggggcgcgggctgctgcggagaaggggcttccgatgagtccgccgcgtggtctgtcgccggcgcgggattgggcgcgagccatgggcgcgctctcctaaggcggagtcgcgggcgggagtgggaggagggcctgagaaaggcttgcgtgcgaaggccgcggggaccgtgactgggcgcgaggagggccggcggcgggggtggcaccaggaccaccatgtagcgctcaggtgctgcagcccagtcaggaagaaagctggcgggagagagtcaccattgctcaaagaaccggggcggtaggcagttgtcagccgctcttagaggaatcaaaggaaggcattgtggaaccccgatgggaaaccagccaattaaatggaaaaaagcctgggaatcttgctgttcgacagcttccattagtccggaacaattccatgttgtagagaaccccggcaaagaagcgagtcagacggggttggcagcgaagtaaccggaaggaacgatgaggaggctatctgcagcagtgtggcgtttatattacacttacaacatagtgagagaatgttaactggacacaagcgggagccggaggggcagtggctggcgaacgatgagcgaaggccagcgtgaggaaggacgtgagagacagcaaggacgaagaaaaacaacataaaatacgcagagaacgaaagaaacttgtga

SEQ ID NO: 614094 - DNA, 283 bp, Homo sapiens
acggccgtcggacgaatcacttgaacacaggaggcagcggttgccgtgagcggagatccaccattgcactccagccccgggggatcagagtgattctcctgccttagcctcccgagtagctgggattacaggcatgtgctgccatgcccagctaatttttgtatttttagtagagacggagtttcactgtgtcggccaggctggtctcgaactcccgacctcaggtgatctgcctgcctaggcctcccaaagtgctgggattacaggtgtaagacatagcgcc

SEQ ID NO: 614095 - DNA, 175 bp, Homo sapiens
gcccccccggaaaaaaaaaaaaaaaaacagggtggggttaaagggggggtccggcccccccgggctttttttactgtttggcccccctttggcaaaaaaaggggccccccccccccctttttgtttttttgttttttgggctttttttaataaaaaacccccttggttcggccca

SEQ ID NO: 614096 - DNA, 109 bp, Homo sapiens
gttgactctagagtatccccacgttgacacttcaggatatagagtagagaagcagaatagaaattatttgctattgggagtttccacagcaggtaggtataaagataag

SEQ ID NO: 614097 - DNA, 113 bp, Homo sapiens
atcatacatattaaaccagcaagggtggagtccatctataaaactaacaggcatttggacacacatacttggcatagaacctggacacatttatcaacacggtagggaacgtc

SEQ ID NO: 614098 - DNA, 582 bp, Homo sapiens
  misc_feature (487)..(487): n is a, c, g, or t
tgagcccccccccccccccccccacaccccagaaaagccccaacccgaataatccacgaccaaaaacataccccacaaacaacccccttacagatccgaccgaggaccgccgtaaatcccataaaaagacatatcgtaataatagaccaaagaaaccataaaaaacacagtcacattttcacccaaaaacataataccacatactatatagtacccctcccgcgtaaaacgcccaagggaacgtcgcgccaggtacgctaagtacatccgtccagagggaagcaaatcccaacatagccatcccgtacaacagcacaggtacagtcaaaacaacggaccccctttttcagaagccaacacactccagagcctaataccccatccccaccccgcaggaccgaaagtcaaatccagtcccacataaacacacgcgcgcgcgcgcgcgcgcgcgcgcacacacacacacacacgcacgaaaataatcacncgaccctataccgaataaacttttaatgcccccattgcacccctagagaacggggctcttaaactagctcgggcatacccctctccccaaataat

SEQ ID NO: 614099 - DNA, 746 bp, Homo sapiens
  misc_feature (553)..(553): n is a, c, g, or t
  misc_feature (676)..(676): n is a, c, g, or t
tggaaatggagtctcactttggccgaggtgtagtgacaaggggccatctcggctcactgaaacctcgggcctcccaggttcaggcaattccccgcgttaagcctcccaaggtgggctggggatatacagggcacggcgcaaccatggcccagggtaatttttttatattttaagtaagagacgggggttccgccggtggttggcccagggtgtgtctccaactcttggagctcagggcagtccaccttggcttcaggctcccaagggtgctgggcattggcaggcttgtgagcacaccggtgccgtggccttacccattattatatttccagcactccagggggggctctggcacggcagcattatataacctacacgtctccaaagggtgattcgggcatttccctcatctccttggacggttacataaccggggaattccatctctaagaaagagcagtccctacagctttttccccttttttctttttgggaaacagggtctggctcccggagggccaacagggtctggacctgcgacgggcgtccaaancaagggctcaaggcgaaggcctcgacctccgggggcccaggtgggatcctcccaatcatacaacgactcttgataacccacgaaccacagtgtgtgctcacccatcaattgcccaggtgactntcggggaatcccgcgaccaatgggggttccccatgtgtgccacagggggctccaaaattgcagacccatg

SEQ ID NO: 614100 - DNA, 943 bp, Homo sapiens
  misc_feature (60)..(60): n is a, c, g, or t
  misc_feature (92)..(92): n is a, c, g, or t
  misc_feature (235)..(235): n is a, c, g, or t
  misc_feature (251)..(251): n is a, c, g, or t
  misc_feature (253)..(253): n is a, c, g, or t
ggtggccgtgtgtgtggagtgggctgcagcgtcaggcggggcgggctggtggcctggggnccccagaggctgctgtctggatcctgggctgntgcccaggatggggctcccgcgtgctcttgcgctgccctctggtggccgctctgggtccttgcaccccgacccagggccagcctgccctgtcctgtcctgataccgaggtgggagccctgccttggccagggtggccgtgttnacggttcttgggactntnacattggaaggcgaggcaggtcaccagcactgtcctctgcaggatgggctgggattcatttggcagcttctcagggcctgtgtccggctggttggtccctgtgctgcccaaaccaggtgtccacatttccggctccgaggcgcagagaagggggcaggtggtggcttgggtggaggaaggcaccatccatcagcccagggagggagggtaccacctgggcacctggggctggatgtgagaggcctggaccagggcccgccggagggcgtggaccagatgctcatgtgttcctgggtgcagtgtctgtgttgggggctggccccaccctgggccagggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttttcaggcagccctgcctccaagaccgacagatggctaagggggccgcagacctggctcccccagctcctgtgtggagaaagggcaacagctgtcccggatggttattctctcctttcctcaaacacatttggaactcaagtaaatccgatgcatgttgggaaaaaaaaaa

SEQ ID NO: 614101 - DNA, 382 bp, Homo sapiens
gattcaggatcttcccgccgtacagttgcgggctaccaggtacacagtgcactgggaaggcgcaggactctgccaagaaagccgggtatcgtccaaggtttctctccactgagacatgctgagatatggcctcatgggaatggaaagacctgaccgtcccccagacacccataaagggtctgtgctgagaaggattagtgaaagaggaagtgctctttgcagttgagataagaggaaggcatctgtctcctgctagtccctgggaatggaatatctctgtataaaacccgattgtacattctatttactgagataggagaaaaccgccttatggctggaggttagacatgctggcggcaatactgctttcagtttttgggaa

SEQ ID NO: 614102 - DNA, 292 bp, Homo sapiens
agaatcgtggtgctgctgatgagaaacaggatgctgggggaggatggaggtagatggccgcctggctttagggggtctctggctgtacgaccatcatcttggataccgactatcatcacgcgtggtctaggtagagagctcctgtcacgacggaggtctctggggtccctgatcgggtcgctgactatgagtccatctacatctggtatggtgaaagtaaagtctgcatagtacacatcatatatctgtgctccgagctgagctcagagcccggagcaccacgaactcgccg

SEQ ID NO: 614103 - DNA, 978 bp, Homo sapiens
  misc_feature (32)..(32): n is a, c, g, or t
tgtcggctgtggcgccacctcgtttatgtctncgtctcctttgagtgagtttttggcgagcgcgttgcccctactctcgtgttgtccaccctagccggggtttggcgtgtgcccttagttggcgtgccgccgagttcgtggcggtgccgctgggtagacgcgcgacgtcccacgagggctgccgccccgtttttgaggggtgtggcctctcgtcggtagtttgtctgggacctcccgcgccgccgaggctgcccggtgtccgccccccaagggcggggtgcacgctctgcccaaacgtggggggtgttctacgccctcgtatacagtgccccaagcatggttggccatgtctactagaacaatgtagctaccccatacttgatgtcggcccccaggaattctgcgtcgtctggatatgtttttttcacgggcaaaagtgtgtcgcgagaagatgtcctgctggaaaaagtgtgcccccaaccacagtggcttcttggaatcgtagttaacaccaggagagccccaaatggggttgacatcggtaccacgcagtcttacctgatgatgaggtctccgtgttgcttcaaagtttgggaaaagcccatcatgaacgggtgatcagtcacaacaaaacgggggggaataatctccctggccccccaaatgatagacttggcaacttgtacgcccccacaggtgtttaattgcacgctgtctgttcaatccccgcctcctatgttggtcctcgcagtatgcagattgattcctagaatagcgtcgtgctcgaacaaattaaatcgccgcgagtgttaggccgccaacatatatacgagaaccaaacgaataggtatttctatgggatcgagatggtgagatgacaacccgcctccgtcttttcggaccacccccgcttcttgagaataggccgtgatgcaaaaaagtcccaaacttacaatttttttacaaaaaaccaaaaca

SEQ ID NO: 614104 - DNA, 371 bp, Homo sapiens
  misc_feature (48)..(48): n is a, c, g, or t
tacgaatactagtagctttgatttcattcctgaattatgaataatgtngaataatcgtgcatatgtttcctggattctttttgtgtgtgtcctaatcaatttctgactgtccacctagttaaagaggagctcttggagcctgtttgaggattctaggaaactcatggagtctctgttccatggattcgctcacccaggttcacagctgaagcaaagctattgtttcacctgcggcagctgctgaaggagctgaagggattgagtagcgtggttaaatatgatgaggaccttctgttcaaaggggtggacctgctgaaggcccaggtcacagagctgctacagcgcctgctccacaggtctagaggagtaat

SEQ ID NO: 614105 - DNA, 533 bp, Homo sapiens
atagggagctggctcccctgatagccatgctgagagtcatcagcccagtcttctggcaacagctctttgaccatctctttggacaggtggtcagcctgcagaatgggggtgcgacgatgggctacgagccctcctaagctgcttacaaattggaaaagtgtgggcggaagtgtggggctcacgccttggtaaatcccacctagttatgccccaggcccatatgggaggagggatcggtggaaacccaactatgtcgcaccaacaaccgaggacaacatgatagagcacccttgtatctagcaccacatagataattttgttaaactaattagcctagactgtattgtagcgctcactgccgttgttgtgtccccaggcttgtttgggcgcgcagggcttgcatagttagagagcgatccatttatggctgtagccagagtgtcgcaggctgcgagtccgagttcgctgcattgtgtaattgcactgcaacggtcctaggacttgggttgcacagactcgagtagcctgtttca

SEQ ID NO: 614106 - DNA, 872 bp, Homo sapiens
  misc_feature (872)..(872): n is a, c, g, or t
agaagttgtaagtacagtggcaaatgcttatacttacttcgaactgtttcccaaaataagtgcatgtatgttgacaataaaagcttaagggtgttcatgagaagggcttgaaaaggtactctagaggaaaaaggtctaaagaaaaaaaaaattcaagaaagtttacattagattattgccagtgtgtgagtaaataaagaatgtgtgcctcgtttaactgtgtaagtcattgtttaaagaatatgattatggaagcacgatttatttaaataggtacatgagactttgtggtctcaatgtcctgatacattaggatgacacgttaacatcttaaatcgttattagtcgaatggtcgtaaggccggtgaggtcgggtaccgagaggtgactttggggtagcagtgtgggggttcattcttttgcaaatctattttggtttaaaaagaatagcaagtgttagaaaacaaagcattagaaaaaaagcctatcagtatcaggggcaatgtgtagatgagtaagtgtagtatgacatcctttatttccaggtgaaagggtctggctgtcacgggtgtagtccgtgtgataacataatgacgttccgaatgtaagtgcatgtaactatctcgacggatttcaataactggtgaaaaatgccaaccgggtgtggtatgctcgggagaagcgtgaagggtaacgagttcatcggaaggaagagggtgtacgcctagggcgaagttggtgcccgtttgactaatttggcaaactgggagtggacattgtaggcttttatgacccggtgacaattgggccggtataaggtggtaaacgggagagggggggggcaccacgcacgaaaattggcaagcgccaan

SEQ ID NO: 614107 - DNA, 175 bp, Homo sapiens
  misc_feature (144)..(144): n is a, c, g, or t
cgggggtgactcaagtctcagtagtgggggtgacggactcatctctgtccgctggccgcagacctcgttactggtccccgattagatgccagttttctcacactctttccttatcatgcctcagtgccccacccccattctagngctgagaccgttttaggccgaaagtcaatag

SEQ ID NO: 614108 - DNA, 179 bp, Homo sapiens
atgagggcagcatgagagaagaaaaggagcccgaacgacaagagagaggggatcataggctcctcccacatcctcacccctacccgcttcctggacgacctcaagatgctggaccagaagctggaggacgtgcccctgccatgaccatgaccttgaccctgactctctccctgtccaga

SEQ ID NO: 614109 - DNA, 1463 bp, Homo sapiens
tggaaatggagtctgtgctcctgtgtgcccaggctgtggagttgcaggtggcattgactcggtggctcacgtgcaaccttcttaccttcccgggtttcaagcagttcttccgtgcctcagccttcccaagtatagcgtgggacatacaggcactttgccaccaacaccgggcataatttttttgtggagtatttttatagataaagcacggggttttccacccattgttgtggccgagtgccccacgctcgtagaaaaactcatgtgaacaacaaaaacgagatgaaaatcaaacaaaaaaacataggaaacacacaaaaaaaaacaaacagacaaaactacaaaagaacaatcaaaacaacacaagacaacaacaacacaaacaacgccacaaacacaaccaaaacacaaccacaaaaacatacataaacacacacacaaaaaaaacaaaaaaaaaaaaccaacaacaacacacacacaaaacaaaaacaaccaactactaaccaacaaactaacaacaaaaaaaataaatgacaacaataaaaaataaaaaataaataataacaagaaataaacaaaacaaaaaaacaaaaaaaaaaaagaaacaacaaaaaaaaaaacaataaaactataacaacaaaaaacaaaatgcaataccaaaataaaaaaacaaacataaaaatataacaaaaaacaaaaaaaaaaagattaaacaaaaagagagtaaacagaacataacacaattaataaaaaacaaaaaaaacacaaccataaatcaatacaaaacataaaaaaatataaacacaaatcaaacaagtaatacagcacacactacaacatcaaacacaaacacaacaactaaaaaaatatacaataaaaaaaaaatatcaacaacaatagaaacaaaaacacagagaagcgcacgaagctagacacaaaccaccgagcagtagatagacattacaacagaagcacacgagaggagagaagatgacacagatcagacagacgagccacgaacgaagacagagaacgatgtgaaacgaagacgacacaacgtaaacaccagtaaaaagcgaatgaaaaatgcacagaacagcgaacgacgtagccaagcaaggacggatcaatagaatacaaaaaaacaatacataaaataacaatccaacagaacataacaaacaaagaatactacaaaaaataaacaaacaaaaacacaacaaacacaaaaagaatagagaaaaatctaaaaatcacatacaacaaatcaaaaccataaataacgtgacaaacacagacagaacactagaagccaacactatacgcattagacaatacaacatcactaaaccatactacaatgactatagaatatatgacataaactaacaaaaaaagcaataataatctaagaacaaaacaataaacatcaaacacaaccatagcagaatacaacacaaaca

SEQ ID NO: 614110 - DNA, 568 bp, Homo sapiens
gcttgtctggtcacttgcctgttccaagcccaatgtgctcacttcgcatgttcacatgaacactcagctgtgttgtaggcatgctgggcatggaatgagaaggggaggccctgtgctgagttaactcggcgttgccacagaaaacactggtggtggtgagcgaatgagtagactggtgagagcccgaaggcgctgggcatagttctgtaggagaaagctgtccgtcaggaggtggctgacagggtgggtcacgtcttatatgttggccctccatcccaaggccaagggtggggttcctgaatcccaaagccaaggcggggtgacttagcacggaggtccccacagatatacaaacacacgttggtgcattcacagggacactcagatccatggtagggaaacatgcacacacagattcactgacaccaacacacgtgcaaagatgaaggcacgtgtactggccctgtggccccagcaccaacactcgcccagcctcccagtgcagagtgagggaagggagacatcgtccatcccctgtctctctggagagcaggtagagccgaggggg

SEQ ID NO: 614111 - DNA, 459 bp, Homo sapiens
cggccatctatcgatattagcgaattccctatgtgtatgcttctctttgcactgggaagcatagacagagacgcttaggagttggcctgtattcatgggcagtaggaagaaagatggttaaatagtgccaataggccgggcgtagtggcccacgcctgtaatcccagcactttggaaggccgaggcgggtggatcacgagggcaggagatcgagaccatcctggcttacatggtgaaacccggtctctactaaaaatacaaaagattagccgggcatggtggcgggctcctgtggtcccagcttgctcgggaaggctgaggcaaggagaatggcgtgaacccgggaggtagagcttgcagtgagccgagattgctccaatgcactccaagcctgggcgacagagcaagactcccgtctcaacaacactacattaatacataacatcaaatagcgccaat

SEQ ID NO: 614112 - DNA, 215 bp, Homo sapiens
ggtggtcccacgcacggagaaggtcctcacagcaaagaggctggcgctgggggcgccccagacctgatgcctgggtgtctctccctccacaggcaacatcatcggctcgggcatcttcatctcccctaagggggtcctggagcactcgggctccgtgggtctggccctcttcgtctgggtcctgggtgggggcatcccttctccggtggcgtggt

SEQ ID NO: 614113 - DNA, 736 bp, Homo sapiens
agagcatttgatcgcctacaagaagttccccatgagggtccaatgtgtgatttgctgtggtcagatccagatgaccgtgggtggatatgtgaagtgtatatcatccatcggagtggagctgtgtgtgacagcatattgggtcgagaagtatatgttacgtgagaacatattaaatcaattgcgcatagtgagcacgtcacggtgagagtgttcttagaagcatcgacacaatgcatatgtgatgggtagggatagtaatctgggtgccgaatgacgcgagaatgtaaggtaacagcattttcaagttgcatccaaaatagttatatgtttatccgctatgtaggggtgaaaccaaatgacttcgcaacatcattgggaaacttagtagggagacatcataacatagatgagtcattttggtgtgcaaaggtttgtggacactctaggaaaacgtcaggtaaaccaagggagaatgcgcatcaattgttgtaaccctccgattcggtaatcgcgccaaagaaacttaactatttttctcgtggtttacaattggaaaaaattttttctcataatatcgtgttgattgacctaggtttaatgtggatccgagtgggcatatcccgattagtttattcagtaccctaaaaggagtgtagcaccatgggtgagcaaggatggcgaaagttaggtagacttgctcgatagaaggtggtccaggaaaatagtaagattatgc

SEQ ID NO: 614114 - DNA, 945 bp, Homo sapiens
gagcggggacacactgtgactggctgcctgaagctagtgagtcgcggctgccgtgcactggtggttgggtcagtgccgcgcgcggattcggctcgttacctgcgatgccgccttggtggccttcaggctggacggcggcagggtcagcccgtggttcgccggctttctggggtcttttgaacagccgctgatgtccgatcttcacccccgaaccaaccaagatcctgcctaaccaattgtgcgccagtggtacggactgaaggctgtgccggtggcaagcgctttcggaaatctggcctgctaacaaaagacaaggtcgtcgtggcttgggctgccagcgggccgttgccacgcacaaggagccttcgaagtggaaacgttacatggcagtattcgcacatccagcgtgtacgtgtcacagtgcttctcttagcaagggctccaggtttgccccaaaacatatggacgagaattcgtccattcaagttgcgtctactgccgacaccagggacagtttgcaccccgaacaaccgtgcgccaaacctccgtggataacgtccgcggcacatacttcggatcggttactccgtgtgcacgcacacggctccccacgcggccttcttccacggtaatttgagaaggcgactaactgttacgcgagcatcgcaactatgactttgtgtcagcccagcgcagtgtgtttacagccgtgtgcaccccaatttgtgccccagaacttatatttggggttggcggcaagtgtaaccaataacagtgcgcgcgcttgcaatattccgctttgggaaatcctccctatacacggcaagctaacgcaatgttagccaatcccccggttagggaactgtcccgtttcataatttgtggcgccggtaacgggatatgtccctatattggcgaaagatgcgtgcagcaacattccgccga

SEQ ID NO: 614115 - DNA, 206 bp, Homo sapiens
agctgtcaggctagaggatcccttcctgacagcaggggtgctggttcctaggaaagtgtctgtctgccctcaaccagcgtaggaatcggaggagaaagccggagttttgacacttgccggaatgtactggagctgatttattggcagactctgacctggctgggggtgctcttctcgcacctactacccggcgtcccaagcacagg

SEQ ID NO: 614116 - DNA, 842 bp, Homo sapiens
gcaggagcgctcggacagcccgagatctgccattacgatgaagagctttcacaagcactcgtgcaaccccaagctaacacgcactgtggcctcttcggggacccacagctcaggactttcagccgacctgcttccagaactgcaaggtgcagtggcgcctgtgccgctcatcgacaactaattaccatgcacgtgcaggtcacacaaacacgaccttgtgcttgcccgtgctcaagcgtgcccactgggcaccaggcacagctcaccatcgatcttcacagaaccttccagtgacgtgtgctggaaccagaaacgggtggtaccaagtgctagaggactgcgacgacgcatccacgggccgacccttcggtgggacttgggctcctaacgaacacggggtgagcggaacacacgcgacagcgcggaccaaaacatggccatggacacgaatcgacactggacgcacacgggatggtaccaggggcacgagacacagcgcttgggcaagccacttcccaaggggacaccagcagcgtacccaattcggggaccagcccaacgacaaatcagcctgcgattggccgaccccaagaggctagagaggaccccgtgcgttcaacaccgtggaaccccattatatgggccacagggttcccagacaacattggagccccaaatggaaaaagtggaaacaaggggttggggggctcccgacaactgttgggcgagttggaatgagagaacagggtggaaacagatattaggggaggagaaacagagataggaggcgagccaaatgaggggggagtatcgcgttccctggttaacgcgacgcagttgag

SEQ ID NO: 614117 - DNA, 251 bp, Homo sapiens
agaaaatgtcatgtgatgtctctccccaaagtcatcatgggttttggatttgttttgaaaatttttttctttttttcttttccctcctttatgccctttggggccttgggaatacccagccaactctcccccctcaatgtaactccatgggcattgctgcttttgggggggttatttaatttttgtgatagggaaacaaatttttttgaataaaaataaatacccaaccaataaaagtttattgagcccca

SEQ ID NO: 614118 - DNA, 339 bp, Homo sapiens
caaataaccgatattccatctgtgcacactcatcccagaccaggccccttacctcttctgggagtcttagacctatggtcaaaatgttattgctcctatccccgatacacagaagaacggggaaagtctgtttccatgtgttccacctttacacacctgtaaatgtcagcactatcaggggcattgcactaagtaataggccgtgctacttgaggacaaactgcatattaagctatttaagacgatgtagaatcggatgtatatatacaggctgtgctacacgttaaaatatcatggtagtctatgtctatacagcaagaacatgtgtgtgcatacact

SEQ ID NO: 614119 - DNA, 178 bp, Homo sapiens
cagtcggtaggatacttgtgttagtagcagaaagtgagtacagtggggattgaagaggaagctggcacaagtctgtctggtggagggcccagctttccctgactagcgctgagacgtggggcaagtcacttaattctctgtgctttgtttgcctcatctatgggcacacattatggag

SEQ ID NO: 614120 - DNA, 110 bp, Homo sapiens
ccctttttttaaaagggaaaaggggaaacaaaaaaaaaaattaaaccttttttttgggttttttccccttccccgggaccttaagggaaaaaaaccccttttccaaggga

SEQ ID NO: 614121 - DNA, 237 bp, Homo sapiens
accaggcccagggattgcagcttgagctccccaaggcccagggcacccgggtgaggactttgtcctgtgtcccctctctccaggtgtccagctgtttcatccctttttgtcctgtcctcagctccccgtggggtcagcgaaaccattgttttttgttaggactcagttgcaagaacaaaacccctgcccccccttaataataaaaaaaaaagtttattgatgggtggttgcaaacca

SEQ ID NO: 614122 - DNA, 90 bp, Homo sapiens
ggatttgctggtgcagtacaactaggcttaatagggacatgcaaaagaatgaagttggactcctaccttccactatacacaaaaaaaaaa

SEQ ID NO: 614123 - DNA, 392 bp, Homo sapiens
gtgctctgtgaatcgtgccgcataaacatacgtgtgcatgtgtctttatagcagcatgatttatactacatttagggtatatacccagttaactgggatggctgggtcaaatggtatttctagttctagatccctgaggagtcgccacactgacttccacaatggttgacctagtttacagtcccaccaacagtgtaaaagtgttcctatttctccacatcctctccagcacctgtggtttcctgacattttaatgatcaccattctagctggtgtgagatggtatctcattgtggttttgatttgcatttgtctgatggcctaacactacttgctccactatggcaaacctgaatgtcattgagattgagaccaatctttgtatatgtctg

SEQ ID NO: 614124 - DNA, 519 bp, Homo sapiens
  misc_feature (244)..(244): n is a, c, g, or t
  misc_feature (250)..(250): n is a, c, g, or t
  misc_feature (261)..(263): n is a, c, g, or t
  misc_feature (318)..(318): n is a, c, g, or t
  misc_feature (338)..(338): n is a, c, g, or t
ggtggaatgaaagagaagctctgaagatggatcatggccgtgactgcatgtcaaggagagtctccttgatgacactgaggcctacgtcgagatagacaaaatgtggtccaattaaaaggtgtctattttaccacattttttaaaacaaaacaaaacaaaacaacaaaaaagatggaaaagaagacaggggtacaggcaccagtgtacatgtctgacggggaacatctattgttcaaagcttgcngctgtncaagtaggttnnngaatgtctgtcagcagtggacatgatcttagagtgggctgtgcagatagaccttnccaggtcatgtaattggatnaagttaattgcaattaaggtacaggtaactgattaggttagggtacgttccatgtcaggtgaccagaggcagtataaaaggcagcctggaaagcggaggtccctctctgccccttcctccgtcgtcctggatgctgcatcgcttccagccgagctgctgcagcacctgcccatctcagcgc

SEQ ID NO: 614125 - DNA, 453 bp, Homo sapiens
ggaacaggttcaccgtggatccacattcagtgtagagaggaccagccagagctagctcagtagacgcatttcagaatcatcagtgaggagcgcgtagcagaattatcccgttaacactgagaccacatttcacctgttacttatttttctaaatggagtaggagagaaagatgctaaaatgtgatcttgggaggagtcccccagtcccccgaaaaagaagaagaaaaaaaaaaggcagagctccaaacccctgtggtcatggcaatttcccatcaaaactgcccatgtaaaataaacacaagctgctaaaagtgaatgttaagaaggaaggcactgtttagtgggtgcccctgaccaatcccctggagctggagaggggtttccccacggcctttggtttaatgggtctgaaaactcaacaaacctccgtttccctgaggtaatctgcaaaaa

SEQ ID NO: 614126 - DNA, 137 bp, Homo sapiens
  misc_feature (33)..(33): n is a, c, g, or t
ccagtaggtgatctggtcaatgtcagcatatcntagcatcttcgttcttgaattcgttctggaactgcatccagcacttgcaaattcttcccatggtcctttgcgatcctcatcaccacttatataatactcagtaa

SEQ ID NO: 614127 - DNA, 267 bp, Homo sapiens
agcggatgtctcaatatttagatgattcatctttttaagtgagcctaattttgaacatagtgctaaagtcaatgcaggcagggtgcagtggcccacatccgtgaatcctaacactttgagaggctgaggcaggcagatcacttgagtccaggagttcaagaccagcctgggcgacatggcgaaaccccatctctacaaaaaattaaaaaatcagccaggtatggcagcgcatgcctgtggtcccagctacttgggaagctgagctgg

SEQ ID NO: 614128 - DNA, 611 bp, Homo sapiens
aagcggccagcgacatttgcagtgtgagaacagactaatacaataagttgataccagtagagtggggtgctgcatgtaaagatacccgaaaatgtggaagcaacatttggaaatgggtaagagggagaggctggaacagttgtggaaggctcagaagaggataggaaaatgtgggaaagtttggaactacctagagacttgtagaatggctttgagcaaaatgttaatagtgatatggactacaaggtccaggcgtaggtggtctcagaggcagatgaggaatttgtctgggaaatggagtaaagtcactcttactatgctaagacactgcaggcattgtgcacctgtattagaaacgggcattagataggcgggaaagagggaaaattagaattttctttctagagttccctacagatctgtggaactttgaacttgagagagatgatttaaggtatctgacagaagaaatttctaagcagcaaagcattcgagaagaagcagagcataacagttcagacaatttgtagcctgatgatgccacagaaaagaaaaatctattttctcaggagactgggttgtagaaatctgctaagtcatgaggagccaat

SEQ ID NO: 614129 - DNA, 120 bp, Homo sapiens
ggattacacttgttcgtgggctgatggagcagagtgcgcttggtgctgtctgtggtgtaaggagcaacaggcgatcaagttggctttgcagccgcgccaatacggcgtccaggtatgccc

SEQ ID NO: 614130 - DNA, 122 bp, Homo sapiens
ggaagggggggggggttttccccccgggttattttcccccccccttcccccccttgggaaaaccccccggggaaaggcttttttttcccgggggagagccaataaccttggggggttgggga

SEQ ID NO: 614131 - DNA, 138 bp, Homo sapiens
  misc_feature (84)..(84): n is a, c, g, or t
cccacgcgctcggaaacaaagcatacactcattattctacgcagcggactacaaccacggaccaagtgatatgaaatagaccantcgtctgtattgtcaactacaaggaacaacataccagaaatagaacaaaggggc

SEQ ID NO: 614132 - DNA, 190 bp, Homo sapiens
ctattaccgcggtcacattcctaaattcgctaaaaatttcctcgccgaaacgggcgacatccgcgcggctgtgcggcagtatatgtgctgacgtggagtccggcgttcatccgggcgaagaacacagttcccattaaggagtcacgttgtgttaattatcgaaaccctgccgctgcttgcgtcaggaggg

SEQ ID NO: 614133 - DNA, 239 bp, Homo sapiens
attttaagtgatagtagaaattaccaagcatatgaggtatttcattatgataggcttctaacattttattagttactcatctttgttccacggacccttgcctgatggtaggggaatggtaaagcatagattaccagccagttgggctctgattttgagttatttataataaagtttggggaataatcataacatctcatatctttgtgtatgttgttttaatgctcggcagagcacaa

SEQ ID NO: 614134 - DNA, 133 bp, Homo sapiens
gatctgcatactctttcctatatgatgctgtatctcacatacccgggactaagcacacgccctatcactgtctttctggggatatcatagctagggctgtaatcactccttctaaggagatccctcattgtag

SEQ ID NO: 614135 - DNA, 250 bp, Homo sapiens
catgtgatgtaacctgtgcgtctgtgatctcacaagggggacaccacgagacgatttgtgggcataccaaggatgtgctgagtgtggcttctcctctgacaaccgggagatagccgtctggatctcgagataaaaccatcaagctatggaataccctgggtgtgtgtgaatacactgtccaggatgcgagccactcagagtgtgtgtctagtgtccgcttctcgcgctttagcagcaagagagcagcagg

SEQ ID NO: 614136 - DNA, 933 bp, Homo sapiens
gccgactctgtggagtctagctgccagggtcgcggcaggctgcggggcagagatgactggggagcgacccacgcacggcgctcccggtacagacgctgtgggccgcggattctgggcttctggggaggctgtagtggtttgggtgttgtggcgcgatcttcctgctgctgtctctggcagcctcctggtccacaggctgagaacgacttcgttctggtgcagccgctggtgaccatggatcaacatgctgtggcgtgagcgggcagcacagatcggctcacgtggacaccttccgtcatcccgttcatcaggagccactccgccgtgggtcactcttctctgcctttgtctgagtgcgaggaataatgtgctcatccgatgagggggccaatgttcgtcgccctgcggaggtccctggaccagtggctagcgcatggctctcctacagcgttcaattgtcgatgattgtgggatgtccccgactgggctgaaccttggggcagatagtgagccacctgttgatgacctgagctcgtgatgtgttggctagtcccgatagttctttcaaggacggatgtgtggtcggccgcgttgaccgtggttggcctcagctgttggatgtcaaccatggaatgcatgtaccggcccagctgcccccgtaagatacccgagaactgcaacgtgttcaggcaccctggacccagggcctctgtggattccagagaataccacgtgcagccacggaaatggggccgccctccatcgcgtagtgtggacatgggaaagccagcgaaatggaaacggaacacactgagtctaccacaaccgaatgaaaatggtagcaaactgggagccaccgaaagaggagacatgggaacacgaacataagccacacaagaaaataatgaaccccaaacaaggagccaataaaac

SEQ ID NO: 614137 - DNA, 149 bp, Homo sapiens
cctaaaagtgccttgtaaggaaatttttgaatgttttaaaagataaatatttttggtacacagagttcaaggggaaatgcactctaaaatccaagaatggatgttctcgtgtggatgagaggtggttggtatctcaaagcaaaatgtat

SEQ ID NO: 614138 - DNA, 953 bp, Homo sapiens
  misc_feature (483)..(483): n is a, c, g, or t
cccacgcgtccgtgactattctctacaaaccacggaagacagtgggaacactatacctattatttcggcggcatgagcctggagtcctgaggtcaccagctctgaagcctccttattcgagtccgagctggggccagcccgaaggtcaaccttctgaggtaacgaaccacgatctacaagcgttatcgtgctagcagcgcccaggctatttgataagtaagctcatatcgtatcaataggtaagtacccaatcatataagtcggcagggcgttatggctaacgtgacatagatgtccccctaagtaatcgggtgcccccgaatagtgggcgtctatcgccccgcattaatactaagcatacagctttctgacgtcttgtaccatcccactctcgtcactacatcccctgctgcggatcgtgctgtaattagtggggtaggccaggagctagcggaacatggttcgaacaaggtgcctaccgcntccgcttaagctagggaaagctacctctcccacacacataggaagccctcctgtgaagaaccttgaaccaaatcattactcacttgtacgactctgagacaaggggtgtcatcacatcttagtctttaagtgtggcgcagttcgatattcccatacggacgaaactagatttcgatgcaaaatcagttaaaatatcgcgccacgtggcccatgataccacgaaaataacccaataacgaccgccgtactgtccgtcgttgaatcccgtgcgcatatattcagcagaccagtccgtacttctcactattctctactccagtggacctaggctgctgggcaatcactaatagctactaacaagaaccggaagagcctcaaagcaccaacgtttctttcggaacccccgagcgggaaggaagggaagaaccccatttctatatacaaagaactaattgcctggacttaacggg

SEQ ID NO: 614139 - DNA, 450 bp, Homo sapiens
gctgagctaccgggaaaaagaaatatttgacaaccagctccttgaagagcggaaccggcgccgtcggtgagggagcagccggctgtgctgtcagcggggctggcggtggaagcgcctccagtgtgcatgagcctttctgaagatggggggctcgagggggcacgtttgtgtttggaacctgtctgtgcgttcctctgcgtggccatcctgatttccatacttcgggagaaacccatttggtaaacacggaaacccagttctctttcccgggcatttttttccatttttttttggccttttttaaaaagaccccgtcgggaaaggcttttgaaaggaacgaaggctattcaactggtgcgcaataccccctggttgtgctgtggtttctcccgacgtgcacatcgatctcgtatgtgtggcatctgatattaaacgggaggttttaagaaa

SEQ ID NO: 614140 - DNA, 1213 bp, Homo sapiens
  misc_feature (1213)..(1213): n is a, c, g, or t
ggtcagcttccagtccgatatgtagcactctaggtacaagactcctgcgcgcggagtccacggcagacgacgatgctcatacacggacggcgtaccgaactgaccgcccgtcgacctactccaacatctcggagccgcagtgggtcattcgctggtgcgagctaggcttgaactccttcgccgctgcacggttggctaccagtcggttcaccgagtagcccacgagccagaagatgagcatgcagcgtgtgggagtgaatgagagcgacgactagtcgctacatcgcttcaaagcaacgaactatcgaaaatcgatctctcctcatgttgggtctggcatcacaatgcttgtgaacgcctcctatcaggcacatgacctgcgcgagagcctcacaaagagggtccctcgtgctaaggaagcggaggacgtagcatacgtgtgactgccaccacgtcgaattcgagacgtggaacgatgcgtggtacttctgcgtgcgaggaattgggtggatatcatgccaccatgcggggcaaggctgtgggaaggaatggcaccccgagagcagcaccgatggcctcgagaaggagctgaaggctgccttggtaggagtacctcacgcgcttgaaggtgctgtggtcgagtttttcgtcacttagattgctggttgaagtgtgcgtgagcgtgcgactgttacgaggctagtagccacaaatgacccttcattgtttggtttttaaggtcccatacgcgggtatgttggtagtgagccagctgaccatttggtgctaaccagaagaggtggtgctttcgttcccctttgatttcttccttttcctaaaatggttaatcccgaatcatcctttgacagatgggccacccgtcaggtgtgaagctgccgaaatagagtggccatttaccaaaccaaagcgccgagctaagtctaccgtaaatggtttgtagccctttctccgtgtggggcggagccatgggcgttgcggcaaggtatctttgcttccataccttgactttgcttaacattctcggtctttacacccctattcatgctaatggggaactacagtcaataaggggagcagccggcgcacgcgaatagccccttgctcttttgggcggcgaatttccccattgcattaatcggcggggacaaactgaagcaggtctaccccggacctgatgtgtcgtggacccacn

SEQ ID NO: 614141 - DNA, 135 bp, Homo sapiens
ttcggggcattctggactctcattcaagaaacgaagtgatttccagaggattacacttttgcttgacacggtcagtgctgcttgcccatttaataaagctggacagcatccaagtcagcatctcatcggtcttcg

SEQ ID NO: 614142 - DNA, 1260 bp, Homo sapiens
gtggctctggatgccgggctgagacggtgggaagcagtgggtagctggagccatgggggactgctcccagccctgaatgagaaactgcaccttatcaccctggaacctgcaggaggttctggtgggcaagagaagctgaagtgcagatactgaagtgagcgggaacttaaaatttacttggggaactggcaaccacgggcaaaccacatgtggcttacttttgtgcccatgtcaacagattgcatgacttcttaaaggcacgggttgtgaggtaacaattctgtttgcggacctccacgcatacctggataacatgaaagccccatgggcaacttctagcaactccagagtccagttcactcatgcagcacatgtagatcaaaagcaatgctggcagcagcattggttgtgcccttggcagaagctcaagtacatcaacagtgcactgattaccagctcaaccaaagagtacacactagcatagtagtacaggactctcctccgatggtcacacagcaccgattccacagacaggctggagctgaggtggtaaagcaggtggagcacccatttgcgtgagctggcctctctatatcccggactgcagggcataggattgacgagtcatctacacaggtaagatgcccaagtctggaggccattgactcagagacaatgatcattcaccttaggcccgacgcaggattccgtcccatgcggcgtatgggatatgcaacaacgtggacccagctctgtatggagtcctcaatggctcccaacgacataacatcgccgatacaatatgacaccccttctgacagcagacgcctcagcctatggaacctcaagtgaacggacattcttcgactttcacgaaacaccgtcacaccaaagggcctctctctttacacccttaatacagtttacacaaccacgtcactcttatcccatacaccaaccacttaccattacacccctacaacgccatctttcgaccacaccacagcacaaagatcatcaacaaatcatcattcacttttctgtctctcaccatctcactgactatccgatatcaacatctactcgtcactattttctacctctcacatctttactccacgtaccaaaccacacccactctaaataggatccacctaccagaccacctgcccaccccccctccccacacctacatccacactaatgtacacgataagaacgagaaccaatgactttctaaacaacacattattcattttc

SEQ ID NO: 614143 - DNA, 1187 bp, Homo sapiens
  misc_feature (1187)..(1187): n is a, c, g, or t
ggccgtcagatcacttcgattagtggcgtcagcggatgtgattttgcatcgtttcatgtgcgatgtctactgtcgtgagcatgccgtatatgcttcgcagctggtggagtcaggaagacagctggccttacataccttctacgcatttaggagtgccgcatgaaggactgcgactcgagatcccctgcatgactggcttctgtcatgatcctaaactggctgggaagtagtgtgcctgccaatactcgcgtgggctggtgaacatgccagcatgagagatacatatcctcatactcatctactcgggtggttcggtggaacgcactctcctctagtcggatctgcacgtgcctagtttgtacctctgttgtgcggcattctcacgcacgaattgctgacctgattaatcattaaacgtttagacaccgaagacttgcatcaatcctggaaagccttggaccctttccatgagggagttggtggtagaggtgagtgaaatccagctgccatcagacttttcgagaaagatctctggatccattgaagttgtctgtactagaaggaagcgggcattcgctcactccgtggctgctgcttgtcgaagatgatgtgcctacgtcggaaattctggtagcccctaggctgtgccgtcttggtttcagaaattgatactcaataatccccttgattgatcgccctatcaccactgcttagaagtattgagatcaactcgattccatgttgcgcgcgaaaaaggacgtagttccggagagttgagacattcgccccttgtggaatatccgtggggcaaagagggaggaagtcgtatagaaggtttggagaacggggtcaagatgatctttctcaacttggggcagttctttgctcggttaactttttgaccagaagttctcatggatgacagaaagaattacccctttgttggaggttttcctaaggatcctcgttgggtcggagcctgtgtttgttttgctctgtctttggaggaggagaaatttcccgcctggctagtttaagaccctaatttggattcggccaggtgttgtggggttacctcttatttagattttttcccccttataaccctcagtttgctcttttccaagtctttcgtttgtggaagcttcggaaattggcgaagaacttcgcaatgggtctggaaagtn

SEQ ID NO: 614144 - DNA, 196 bp, Homo sapiens
aagtggaggtggagcacagagaactacaggtcagtggaggtggagcacaggactacaggtcaatggaggtggagcacagggactacacatcagtggaggtggagtcacagggactacaggtcaatggaggtggggcacagggactacaggtcaatggagatggggcacaggaactacaggccggtgcaggtgtggg

SEQ ID NO: 614145 - DNA, 833 bp, Homo sapiens
tagtgctaggtaaggccggtgttattcggacgaggcacggctgtcaggcacgcatgcatgccagctaccggtgagcacgtgaatgtgagtgtgcagcagctgcatggcaagatccggactcttcagtgagcagctggagaatggccccaacacgcagctggccctgcctgcatgcaggatgaactccatcctgcgggatgccttgaaccatgtgccactgagccatggtggatgatgcaatgcagaactgcatgatgcttgtgccaatgcttcgtgcatgtgatgctcatgcaatggtcatgcaaatgatgcttgtgtgtgatgaatgtcatgatgtgcttgtgctgtgcaatgattgatgcatgcatgctgtgaaatgctctgtgaatgccaatggcatgcttgccttctgatgaatgcatgtgtccttgcatgcttgacatgtgctgtcccacatgtgggatgatgttgagtgatgtgccactgcatgaatgctgccttggagctgatgtgtcagtgcctggtgatgcttgtgccacagctgcaggatgcagcacacagccatgccctcctgtgtgctgtgaattgcctgatgaatgtgcccagtgatgcaacatgcatgcagacttgtgcctgaagtcttgccacatgcaatgttacatgtcccttcccgatgtgctgtgagtgtagcggcatgcaaattgctgagtgatgcttgaagtaggccttccatcgtggcaatgtctccaatgtgatgccatgggctggatgaactcccagtctcacatgagagaatcctgttccattttgagggccctgcttgagtgcgggca

SEQ ID NO: 614146 - DNA, 341 bp, Homo sapiens
  misc_feature (5)..(7): n is a, c, g, or t
  misc_feature (90)..(91): n is a, c, g, or t
  misc_feature (109)..(109): n is a, c, g, or t
  misc_feature (123)..(123): n is a, c, g, or t
  misc_feature (292)..(292): n is a, c, g, or t
  misc_feature (329)..(329): n is a, c, g, or t
aatgnnnagagcaatcgtcatgtgttgaggatgaaccatcatcagcatgcgacggttctccctgagagtggaattatgtatcagaagatnngtactctcacacccgagntctaatcactcatnccacactggaaacgactcctgactcggggacctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggncaaaatcagccccaggcagctgctggctcccaccagnatctccatgggc

SEQ ID NO: 614147 - DNA, 1037 bp, Homo sapiens
gctcctactcctcatggtacccagttctaatcgcaagggcattgcctaatgcttaccgagatcgaaaaatttctaggctatatacaactacgtcacaaggtcccaaacgttgtaggccccgtatgggctactgaacaacccttcgcatgacgccataacaactcttacaccacagagagccccgtgaaaacctcgccactatctaccagttcaacctcgtcttacatcgagcggtcccggagcttgtagctcgtgcaatcaatcgcatcgttctactatgaaccctcggcctcccccaatgaccgcaagagccctcgtggttgcatagactcaactctgaggcactcactattttattctaacacgaactcgtaggcctagcctgtgttacgtcgaagtctcgtacgtgaatgcagggttgagcgatcaaacatcaaaactactgcctgtgtatctggcggacttgcgatgtagtaagcccaaacaaatctcatatttgaagggcacctctaatcgcagtctagttctacgtatccaacagttacgtaagtaggtggctcctttaagctcgtctccaccccgttatcacatggacacggaatgagcactcctgattagcgtccgtgcccatgcatgaaaccttgggcataagtatgatttatgctacacactaagcagaagagcaaccgaatcgccgcttcgatcttgccggagtggggagtccgaagtaggtctcagggcttaaatattcggaatacgacgggagggccccttggtcgctatactttgatagggcgaataaaggaaagtgttataataaatagctaagcataaggatttcctagaggacatatgacggaatgtgccctgaaatgtagagaaatattgggtaagcagacctattttaactccgttttatgaatgaaccggtagcccgatcgatagagcactataagtgtatgagaaattctacataacgagagtaggattaaagtcaacgtgaattcaaattcctggtgaagaaaaaagggtttggg

SEQ ID NO: 614148 - DNA, 361 bp, Homo sapiens
  misc_feature (41)..(41): n is a, c, g, or t
  misc_feature (51)..(51): n is a, c, g, or t
  misc_feature (287)..(287): n is a, c, g, or t
  misc_feature (297)..(297): n is a, c, g, or t
tacaccattatttctgcatatcagagacttttagtactttnactaattttntactgctatctaaaaggcagagccaggtgtacaggatggaacacgaaagcagactaggagcgtgaccactgaagcacagcatcacagggagacggttaggcccctggataactgcgggcaggcctgactgatgtcaggcccctccacaagaggtggaggactagagtcttctctaaactcccccagggaaagggacactccctttcccggtctgctaagtagccaggtattttttncttggcactnacggtactgctagaccacgggtctactttggcaaacaggcgtttttcccagattgttggcgtta

SEQ ID NO: 614149 - DNA, 656 bp, Homo sapiens
  misc_feature (1)..(1): n is a, c, g, or t
  misc_feature (344)..(344): n is a, c, g, or t
ngagatgtttaaccagcccccagttttcctgtgacggtattagtgcgcatttgcagggcgtactaaatatacccccccgccttacgccaacaaattggggcccccccaatagagcgggcgggcctaaaacaatagaagtaagagtgggtttacaaaggaggaccccttctgcgcccacggcccaaagaattttcttattgaagatttgatgcccccaaaaggggcgaagtacaatgtgagaaagagtttttggtgtctcttttctcgcccggcatgcattttctccacttaacagctctccacactgtgcataattcaccgatgtttctacagaagttctatgncgatacccccagatattaattatgttgtttacccctctcacccaactctgggagataatatttatcccacaaataataatatcactctctatacataatataagatacatctcacactgatatagtcctcctccccctcgtctatattttccaaaatatgtttttataataaaactaatagaaactttatttttccacactataatattgcaacaaattattactagtatattataacacactaccacacttcataattgcgttccctaaaaatacacaacttcttgcaccatcaccacgacaaaaatatac

SEQ ID NO: 614150 - DNA, 616 bp, Homo sapiens
gagagggctgtgcagcagcgatggccctaaggatgctctgggctggacaggccaaggggatcctaggaggctggtggagatcatctgtcttgtgtgatgtcttctacttctctccatgcactccaggatgtctagcagtcaagatgactacttgcctaagcttccatgcccccctgtctctcatgaggtggaagatattgttaccctgggctgagtccttggctccgcccacggagcctgtgttccatgtgcaccgtgtctgcggtcctgtttggcgttgttggcgtgcatgttgacatcggtcccagtcatccctagtcgtagcttccgctggcttgggtgtgaggtgtacgtcggcgaggcgggaacctgccatttctccttggtgctccattcgtcggcaccctcggctgcccgtgcataggggggaggaggccatgacgccagaatggggctcagcctatgacccctgttcctgcgggctcctgttccccattccagctcaaactccaattgatccatccatctagctgactgctctactgctcgcttggcacttccagggaaaccatctatgcagtctgcctaatgtattctggaacaaataaatcacatg

SEQ ID NO: 614151 - DNA, 489 bp, Homo sapiens
aacttcacatcacgtcagcaattatatatctcattagtggcgcggtgtagtgtgcatgtctgaatcatgtgtatcatactgtatctgtctcattaatgacagaacatatatatcccagccatatctatcacataagtaatagacaattagaagtgcctatgttttgatcaattataaagatagtaaagatatcattccggaaaacgactttctcttattcattcacccacattctcaactttatgtgcctgcaaagcactggtccccaataacaatactttataccctagatataatgtgaacaactaaatatcatttcatttacgttgtgctcgaacagaatacatagaaagtaccaagagaacacaccacaggggcgcataacataaatgaaacattagggtattgctaaaacaagttggaattaatcttacattaaactttgtacccacttaccttaaactattatgtacacagacaagatgcaaa

SEQ ID NO: 614152 - DNA, 90 bp, Homo sapiens
  misc_feature (47)..(47): n is a, c, g, or t
cgggcgtgccgcttgcttgctgctggtcgcctctcgacgagctaccncccggcccagtcgctagtccttcttggccccagccaactgccg

SEQ ID NO: 614153 - DNA, 1027 bp, Homo sapiens
  misc_feature (224)..(224): n is a, c, g, or t
atggagacggcggcggctgtagcggcgtgacaggagccccatggcacctggcccagccccagctcagcccatcttgaccaaatctaaggctccattggtagccactcacggggcccccctgtccaactgtggtgccgagtccatcccgggacagtgggcaccgtcaaagtatacctgcgccaagcaagtcaacgacacggtgcgtgacgtgtcctgtggatggncatgatgtgtctactgactctctatgacaaggtccctgaacggtgcggggatctaaactcaggactgctgtgtggtctacctgagctcactcaacggggtaactgagaaccagggaggagtgaaaccagcagataagggaggactactgtcagttcaaacgaaagacggtcactgtctgtggacactagccattgctacccctggatggcgaggagctcattgtctgcatggtccttgaacgatgtgcccgctgaccatgcacaatttggtacaggaagaccttcattcgagcctggcagttctgtgacttcatgccttacgttagctagttccatggcttccgtagccaaacctgtggcttacaagttccaccagcattgtgcctccaaggtccccacaggctgtgtgacatgagtgccaaacgcaacagttctaccacagtgtccaggatctgtccggagagctccagacagcatgaggctcccgccgaaaccgaccctgaatgatagcgaacccccgaggtccaagtagggatggctgagcgaacaccgctgggcgaaagaaagactgagggacaaggaaccaagagccatacgtatacatgaaactgacaacattatgagccaaaaagccccggacagatgtgacgagaaaaccatccggccccaagcccataagaggcgcaacaacagcaagaaagaagacggaacacaacagagcaaaaagaagaaagaagaacaggaaaaagacaggacaaacaggagcaacaacgccataagcaaacagaagacggcacaacaag

SEQ ID NO: 614154 - DNA, 366 bp, Homo sapiens
acggtgaccacgcttacctttacctggacacacgacacaacctacttgaacaccacgtgacaacgcacgtaagttgactactacgacatgtggtactctcgtttttacactaagactctcaacctttcacgtaacagtttacttctgtactcacccacgaccacgccctttatttggcaaccaagttgactgacgactttaaagactggggattataacctgtttccttctcttgtaaccaaagatgggagtagtcccgcatctctttgatcaatatgtgctcctttcaggtgtacctgggacctgccctattcagagtgtctagatatcatcccacctgagtccatgacactcagtctcttccct

SEQ ID NO: 614155 - DNA, 362 bp, Homo sapiens
cagcccgggtcgcagagcaagactccatctcaaaaaaaaaaaaaaggcttaagggactttggggacattttgggggacccaattttttttttaaggcccttaagggagggaaaaaattgtttttgtaagcggggagggggaaataaaattaaacccttggaggacttaggggttaaaattttttaaactgggtgaaaatttttaaccccacagttccagggggttaaacaaccccaaattttaaaaaccgggaaaaaacttagttttggggccgccttgtgggaaaagatttagggagaggcagttgctttttggaattggttggggggtttggttttggggtttgggggttggggggggaa

SEQ ID NO: 614156 - DNA, 851 bp, Homo sapiens
tgcccggcggtaaatactgggcgcttttaagaccacccccgtgtggtgagtgtcgccccttacccgccggactgtggtttctattattccgggtgcacacgaccaacaaataaagctggggcggttcctcacaccgcccccctgcgtgaggaaaccctcggggtgagacccatggagtgccgtgcgggctgccgcccacgaagaacagatgtaagataatagtagcgcccggtcgacgtccactgcggaatattcggtgccattctgattgccacaccacgccttgccatgtaaccaccggcccacaccctcgaaaaaggggtatgtcgagtatgaataaatgccatattgatgcaacaagctcgcaccggtcggcctttcgcctatcatccgccccggggcgagagacatgttccgccgtcgccccgaaagagcgttgttcgcccctctgtatttcgtaggataatctctgtcggagagacccactctctctccacagtttccaggagacatagtgagaaataaccaccacatcatgtgtatttatgtgagaaacgagactaactatgttttgtagggaatgacctgatctacccgccatgttgtggcggtatgattttgcacgtcaatcatgattatagagagcacgacacttgtttttttataacacgagtatacagtgttcacgtcgatttgtttgaacgaccacgacgaactttctgtggggacaaaaaagcacagcagaacaagggttaagagagtaggaggatagaataggtgcgaaaaaaatgagacagatggtagtaaaagaagtaagtaaataaaaaaagataaaagacccaacaataaca

SEQ ID NO: 614157 - DNA, 645 bp, Homo sapiens
  misc_feature (379)..(379): n is a, c, g, or t
ctggtgtcgaactcctgacctcacgtgatccatccgccttggcccccccaagtgctgggattacaggcgtgagccaccggcctgtagttttaaatttactaatgttaaaactaaagttttaaaacccggcctgtagttttaaatttactaatgtcatcatgtaccccctgtgtgtcaggagctattctgctatctgcttgtgtatacatcttgtatccttgtttgacgttcaaagaaacgcgagggagcttggaagacgtgtcccaggtgaaagagctgggaagcagcagagctcagatttgaccccaggctacctgactatctgaccttcagcctcccaagagctgtacttttctatactcctgctctctcctttccnggttccctctgcacctcacgcagctcagcacactcctcagtgtgtggcacttcatcaatattggtctatgcaaaccttttgtcttttagttttatttctttcccttcattcccagtcccctgcctactttcctttttcccaggggcacccatccaattttaatgttttgatacatatgctcgaaaagctaaagcattgttctgcatatgtgtgcattttaaatgtccataaatggcattgaagctgtgaatcagttaaaaaaaaaa

SEQ ID NO: 614158 - DNA, 309 bp, Homo sapiens
tcgaagtcgccgccgacctgcggaagacgttgaggaacgtcatcaggtctttctggtcggcgccctcgacgaagatgtcgcccttggtcgccagcgcggcgctcgcccagctggcggcctcgttgcggtcgttgatggcccggtgcgtgtagccgcggagggtcttcacgccctcgatgaagatgacgcggttcggctcgacggagacgatggcgcccatcttctgcaggatggcgatgaggtccatgatctcgggctcgatcgccgcgttgcggagctcggtcaccccgtcgtgtggagcgggtaccg

SEQ ID NO: 614159 - DNA, 122 bp, Homo sapiens
agttcaagaatataccatcactcccagtgagtgcaaggtttctaaggagcaagctggctctcctcactcactgctgcctggggggtcttgaactaggtgctattgaaacttctaaaactagg

SEQ ID NO: 614160 - DNA, 221 bp, Homo sapiens
agttaagcataaaatatgcatcacaatccctaatctcaagtaatcaggacacaaacactgcggaaggccgcagggtcctctgcctaggaaaaccagagaccttggttcactgtgtatatctgctgaccttccctccactattgtcccatgaccctgccaaatccccctctgtgagaatcacccaagaattatcaataaaaacataaattaaaaaacaatgt

SEQ ID NO: 614161 - DNA, 143 bp, Homo sapiens
cactctagcaggatctctggtcttagggagcctcatgatactttctcattcttccaaaatcaggctggatgcattctgtgaaatttttcccgggcttaggatgtatactgaggaataaggtaaggaagatgtcagcaagtcag

SEQ ID NO: 614162 - DNA, 136 bp, Homo sapiens
ttttggggccttccaaaagccctggcttttgtttttccttggtttaattggtttcccctcggattttttttcccaggatttttgccccttccccccccccgaaggggttgccttttttttccccccctttttccca

SEQ ID NO: 614163 - DNA, 494 bp, Homo sapiens
atccccgtcccaaggatgaggaagtgaacactgctagcatggcctataaaatcaagaaccaagttaattacttctaagatacaatgaaggtacaggcgttggatgaggatgctcccattctatataggagaactggacaaaacaaaggggctaaaggccccatgcaagtccagaatccagcagggtagtcattgaattttaaagctccaaaataatctcctttgaccctgtgtctcacattcaggtcacactggtgcaagaagtaggctctcatggtcttgggcagctctgcccctgtgcctttgcagggtacagccccattcaaagctgctttcataggctgccatagagtgtctgcagctattccagatgtacaatgcaagctgttggttgatctaccattctgggatttggagaatagtggctctcttctcacagctccactaggcagtgcctcagtggggactgtgtgtgaaggctctgacctcacattt

SEQ ID NO: 614164 - DNA, 858 bp, Homo sapiens
tggtgttccaacaaactttatttatgaccactaaatattcatgttaatttcaagtttcataaaagtctttaaaaaaaaactttaaaattataaacccaatccctaccctcacaggccattaaaaagcaggcagcaggcgggatttgatccacaggccatagtgggctgctctctaaaacaggcttttatccgtcatgcaaagtgtttcacattccagagacttgtggagactttctcgttttctagattctctcattttaaaacacacttattacaagctttctctttcgggatcaatatactcacgagagaaaataattcagaaaaaaaaaaataaaagacacaaacaacaccccaacaaaaaaacaaaacaacaccaacaacaaccaaacaaaggagcggggcgggggcgcgcgcacgagaagaatcatcacccccgcggagggcgcccccaacgactagcgcacccacccgccactttcgtgacaccacgaggaggccccataagagggaagcgcgtcgaaactaaaacacacgaaagaggaccgagcggcgcccaggataacaacacagcccctctggcgcgccgtaggacaaccggcagcacgtgagaaccctgctgtggagagagccaccccccacacctgctgcggggggggcgacaacacatgctgggcacaccacaccctccacagagaaaatctacgcccagacaggagacaaacaaacacctacccgggcccacagtgcggctgcaacacccacacgccgcaataaatcctcgcatgcagaacaacatggcaaccagaaaagcacgcaaaccactatccagacagcacaccaaaaacagcacagacc

SEQ ID NO: 614165 - DNA, 345 bp, Homo sapiens
gctccgactaatagtctgaagtgcagcatggctgtacaggggtccaagttctgttagctgaggatcgggtcctcgctcatctgtgtcacctgtcataggatacttcttgactataatccctgtcccaaaggttacgctgtacaccggagggacaagaacggttcatgtcgctccatattatgcagttccagcactcataagcatcatgcagcaaaggtaaactgttgcatagcatccgctcgtcgttgctcagtaagcacccatcgcttgggttaggacactcagctgctcgcggtgagtgtgcctttgtcaatcgtatcagtataaatcagacagactgtaccg

SEQ ID NO: 614166 - DNA, 112 bp, Homo sapiens
cagcacatctgccctctggccgcttatggtataccttttctgtccttcgcattagtcaccgaagtacaaaggttgtgtctagtagatcctagtaaggtaagcagattttccc

SEQ ID NO: 614167 - DNA, 664 bp, Homo sapiens
  misc_feature (118)..(118): n is a, c, g, or t
  misc_feature (154)..(154): n is a, c, g, or t
  misc_feature (156)..(156): n is a, c, g, or t
  misc_feature (275)..(275): n is a, c, g, or t
  misc_feature (285)..(285): n is a, c, g, or t
cccgtttttcaaaaaacccttttattaggcccccgaggagaaaaaaaaagaagagggtttttccccaaaaatttgaacagcgcaaacatgggctggtaaaaatgcaaaaggggggccnaaagcccattaagtaccaaggccaagtagaagatgncncgcgcgtttctcttttgttttttatatagcaatgaatgatctattgcgtgaaataggtatcacccttaactaaaatttaacgaatgtttatagtctccttccatgaactagcagcagcnagagatagcnagtgttcgcaagtctctccaatccatgttattctgatgactctttgaacaaagaacttgaacctgttcaggtgcttgatgacatgcagtcttgaatatatttagatgaaggtgtcttgaaatttgcaggcacaaagcactatagtatatcaccatatcaaatgaagaaatcgccagtgccatccatagaacaacatattcgtctataaagttattaaagtactggtctaaaaacaaaagacctggccccaaaaagacagtgtcttgaagatatagttcacttttggtcatgtgagctaccactaatttttgtgagtctttagcaaagacacatccaaaccttaggatataaagccaagtatgcttttcaaactctccag

SEQ ID NO: 614168 - DNA, 449 bp, Homo sapiens
caaaactccttccgtctacaaagaaaaagtggtgccgcttgagacattatcacgcccaaccagtttgaggccgagttactgagtggccggaagatccacagccaggagggagccttgggggtgatggacatgctgcgctctatgggccccgaaaccgtggtcatcaccagctccgacctgccctccccgcagggaagaaactacctgattgtgctggggagtcagaggaggaggaatccggtggctccgtggtgattggaacgcatccggatggacattcgcaaagtggacgccgtctttttgtgggcacttggggacctgtttgctgccatgttcctggcggtgacacacaagcaccccaataacctcaaggtggcctgtgagaagatcgtgtctaccttgcaccaggttctgcagaggaccatccagtgtgcaaaagcccaggccgc

SEQ ID NO: 614169 - DNA, 102 bp, Homo sapiens
ggtcgacggggaggtggtccttgagcccaggagcgcaagcctgccatgagtcaagatcatgtcactgcactccagcgtggctgacagagtgagcccgtctcc

SEQ ID NO: 614170 - DNA, 305 bp, Homo sapiens
gtttattagttaagtgacttagagaaggttacttaaggctgggcatggtagcacatgcctgtaatcccagcattttgggaggccgaggcgggcagatcacctgaggtcgggagttggagagcagcctgaccaacacggcgaaaccccatctctattaaaaatacaaaaaattagccaggggtggtagcgcgcacctgtaatcccagctacttgggtggctgaggcaggagaatcgcttgaacctgggaggcagaggttgcagtgagctgagaattgctattgcactcctgcctgggcaacggatg

SEQ ID NO: 614171 - DNA, 189 bp, Homo sapiens
cccccttttaaaaaaaaaacccccggggtatggttattccgggctccccccggggtttggcccaaaacaaaatgttttccccgggggcccctggggtaaaggcccccttgtttcctgaaaccagtcctaaaaatttttttgggttttttccccttttttttataaaaccaggaaaattttttccgttta

SEQ ID NO: 614172 - DNA, 1346 bp, Homo sapiens
aagacaggcatctcaaatcggcatgattctgcatctggaaactgccttcatcttgaaagaagaagctccaggtcccttctccagccaccacagccccaagatggtgatgctgctgcatgcatgctttccggcacatggcatggcctcttcggatgacggaagagggacatagaccataacaatatagaggcaagatgcccacaacatcacatccggagcaagagagaaatcaagacagtgaaatcagatatcatcaggaaagatggaacagaaacaacgcagcaagatcccacagcaaccataagagcaatggacagctgccaatccagggccaaacatcctccaactaaatgggaacacacgagacaagacatcacacagaagatacacacaccgagagcagctaagagcacgcatagaaggcaacatgacgccaatcccaaaatcgacaaaggctgaaagcacgaacacacaagaaaaagacatcaacaaagcacaacaatgagacaagactgaaaaagataaaaggataaaacacatgagaaacatagcccaacagagacaaccggaacataggcataccatgaaaacacacagacatcactagagacacataatgacacacaaccgatagacataaccacggaaccccatagacaatcaactacaacaaaacaaggaccacagatggcgaactcacagcaacgagacatccagaatgacacaaagaaaacaaccgatagagacacaccatacaagacacaagtggcacgcaacaacgaacacacataccaggaaccactacactaacaaactggacgcacaacacaaaacgaaagagacaaacgcaaccaggtgacaaaagcaccacagaacaccaataaacacgaaggtacaacaaggagaggaggcaagcaaacgcaggagaaacaaacaggacaacacgcacacccagagcaacaataccaagacaaacaagcacaaaccaaacaaacacagaacacagaaagaaacgaccaaccagagaacacaaggacaacacaggacacccggcgcaaacaggacaaaacagaacggaagagagcgggaaagcacaacaaacagaacacacagacgacaagaagccagcgaaacaaagaaagacaaaaacaacagaaacacaagaaatacacaaacaaacaacacaaccacaaccacacaacacaaagaaagaaacaaggaacgaaacaagacagaagaagcaaccagcagacaacatcagcaacccacgacacgcagacgagcaagccagcacacaacgagggcgacaggaacggaacgcagaggctaaagagaaaaacgcacac

SEQ ID NO: 614173 - DNA, 326 bp, Homo sapiens
  misc_feature (9)..(9): n is a, c, g, or t
  misc_feature (103)..(103): n is a, c, g, or t
  misc_feature (109)..(109): n is a, c, g, or t
  misc_feature (116)..(116): n is a, c, g, or t
  misc_feature (158)..(158): n is a, c, g, or t
  misc_feature (167)..(167): n is a, c, g, or t
  misc_feature (173)..(173): n is a, c, g, or t
  misc_feature (281)..(281): n is a, c, g, or t
  misc_feature (286)..(286): n is a, c, g, or t
ctggaagtnatccagggcccaaaacccccagggttttggagccggcaacttcaactcactgttcaaggctttcgaggaggagcagaacctgcggggtaacctnaccaanatggagnccaatggggtggtgcccggcatgtaagccccgcccaccccanggaggccanagccanacagccacgccccctgattctggaactcgcccaacttccctactggctgctccccttgggtcccgcccaccagcggactcggccccccaagtccgcccacactgaccncaacncctggcggggccgccctctgctccagccctcccgattaaa

SEQ ID NO: 614174 - DNA, 975 bp, Homo sapiens
tgaaactcattgagaatccttatgttgaggtatgtgtatggttatcagaagaattctaacatccaagcaaagggtgtccgttccagcggtcagaagatcactcatgtggtctcctccaccatgatggctggtctcctgcggtccctgcttacggacaggcttatgccaggagcctgggtgaggaagaaagagaaacttcagttccatagtgataccattgtctgctataaagtgcctgcttcgaaggtgacactgtaattgtttgtcctggccattatgtggtacatggcactattctccattgctgactcccattgagttggaaggatattggctaacagcatgacattgtgatcagaaacagaggggcaacaggcgacactataagtaggactgcacatggtgctgaatattaaaatctcaggcaatccaatttgttcagcatgatgctgtaagagggactcttaattgttcaccgtggtaagactacgctggccacctggtgtgctgcagtgtgagactgaccggaggtcaccagtgcggacatcagcagagttactaatgaagaactcggatttatatggcgccaagggtgcttaggtctacgaaatctacccttgagcagtcaagtgagacccttgaagttgaaatgggatcatcactggcagggacatgggtcctcattaaggaattcattcaattcacagtaatacactaccaatggtatttcagtggcgcacttaatacttcttccaatattacagagcgagttagtaagcggccgccatcgttgtgacaccacatcaggctctgtgtaacactgacacacatatctccgttcgaccatgagctcccataaaacgacctgtaatttactacccttgatagcccactctgtatgctctaggggccagatacctatatctcagttccgcgcaccatgctcttacatcgacataccaacatattcacgcg

SEQ ID NO: 614175 - DNA, 566 bp, Homo sapiens
ctagtactagatcgcgagggccgccttttatttatttttggtgtcattcttttatggtccgtggtttaaacctgactgaatacaagatcaacaaaagcactgtactcctggcaattatacatatgttaaaacatggatttggcactgtagacaacatttaaccccagtctatggggtactgaatggctttttataaagtgcaacaataaagatttatatccaaacaagtgacttgggtattatttcatacattccacactttttctgtgcagaaaaaaataaaatggtacacactgcttaaatatacaattcttccaccagtgaaaagggttaaaacattcataaagacacagcaccagaatgtgatgcctccagacagggaaaaagggaaaagtaacaacgaacaattgtttcaagcacaatatacttagccctgtcactagccaaagtgatgggacagatccagatctcaaacacagcttatacaacataccggaggacagggcaagagatgtcaagacagcattcaatacaagcatacacacaacccatcaccttataggagt

SEQ ID NO: 614176 - DNA, 1198 bp, Homo sapiens
  misc_feature (66)..(66): n is a, c, g, or t
  misc_feature (89)..(89): n is a, c, g, or t
  misc_feature (91)..(91): n is a, c, g, or t
  misc_feature (115)..(115): n is a, c, g, or t
  misc_feature (159)..(159): n is a, c, g, or t
  misc_feature (178)..(179): n is a, c, g, or t
  misc_feature (182)..(183): n is a, c, g, or t
  misc_feature (187)..(188): n is a, c, g, or t
  misc_feature (217)..(217): n is a, c, g, or t
  misc_feature (220)..(220): n is a, c, g, or t
  misc_feature (242)..(242): n is a, c, g, or t
  misc_feature (254)..(255): n is a, c, g, or t
  misc_feature (264)..(264): n is a, c, g, or t
  misc_feature (291)..(291): n is a, c, g, or t
  misc_feature (304)..(305): n is a, c, g, or t
  misc_feature (309)..(309): n is a, c, g, or t
  misc_feature (315)..(315): n is a, c, g, or t
  misc_feature (327)..(327): n is a, c, g, or t
  misc_feature (329)..(330): n is a, c, g, or t
  misc_feature (335)..(335): n is a, c, g, or t
  misc_feature (397)..(397): n is a, c, g, or t
  misc_feature (404)..(404): n is a, c, g, or t
  misc_feature (406)..(406): n is a, c, g, or t
  misc_feature (426)..(427): n is a, c, g, or t
  misc_feature (433)..(433): n is a, c, g, or t
  misc_feature (440)..(440): n is a, c, g, or t
  misc_feature (454)..(454): n is a, c, g, or t
  misc_feature (461)..(461): n is a, c, g, or t
  misc_feature (473)..(474): n is a, c, g, or t
  misc_feature (526)..(526): n is a, c, g, or t
  misc_feature (531)..(531): n is a, c, g, or t
  misc_feature (535)..(535): n is a, c, g, or t
  misc_feature (538)..(538): n is a, c, g, or t
  misc_feature (544)..(545): n is a, c, g, or t
  misc_feature (568)..(568): n is a, c, g, or t
  misc_feature (571)..(571): n is a, c, g, or t
  misc_feature (590)..(590): n is a, c, g, or t
gtttctctccgctccctgtgagtaacttgtgctccgggggctcctgctcgcctgcccgcacgccgnccgccacccaggaccgcgccgcngnctccgccgctagcaaacccttccngacggccctcgctgcgcaagccgggacgcctctcccccctccgnccccgccgcggaaagttanngtnngaannaggggggaagaggggaacatggacatganganggaggatccacctggagctgangaaccggacccnngcagctgtncgagaacttgtcttggacaattgcaantcaaatgatggannaatngagggnttaacagctgantnngtgancttagagttcctcagtttaataaatgtaggcttgatctcagtatcaaatctccccaagctgnctaaatngnacaagcttgaactcagtgannatagantcttggnggtctggacatgtnagctganaaacttccaaannctcacacatctaaacttaagtggaccataaactgaacagatatcagcacctnggaancttnganacagcnngaatgtctgaaaagcctggaccnctnaaactgtgaggttaccaanctgcaaatgcctaagcggagaagagtgtcttccaagacatcctaccccaactaagacaaacaaggaatggctacagcaccgaagaagcgaaccaggaagcacctgtactacagactgacgaagtatggaaaggcagtggcattgaaaaagaggaagacaacgaacagacgaagaatgaagcagagaccagaacgaaccaagcaacacaagagaaagaaaaaggcccgacgaccacccaaccaccgaacaccaacagcagagaccacaagggaatacgaaccaaacaacaacacaaaacgacagagacaaacacgcacatacgcgaaaacatatgcaacacatgaaaaggaaaaacaaacgaaaaagacagagaaagagaaaacagacaagacaacaagcacacacagccaaccagcacacacacaccagaacgacaccaacaaacaacaaaactgcgactagaacataaaaagaagaaaaaaaaggacgcaccaaacaacacaagacaccaaccacacataacactcgaagcgaaacacaagagaacacaagaccaaactgcatgatgccaaacataatcacggaactagccgcacgaacgcagcccg

SEQ ID NO: 614177 - DNA, 1046 bp, Homo sapiens
agcgggtgcactggcgggccctcccctcgggcgtgcctcccacacacgcccggcggcaccgcaccccgaggcgcttcacgtcacggagctgctaggagacgggcggggctccggttccggacggaatctcactctgtcacccaggctggagtgcagtggcacaatctcagctcactgcaacctcgacctcccaggtacaagcaattctcctgcctcagcctcccaagtagctgggattacagatggagtttggctcttgtcgccccggctggagtgcagtggtgcgacctcagcgatctcagcgatctcagcgatctcagctcactacaacctctgcctcttggggatttcgatgcgatgcgacgactaatccttcaagtccttctagattatcgtggtgattacagggcgcctgccaccacgcctgtgctagtagttggatgtttgtagtagatgatgggggtgttcaccaggttggtcagtctggtctcgaactcctgacctcaggtgatccatcaagtctcggtcctctcggataggatggtgtgtgatatacaggcggatagtccttctcatggccgctttccgatcagcaagttcaacgatagacacaagaaatcctttatgactccgcgcacctgcatctaacggattgggcaagatggcaacagatctaatttttacgcagctaagaatgaaaaggggagcgaaagcgaagctaagaataagcaggaggcgctgattgctaaaataaccatccttctctgattagggctcttgggcagcccatgggactcaactgggttgcgggttgggtgttgggtgaagttcctggtcacaacaaactttttcttctacggcatcgccgggtttcagaggattccgtgtcccgttaaaaagatcgcctagaatgccttcgtaacggtttatatcccatagatctctaactcggttagggccccttaagacatggcgcttttactgtcgcgaacgtggtttacatctgcggcccgtatacctggttgagccttgtgcccgaatgttca

SEQ ID NO: 614178 - DNA, 720 bp, Homo sapiens
atgaccaaacgcacagtcggtgctgcagtcaacatacgggatgtcacatctggactcacgtccgtgcacttgcagcacggtagaaaattgcgttttccgtgttactccttcgtatgacgctcttgccgtttcattggcctggtgttgagttgcataaatgaaaatgtctttgtgggtgaactgtgtggtgtacggtctgtagaaaattatggattggagttgtaagggtttaacaaaagggcaaggagagcccttgtggagttttcgttacctaatcacagagtggtgtagtgaatttaaaaggacccaaaaagtgttataagttggagcaagggagtatgtgttgcaaaggaatctccttcctttttgggtgtgttgatcctttgtcccaattggggaacctaaatctgttttaattgggagagacgacatggacaaaaagtcattgtattctggcaaggttgtggtacctttccttgggtcatggggctagcaaaacgttccggaaacgcacacaaggaacatgaacaacactgcttggggggcgggcacgcacctcagaaacattctgcgactccggtggggaggggcgcctgtcgcggggtcactggcacacggaggctccgaaaaaactcgggcaggaagacggaggccgcacaaataagcgcggaacggagggcgaaacccaagggtcgcgcaccgcctcaagccaggccgaaa

SEQ ID NO: 614179 - DNA, 429 bp, Homo sapiens
aattcaacttatccactgaaagtcaacagcatacaatctagatcttcaggaagtaggtagagccctggcattcttcctgagacccttggttaaggtcctaaaagtatctgccgctgctgcagttcgtgctgttcgtccatttgcaacttctccgtctcaaagacaatgggaagagccaggatcataaaggatgtgtcccaatccacaaggctgccctggaaaacctgtacatttcctgagccacaaagagggaaagatcaaaagtggctccggccgcggaccgggaccctctccggaaacatctccgtcaggccccatagtctctccgacagggtctcatctagctgtggtggagtagacgcgggtcttagccgaaaaagcgacatccattcctggccccgcttgcggactgggagccggcgagccccc

SEQ ID NO: 614180 - DNA, 120 bp, Homo sapiens
ccatctttaccatgtctgtggaggttgatggcaattcattcgaggcctcttgggccctccaaaaaggacgggccaagcttcacgttggcctttaagtgtttacaaggcatggctttccca

SEQ ID NO: 614181 - DNA, 292 bp, Homo sapiens
  misc_feature (41)..(41): n is a, c, g, or t
  misc_feature (57)..(57): n is a, c, g, or t
catataaaagcagtcatacaatatgcgaccttttgtgtctntcagctggcatagtantttcaaatttcatccaagttgtagcatgtatcagtactttggtcttttgtatggctaagtaatattccgtgtgtgtgtgtggcggatttcgccatccattcatttgttgatggacatttggttttgtttctaccatttggctattgtaatgatgctatggacatttataaacacaagtttttgtatggatgcatgttttcatttctcttgggtatatgcctaggagtggtttaca

SEQ ID NO: 614182 - DNA, 1288 bp, Homo sapiens
ctggtgcactccttccagcagctcggcgtatcgactccctgagcgagcagatttccttcctggaggagcagctggggtcctgctcctgcggagaaagactcgtgactgcccagtcgccccaggctggactgagccgcctcacagcctgccctgcggtcccctatgccctctgtcccaatgatgctgggggtcctatcaagcgcaccctcggggtgacgtgagcggaagggcccatggcgagggccgttcctccgtcttcctccgtcgcaccttcctcggcgtaggctcccctgacccctgggctctcgggactgggggcctgcgcgagtcgtatcgtctgttgagagtccggccgccgtgggctgaccctcgcacacctggtcgtaccccgatcgggcattccacatggctctagcgtggcggaccctcaagtgttgaccggaattggctactgagcttcctcctgcttgcgagcccgtggcgtgcccatgtggtcaacactgcgcccagtgctacggtccaggaccggcatggggctggcgcgtcgtcaccgatgtgcgcgtccctgccgttgtctcctgtagcacaccccgacgcctgccctgacgttagacatcatacttgtatacacaaactgggctgacacaatcgcactatactagaacacgccagctcacacttcacgacaaaggagactcccacctcgctgaaacgcactaccacccgtagcgctatcgcaactaacccttgcgcccctcaaaagattacactgaagcggacacggtgcagcacgccctatcctatggcatgcattccgtgtcgcgacgctgcccctatcttccgggccggcccgccggtgtgctgagctcatcctcgttatcatgcatcaggtgtgcacttcgacagagttgtgcccgctctatgcgcgcctttgttccgcgccccgcgctcaagcggcgctttgaccggcgggcaaatggccgatcgcccggcgcggcggtctcccctggactaagctcctttggacgccgaagctggttcgttggccatgtccacccactgtcctggacacattggcgggcggaacaactctaaatgcggtatggctgctaacccgcctttaccgctcgttttgtcggcccctacggcttgccgcaggttgtcattgtatcctcctttgcttgggtcggtgctctccttcgtgggctggttttgctctcttgtcctctcatcaaattcacctagccctctgcccccgctgctgggttgtactttatgctccccgcgt

SEQ ID NO: 614183 - DNA, 1215 bp, Homo sapiens
  misc_feature (344)..(344): n is a, c, g, or t
  misc_feature (513)..(513): n is a, c, g, or t
  misc_feature (521)..(521): n is a, c, g, or t
  misc_feature (937)..(937): n is a, c, g, or t
tggttattattatttatttattcgggtacacccagagctcctgctataagatcgttcagggaacacccgacagctattgctatcctcctcactcagttagctcacccaccgaggacgttcatgccacagctagccgaccatgattacatggagctttatgactctaagctagagtcatgattgtaaggtttattatgtacgctaacaagttcccatgcgaatcagtgcactggatcataggtatgcactagcaggcagtgctagtgcgtcttaatctagtagccatgcactttgataaagttatagtgttatgtctatgttattgccatgctatggcttgatangtaacatgtgtgaactatgtgcgcgcatcatattattccctaaataaaagtgttcgtttgatgttatatcgagttctagttgatcgcagtactcttatctaatgccactcactactcgacctggtcgtattttacttaggtggcatgttcatttatacgagtgattgcncgttggtntctatgcccagtgtcacattgtcacgttattacagtgaatgtagtctacatttatcgcgattatcgtcaccaatagtttagtatctatgtattctagaatactctcgttgtcatcgaataatttcgatatggatcgatagcgtgaagctccctccgcttgaagctgatagctatatgacactccggtccgcgctcatgagtggatcgtcgtgtttagctatattcgcgtgtgatataatttcagggcatttgctctattctttatgtcactcgctacatatattccattcatgtcatccctttgtatctattactaggtgatgatgttgtcgccgtaagtgtctatgggtagagagctaattgcttgctcttattttgcgttctattaggcgtctcgcttacctaggtgtgttgtntagctgtgtgacacaactattcgtacatggattcagtttccatttatgtgcgactcatcgtcatacgttgtgtatatttcagtatctacgtttgtctttgtgttctcctcccgtgcgcgaactatctgcgtatcgtggttaatcatgatgcgtatgttgtaggaacgtacgaagtgatatctagaagatgttgtatatccatgttgtagattatatattgtctgttctatcgaatcattatgtaaagtgtgatatgatactatatatatcacgataat

SEQ ID NO: 614184 - DNA, 190 bp, Homo sapiens
gtaccctcacaagatgcacagggtaacagaggacgtggctgcgctagagtcacgttttccagttcccttcgcaaactatatttctggaacgcgaaaggaagctttacctatttcatagaagacctggtctccaaggctttattcaggaaggtttgcatctgtttgacaggcactgtgcatgttgtgagcg

SEQ ID NO: 614185 - DNA, 972 bp, Homo sapiens
  misc_feature (1)..(1): n is a, c, g, or t
naagacgatgatgatcgcaaggaagaagcagtaaacagggagcccccccgcagttgaacccgcgcattacccacctgggcccacgggcgacgcgtgtgccgaaggttggacgccccagcttccctcccttgcgagcccccgtggacctctccgggaatggggaaagaccgagcccctcggggggcccagaaccccacgtgggggggccaccccaaaaccctcagaagcccggaacaatgggccctcctcgttcccccggatcaaaattgtcggggccctgttgacgccgcagcaactgtcggcggagagacccgcggtggttagaatcagaccgcggccgcccctctggtcgtaatcaccccgcgcgggggtccctacacgacgaaagcctcatgcagagcgggcccccccttaacgagcgcccaattcggaaatcttgatggaaacgggagggactcacattgtacataacagtcctcgaaaaaagatgctctctcaaaaatgagatgcccccacaaggtattgggcacccacggatggagggatcccccctaccagaccaggaaccaccattcgtgagaggaatcgcggaaaaaaaccaatgctcacaattgtcatggaccgatcaaagcccaaaattctcttgctcgccagatgaatgggtgcgcacacaaccaagcttgtacccacgactggtgcggaagactatttttattcgtccccccatcgtcttgggataatcacaaccccatggcgcgttcttcaaacagtcaagtggttatcttgtcttgcagaagccacagccaatctgcgaaacacacacaggttctggtaaatcagaacttcattgtcacaaatctctccgcccggcacctcgtcacctatctaatttctcggaggtctccaaaacagaaatacagaaaaaaaaacagagaaaaaatcccacaaaaaaaatttagagcccacataaca

SEQ ID NO: 614186 - DNA, 275 bp, Homo sapiens
tttcgtgtttatctacttgggggcgtgatcatttgaagtcatctttatctctcagagttaagctttattgtagaagaaaaaaaaaaaaagttaccaaagccatagataacacttaactcacagttcccaggaggacccttgatctcaaagctgatcttttggagtcagatcctacatcaaaccaattagggccagtttagggcatttccttcctggtgatggggggtaaacttcttggctctgtcggagttggcagataagggtctctgggcagg

SEQ ID NO: 614187 - DNA, 956 bp, Homo sapiens
gtgctcacggcttgcttcacatgagatagtatataatcatagaaaggcctaatgagtgtatagaatgtggaaagtacattagacaaccttgctcaagagtcactcattgtccggatgttcataatggaatgaaaactcttggagtgtgaggtaattgtggaatgatactctaattgaggtggatcaagatgctatacttagtatagtcacaagtatagtcgaatagtggtgagaaaccacttagtgaaaatgtaaggaactgtgggaaatgcctcttcaatggctggatgtcatgggattcaatcgagtatgagagaagtaacatgcaggagatggacaaggcgtgtattgaattctgaaaatgacatgcgtcgacaagggtcttttggtgtagctgggatcaagaattctcttctgaccttgcgatggttcatatctgctgccatacaagaactctgacactgtcctgtctggtcctgcaaggggctttagatcttgagttcaccacagattcttccagcaatcattagcatccctagtacatgtgtgatgaaactctctaccgacattgtcctgttgacccgtggaacatagggcgtttggttcctgcgcgcgtgcgcttgttatgaatcgtcgcgatgccctaccttactgggggatggaaacactgtgctggtggtcagagtcatggtggtgaaaggcgtacttgtgcagagtgagacatgtttatgaaggaatcatagaattcatgactatggtgtcgtgaaacgttatgacatatagtggaactgtgggagacgaattattgggtgaccataatattattggataaatagatggtacagaggagaaagggacggaagaggtgaaggaggttaagcctggatgtatgaagtgtgagttaaatacggaaaacacaagtttaagtgaatgggagagcgggaatgtggaaaata

SEQ ID NO: 614188 - DNA, 548 bp, Homo sapiens
  misc_feature (37)..(37): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (97)..(98): n is a, c, g, or t
  misc_feature (103)..(103): n is a, c, g, or t
  misc_feature (111)..(114): n is a, c, g, or t
  misc_feature (133)..(134): n is a, c, g, or t
  misc_feature (138)..(138): n is a, c, g, or t
  misc_feature (140)..(140): n is a, c, g, or t
  misc_feature (142)..(142): n is a, c, g, or t
  misc_feature (144)..(144): n is a, c, g, or t
  misc_feature (149)..(149): n is a, c, g, or t
  misc_feature (153)..(153): n is a, c, g, or t
  misc_feature (155)..(155): n is a, c, g, or t
  misc_feature (161)..(161): n is a, c, g, or t
  misc_feature (163)..(164): n is a, c, g, or t
  misc_feature (167)..(167): n is a, c, g, or t
  misc_feature (170)..(170): n is a, c, g, or t
  misc_feature (176)..(176): n is a, c, g, or t
  misc_feature (205)..(205): n is a, c, g, or t
  misc_feature (211)..(211): n is a, c, g, or t
  misc_feature (235)..(235): n is a, c, g, or t
  misc_feature (254)..(254): n is a, c, g, or t
  misc_feature (314)..(314): n is a, c, g, or t
  misc_feature (316)..(316): n is a, c, g, or t
  misc_feature (323)..(323): n is a, c, g, or t
  misc_feature (326)..(326): n is a, c, g, or t
  misc_feature (330)..(330): n is a, c, g, or t
  misc_feature (332)..(332): n is a, c, g, or t
  misc_feature (368)..(368): n is a, c, g, or t
  misc_feature (394)..(394): n is a, c, g, or t
  misc_feature (419)..(419): n is a, c, g, or t
  misc_feature (422)..(422): n is a, c, g, or t
  misc_feature (539)..(539): n is a, c, g, or t
tccgttccatgggccagcacaggcaggcgccattttnctgatatgaggacctggggtagctcagacatttgactanccaancccagaaagganatanntcaanctcttacnnnnaaatccattaattcccccnntccnantnanttctnactnanataatncnncanctntaaaantaggggtttggcttctggcccagatccangccctngtcctctgtcatcacctggaaggnagcaacactgacgtaatcntctgccactatctggaagagctcgtccacactctggcctgtattgctggatgtttcaaananctgagcnttnatantntctgcatagtcctggacgtcgtaggaagtacacacntcgacgcctccggtcttctcccagcnggtcactcttggtgccacaaaagtnganttggcagccctcctctaggctgcgcagtcccttcacccagaactttgctcgctcaaagctgccgccgtctgtaaggacatagcagaagatggcagccatggcaccccgatagttgantctactcat

SEQ ID NO: 614189 - DNA, 560 bp, Homo sapiens
aggactttcttacgcccaaactctctcccccccgtacaaccaattctccctccctctttttctgaatctggtcagaccagttctcagagtcactagactgctggtgatttgcatttctctccctctcagaagggaggaaccattattcacaggtcatagctcagctcaggagattgtgttgcgggccacagattgccttaccctgctggcatcctctccaagagacactcctgctgctctcacccacaaggaggctcaggcccaagcattttgtgtcgggctttagagtaatatgaacattaggtctgactttggcacttgacctgaaagaagatggggatgggatgactttgcgtcatcctctctctcgagacaacaaggtatactatgcagctagttgtagagaggcaaggcagatttaattctgttcttaatgtatgtgcatctgtaatgaaatgaaacatgggtaagactggataatatggttgtactagtcttctttattaagcccgcacctatgtttttaaggatgtgcgtatgaccacaaacgtttctgtaga

SEQ ID NO: 614190 - DNA, 132 bp, Homo sapiens
ttgtaatagtgtaatcagaacttttagcagaaaatgctcggtcttttatctaaggcttgaattgtaaagtgaaggcataaaagttaccaatgcattaagtaactcttaaaatggcacacaggttttaaagct

SEQ ID NO: 614191 - DNA, 228 bp, Homo sapiens
aacccgggaccctttgtctgggttggaaaggattctcaagaagaagaaaagacagaagccttacttctgctaaaccggtacatcgagacggacccgccaatcgggatcggcggacgcccctcaccgtgtgaagcaaggctctaagcctccctcctttgtgggctggttccttagctgggatgatgattactggtctgtggaccccttggacgcggccatggctgatgc

SEQ ID NO: 614192 - DNA, 223 bp, Homo sapiens
  misc_feature (42)..(42): n is a, c, g, or t
  misc_feature (139)..(139): n is a, c, g, or t
  misc_feature (141)..(141): n is a, c, g, or t
  misc_feature (181)..(181): n is a, c, g, or t
  misc_feature (218)..(218): n is a, c, g, or t
atttattaaaaaaatgttaataaacttagtgtagcccaagtntttatagtctacagtagtgtacagtaatgtcctaggccttcatattcactcactcaccactcacttactcaaagcaacttccagtcctgcaagcttngnttatagttagttccctatacaggtgtaccatttaaatttngtttttttgagacggcatctcgctctgttgcccaggntggag

SEQ ID NO: 614193 - DNA, 892 bp, Homo sapiens
gtatttcctcacgcaagcaacgatccataatccttctaatagctatcctcttcaacaatatactctcgggacaatgaaccataaccaatattaccaatcaatactcatcattaatactcataatggctatagcaataaacactaggaatagcccccttacacttctgagtcccagagtttacccaaggcaccccttctgacatcgggctggttctctcacatgaaaaaattagcccccatctcaatcatataccaaatctctccctcataaaggtaagccttctcctcatctctcaatcttatccatcatagcaggcagttgaggtgataaaaccaaacccatgctaacgcaaaaatcttagcatatctctctcatttccccacataggatgactaatagcagttcaaccggtaaaccttaacataaaccattcttattaacctatttatatatctaatataccgaatctataatcaatttaaatcgagcacaggacctatataaattcgcacctgaaaaagctacatgataacaccttatcatcacctctctcctaggggcctgccccgggtaacgcggttgttgccaaagtggcatatcgagactcaaaaaaatgcttattatcccacaatgatggcaatacctctagatttatttactagctattatcacttataaatatccatattacaggaaataaaggcgtgataaaaacaccatttccaataaacttagggatcagatttcctttttaaaaaagaaaaaaagtgtgggggcggaattaacatgggggcgaagaggaagtcgaaggtagggttcaagaggggtagtatgtagatatcggagcttgatgaaaaagagagaaaggaaaagactgctagcaagggaggg

SEQ ID NO: 614194 - DNA, 103 bp, Homo sapiens
aagctcaggacagacatgaggtggcagactggtctccaattcccggcctcacagtgatcacatgcctggccactctatgtcttgttccttgcttgttccgctg

SEQ ID NO: 614195 - DNA, 372 bp, Homo sapiens
  misc_feature (101)..(101): n is a, c, g, or t
  misc_feature (161)..(161): n is a, c, g, or t
ggtgactctagaggaccctgctgctcctcttcacagctctccgccggtggatatttggtgaggaggggagtacttgtcacatgttgttggtgactggtacntggtcactccccggccattaatacagcaatccttcttcacgatggccttgtcagtcaggncggacatgacactggctgcaccggctcctgcgacctcacttggagggggcagatgaaccacatatccatcgccaacatagatggcccagtgtctgtagaaagggcgaaaaatctcaatcaggtctccaggcttaggctctggaatgggcgcacgcatcttccctcgcggtgttggacctcaagggcaggctcgatttcgctgcgtatatat

SEQ ID NO: 614196 - DNA, 221 bp, Homo sapiens
ggcaacagagcaagactccgtctcaacaaaaaaaaaaaaaaaaaaaaaaaggaaaaaaaaaggttttttttccggggaaaaaaaaggggggcttattttttgggggcctttccggggggccaaaaccctggccaaccataaccaattaaaggcctttacccccggggggaaaggaaaaaactttggtaaaccctgggcaaaccaaggggtttttcccccag

SEQ ID NO: 614197 - DNA, 429 bp, Homo sapiens
ggaagggaaaggtgaagaaaggaaataaaaatggcacagagtgatataaaacatattctgctccatttatagaatctacattttctgcatctaccagcattagagaggaaagttggacattaacatggaaatgtttttcctcataaacccagtatccaatttgtattggctatagacattaagttaggtcatttattaatgctttattttcaattctcttttgttcttgcatctgcttttgtatgaacaaagcctgcactgtaatcagttctgtcctcagttttcttagtagactcataaacaataattctggaatactaaaataatactacatattttttaaaatcactaagtgccttccaaacagttgctttcagtgtattctcaggcacataacaacaacaaaaaaatacatttgatttactacca

SEQ ID NO: 614198 - DNA, 714 bp, Homo sapiens
gccgaggtggccctgggttagcagctgctgcatttccccgggtggctgcggtcactggtggcagtgctcaggcgcccgccgcccttgaccttcggcccgcgagctctaaccctacagcgcaggaagatcggcgccgcgggcaggctctgatgctggtgtctggtagaagaaggttagctcacagttctgctgcaggctcagaaggtgtgccctttcaaccctccagagacatgagactagtgcagttcccgggcaccccacctggtgtgggcctcacttgggcctggcagacacgggaatggtggaggggtgtatcaagcctcaaatgccttttgaaccctatcactacccgaagacgatgacgcgagtgtcctagagacagggtagaggccacgccctctcatgtggcaacgaagagccctggctgtccagttgccagtcctaccacggtcggaggtaaccttccggggtccagtcacacgagtcagataaggtggtgtgtgtgggcgctgaattatgtggagccactgcaaagaactagaacgtgcccgtgccaaggagcccatcatcttcagcaggtttgcagtccatcgtggggccctatgatgaggtggtcctcccgacactagagccaggcggtagattgcgaagtggagctggccggctcattggaaagagggcagctcatcaagggccagatgctatggccacggg

SEQ ID NO: 614199 - DNA, 112 bp, Homo sapiens
atgggctggtggacaatgacagggatcgtcataacacagaacttatattcgtgtacggaatgtgccagctgtacttaaaaataaaagaatcccagacccatctccatgtgca

SEQ ID NO: 614200 - DNA, 182 bp, Homo sapiens
  misc_feature (64)..(64): n is a, c, g, or t
  misc_feature (122)..(122): n is a, c, g, or t
  misc_feature (146)..(146): n is a, c, g, or t
ctggagtgcagtggcacagttctctgcaacctcagcctttgggctcaaatgaccctcctacctnagtctcctgagtagctgggactacaggctcatgccactatacctggctagtttttggnttttttgtatagatggggctttgncatgttgcccaggttgatcttgaattcctgggccca

SEQ ID NO: 614201 - DNA, 134 bp, Homo sapiens
  misc_feature (55)..(55): n is a, c, g, or t
cctgtgcgcgcggccgggacatcgagggtgtcatcaagcagtacaacaaggttgnctagccttgccgcccacaacccacgcgcgcacatttcacgcgcccacaacccacgcgcccacaacccacgcgcccacaa

SEQ ID NO: 614202 - DNA, 232 bp, Homo sapiens
cagcctggagctagatgaggcggactactactacaagagtgggaggagggcaagagcctggagtgtaagagggcagcctgggaacacctccgcttaataggctgtggttagagacgaacgagggactcgctaggcaacagacccagacctgaccgctacggagtgtacttaacctatgacatgcaaggctagaaggccaaggactacagatatagacaatactacctaccta

SEQ ID NO: 614203 - DNA, 839 bp, Homo sapiens
  misc_feature (393)..(393): n is a, c, g, or t
gggtgggactcggcgtcacgagcgggagacgtgaagctctcgaggctcctcccggcctgtgaggtcggtgctcgcccattcgtgctcctcgaccgctccgtccggaccccgggccggggctcgccactggagaagactgagctgatccagaaggccaagctggccgagacaggccgaggcgctacgaaaggaacactgggcactctgcagtgacatggcatgtgtagctcgatgtcaggagacggacgcgtatgcgtgtccacacagaaggggaggcgcagatcgtggcttctcacggtgtggccatacaatgaacgatggatcagggggtcgcggaggtacctggctggacgggtcactctctaggcattcgaagcagtaatacccgagacnctccgagtgacgaagtgtgcatgctgatttaagggacttactcgggagtacaatggtggaggttcgcggagctgaggagtctgatcatggacgcagcggtggtctgggaacattgtcggagtaacactaatgtgtaactaagccaaatggcaagctaagtcgcagaggagtagaggggtcttctattcctgaaaattgccccagggtgactttacctatcgctggtaaccttggctggaacggttgcgtgtgggtgactgatcgaggatagtagcccggatacgtataagtgttccccaaaggcagtgtttagcactgagggcccctttgactgctaaagcaagggcgctgattgcaagcccactggcactcgcacactcccggctggggggtgtggatcttaacattattgatgtacttggaccttatgagaactccttattaac

SEQ ID NO: 614204 - DNA, 955 bp, Homo sapiens
accctcttcattttaaattaaaaagcccccagttctgtgtggtgtagcaaaataaacagttgcggcgacgcacttcttcctggaggccttcgagtctccatgatttaaggagacgagaaaggtaaggaggaccggaacaattccttcgcggaacctttgaggtgaggcctcgcggagccatttgagaacggaccgcggcgggctggaaccagactagtaggcatggcggcggcggagccggatgcggacccgaaggccgccatccctgtggacctgcggcgggaacggcgcttggtgtgcgtggagtacccgggcgtagtacgtaacgaggccaagatgctacagaccctgggcggcgaggaaagcgtctctcgaatctacactgaccctaccaagaggctcgaactctacttccggcccaaggacccatactgccaccctgtgtgtgctaaccgtttcagtaccagcagcctgctgctccggatccggaaaagaacaaggcgtcggagaggtgtcctgggagacgaggcccacccccaggtcacgttcaacttggagatcattggcatcatctccacaatttacaaattccagggaatgtctgacttccagtacttggcagtgcacacagaagctggtggcaggcatgttccatgtgtgacagagtggtcatggcgccaggcgtgagaagggagtgagtcgttccatcggagctacctctaatcccccacccttttttcagggtgggacccgggggcatatttattggccgtgaaacagggcggagggtaaatccccctttcgggagcctcgtggtgtgggtggcggggccagcgttgacggtttggtctggtgtccctgtggggtccagtgaggggcccttagggggggggcgttcggggaagagtgcgcgtcttatacggggtgggcatttgttgtggcctctctgttgtgt

SEQ ID NO: 614205 - DNA, 202 bp, Homo sapiens
ccctgtcatagcagataggcactgttggcgcacgcctgtagatcccagcctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgcccactttgcttag

SEQ ID NO: 614206 - DNA, 401 bp, Homo sapiens
  misc_feature (50)..(50): n is a, c, g, or t
  misc_feature (132)..(132): n is a, c, g, or t
acatttaaaaaaaacccagtgcatacacctgtgtaaaggaaatattgtcnccctagtattataagtgtattttcctatattatgtggtccttaaaatatcaaatgaatgcccattaaaaaagaaatattttncccaggcatggtggctcacacttgtaatcccagcactttgggaggacaaggcaagtggatcacctgaggtcaggagtttgagatcagcatggccaacacggcaaaaccctgtctctactaaaaatacaaaaattagctgggtgtggtagcgtgcgcctgtagtctcagttacttcaaaggctgaggcacaagaatcgcttgaacctgggaggtggaggttgtagtgagccgagacgggccactgcactccagccagggtgacagagcag

SEQ ID NO: 614207 - DNA, 700 bp, Homo sapiens
  misc_feature (61)..(61): n is a, c, g, or t
  misc_feature (81)..(81): n is a, c, g, or t
  misc_feature (137)..(137): n is a, c, g, or t
  misc_feature (146)..(146): n is a, c, g, or t
  misc_feature (168)..(168): n is a, c, g, or t
  misc_feature (177)..(177): n is a, c, g, or t
  misc_feature (388)..(389): n is a, c, g, or t
  misc_feature (396)..(396): n is a, c, g, or t
  misc_feature (431)..(431): n is a, c, g, or t
  misc_feature (467)..(467): n is a, c, g, or t
  misc_feature (515)..(516): n is a, c, g, or t
  misc_feature (532)..(533): n is a, c, g, or t
  misc_feature (537)..(537): n is a, c, g, or t
  misc_feature (539)..(539): n is a, c, g, or t
  misc_feature (550)..(551): n is a, c, g, or t
  misc_feature (590)..(590): n is a, c, g, or t
  misc_feature (607)..(607): n is a, c, g, or t
  misc_feature (620)..(620): n is a, c, g, or t
  misc_feature (628)..(628): n is a, c, g, or t
  misc_feature (666)..(666): n is a, c, g, or t
gctctcctgcctgtcgccatgttttcaggccgggtctggcttggtcttcccccgtaagganatggccggggagctccaggngacccaggcgccgtcgcttcggcggactgggctgaccagccaggacagcggggtanacccgaacnattctgcgcgaggtagggaggncatggcgtncggcagtaactggctctccggggtgaatgtcgtgctggtgatggcctacgggagcctggtgtatgtactgcaatttatttttgtgaagaggcaaaaaatgcgcattgcaatgaaatctcgaaggggacctcatgtccctgtgggacacaatgcccccaaggacttgaaagaggagattgaaatccgactctccggggttcaggaaaacaannatgaacnccagcaccttgcagaagaagaagcaagaatacaanaactggaaacccagggaaatcaaagtagcaacaacnatctgtataggatgaaagcactaaaaaaaaaaaaaaaaaaaaaaaacnnaatccaaaaaaaaggnngggntncccgttccttnntgggcaagaatttccgctcctacctgctggatctgcganacactagtacgcctttnaagggtgtacgcnaagcactnattgataccctttgtggatggctatgaaacagcccgcnatgggacaggggtctttggccagaatgagtacct

SEQ ID NO: 614208 - DNA, 113 bp, Homo sapiens
tttttttttttaaattctatggtaacaaaatcagttcaggggcttttctgaacaaatgatcatgatccctcagtatttccggttggctctgcgcctgcaatcccagccgacat

SEQ ID NO: 614209 - DNA, 606 bp, Homo sapiens
  misc_feature (42)..(43): n is a, c, g, or t
  misc_feature (47)..(47): n is a, c, g, or t
  misc_feature (52)..(52): n is a, c, g, or t
  misc_feature (54)..(54): n is a, c, g, or t
  misc_feature (56)..(56): n is a, c, g, or t
  misc_feature (60)..(60): n is a, c, g, or t
  misc_feature (65)..(65): n is a, c, g, or t
  misc_feature (67)..(68): n is a, c, g, or t
  misc_feature (72)..(72): n is a, c, g, or t
  misc_feature (81)..(81): n is a, c, g, or t
  misc_feature (93)..(93): n is a, c, g, or t
  misc_feature (100)..(100): n is a, c, g, or t
  misc_feature (103)..(103): n is a, c, g, or t
  misc_feature (119)..(119): n is a, c, g, or t
  misc_feature (122)..(122): n is a, c, g, or t
  misc_feature (124)..(124): n is a, c, g, or t
  misc_feature (143)..(143): n is a, c, g, or t
aagctccgtacaaaaatcaccaccttgaactacatgtactcnncgangaccngnantggnaatcnannggcntgacctgcnagccagcctggngccgctnggnatcaacctgaagatgnaananctggccaacgccaccatgngcgagcgcctgggcaagggtgacttcgacgtgtccatcggctcgtgggcgccgacttctccgatccctacatgtacatgaacttctggttcgactcctccctgcaagggctgccgggcaaccgctcgttctacagcaacccgatggtggacaagctgattcgcgacgcggcggccaacaacgacacggccaagcgcaccgagctgtaccaggaagcccagaagatcgtgctcaaggacagcgtgtacgcctacctgtatcagaagaactacaccctgccgatgcgtgattcggtgaagggttatgtattccatccgatgctggagcaggtgttcaacgtggctgagatcagcaagtaacacgcgatcaaatgtgggagcgggcttgtgtgggagctggcttgcctgcgatagcatcacctcagcctgcctgacagaccgagggtcgacgcggccgcgaattta

SEQ ID NO: 614210 - DNA, 137 bp, Homo sapiens
cgacgcccgtaactgagtgcagcagcggtgcagcggggctcggccgacatcgtgatgtggtgcggatagggcactgaggggtggcgcgcggcaggagcacgcatggtattgacttaaaaggttcattttttgtgtgt

SEQ ID NO: 614211 - DNA, 163 bp, Homo sapiens
aagaaaaaaataggaaagggtcataaaatctcagtctaattgaggtggtgaggcttgcgggggtaaactagtggagggagtgcatggcttcatgtgagtacaccacgaaccctcagggggggggaggaaaagcagcctcatcagtaggtagagagccgggcaa

SEQ ID NO: 614212 - DNA, 341 bp, Homo sapiens
atgagctcttagtgaatttctgtgtcaaggatgtgtgcatttaagttttgatctgctgggcacagtggctcgcacctgtaatcccagcactttgggaggccaaggcgggctgatcacttgaggtcaggagttcaggaccagcctggccggcatggtgaaaccccgtctccaccattaagcagggattacccgggcatggtggcttgtacatgaggtcccagttactcgttaccctcaggagggacacttgcttggacccaacaggcccaggttgcattcaaccaagattgaaccactgcactccaggtgtggttacaaaaaaaaactcccaatcaaaaaaa

SEQ ID NO: 614213 - DNA, 274 bp, Homo sapiens
atccgccacatgaatgcagaagggtttcctatggtttctctagaatttttatggtttttggttttagatttaagtatttaatccatcttgagttgatttttgtataaggtgggagctagggatccagtttcattcttctacgtatggctatccagttttcccagtaccatttattagataatgtgtcctttccccaattttgtttctgtatgctttgtcaaggatcagttggttgtaagtatttggccttatttctaggttctctattcttttc

SEQ ID NO: 614214 - DNA, 332 bp, Homo sapiens
agtatccactctggctctctcctccactgcaaggggaagagtggcgaggaggggctggcactgcccacccctaggcattcggaaaaaccctgcttccaaggcttccctctacccctgctttccaacaggctctgacctccagacagacggttcaaagttacaagtgctttatgccctcccttgattcccccaggcccattccttgcgctaaatttaaggggcacctgtcaaaacccttgcttttctaattcttgcatcctcattcatcctgaaagaggtccggggactgagagtgagtctatactgccaggggaagggggaaaggatgttgg

SEQ ID NO: 614215 - DNA, 121 bp, Homo sapiens
taagtttcttctttgtaaatttcctattgggtggggtaacgattttactatatctttgagtttaaaatctctgctgtgtagactctggcagctgcctctatggggacgaaccaagcttttt

SEQ ID NO: 614216 - DNA, 750 bp, Homo sapiens
tgggaaagtcatgtcaggggtagtaatataattgttggggacgattagtttaagcatgggagtaggttaaggtaatagtacgtagtcaaggccattatgtggttggagattgagactagtagggctaggcccaccgggtgcttcgcaggcggcaaagactaagttagggcaataggcacaattattggctaaaaagggagtagggttgtcgagggtctatgaaagtacgctataatgaacagcgattagtattaattcccttctaagggctataagttagggcgggcatatatgaggtggtggacgcgatatatcactaagttattccctaagaaatgtggagtatggtgtaaatggctcagttataaatatattttcccagccccggattggcccagtattggccaagtgagaaacaagagaacccactttgtgcggcggaggagacagatgagatctctctcttcacaaaaacactcttctctttcacagagtgagagagaaccgggtgctcgctgtggtgcaagatgcacaccttgttgtgccccccgcgagggtctgagtgggtattcggcgaaagcactcttgttgggaagaccaccccacaccatggtcccattgtgggtatgagaacagtgtatcccggcactttggggggcaactctaaaccctggcgcatgtctttctttaccacacccttggaaggccggtgtccatcacaacagggggcaatggggaaagaattggtcg

SEQ ID NO: 614217 - DNA, 1078 bp, Homo sapiens
ggccaatccggctcggctccggccctgatggggcacaggaaatcaagcggtatgtcttctactccagcatgagctggaataagctataccgtgcgtgagatcaagccaggctttcaagccagtcagtggctcagacctgatgacacctgtctactttgagacgcagagttctagcgtcccggacatcccagaggattgccccaggcaatccccacctcgagcagctgggtgcccatcagcgtgttccggaggcttcaggcttcggtggccaccggcctgatgtgatagacgactggcaagccgtcgtgccccgcaggcacccctgcagctcggtgcgttacaagcgaactccaatggaggacagaacctggtttctctagttgacggctgacgtggtagataggcagcacgaatcgcgtgtggggtgtccttactctgcatgtgccaagcgctgtgtcctacacaggcccaagccaagggatggaagtaatgctggtcgacaggtccattgatcccggatgcatacactgcggattcctctcaggaaggacgactgtgagagacttggttgctagcaaggtacagggggcaaatgccaccttcataaagcatccatcatcgtcgtttgagcgacgggagacgtggttatcgacttgactgggcatagctcaaccgtagtaaccctaggtgagaccgacgcatgcttgatcgccggggggtcgccgtgggccgctgcgctctgggagacatatcgcattgcttggaccgcagtacaggatccccaccggacgaagccgcggacaggaccccaagcggtctggagtccacatgggcaccaacggcaaacagcgagcagaaacactttgcgggcagggaaaatcatgggcaaggcgacacagcgggagggtaggtcgacacaagggggccagcccagccacacccacaaaccccacaacataacttggtactgcttgcatgaaacgacacacggggaacatacccggaagcatgcacatgacgctatacgggacgaacctcgcgggtagggccaaaagccagactgagcggatgacaacag

SEQ ID NO: 614218 - DNA, 219 bp, Homo sapiens
ttttcaccacattggccaggctggtctcgaactcctgacctcagtgtaatccgcccgccttggcctcccagagtgttgggattacaggcatgagccacggtgcctggtccttcctactattttatttcttttttttttttttttaggaaaaaaaatttttgccttgacacccaggttgaattcgggggcgatactctcagcatcactaaaacccccacc

SEQ ID NO: 614219 - DNA, 129 bp, Homo sapiens
gttccgtagatggtggctttctttggatccctgtgcctcaacctagttactatttggtatgaacttaagtcattccagtgcctctctcagatagcattggcagtttatgaatttctgtgcccatttcaa

SEQ ID NO: 614220 - DNA, 112 bp, Homo sapiens
  misc_feature (53)..(53): n is a, c, g, or t
tcgtagggagcgttaagttgtgtctcactgtggttcgttttgcatttccatantcctcatcctgtcttatatagctggaaaactaaaatgctttttacatgttttaattgtt

SEQ ID NO: 614221 - DNA, 768 bp, Homo sapiens
  misc_feature (447)..(448): n is a, c, g, or t
cttagtctgtactgctgtcactaacagaattacacaacactaagtatttgataatgaacagaagtttatttggttgacaggtgtggatgctaggcagtccaagaacatggtgccagcatctagtgagggtcttgccatggcagaaggcaccacatggtcaagtgagcatgagaaagatatatgtggtctaaacttagtccttttatcatgagcccactcccaagatagcagcactaattcattaagtgagggcaaagccctccttacctaattacttttaagaggtctcataagcacttttacaagtgtcaagtgtaaagtttccaagcagcttgagactttggcgggacactagtttaacaccccttacatcaggaggtgctccacttcacctgacataaggagctcagtacagtgggtacgctaatcactgtggctattgtgctnngcaaacacactggttatctatccatgggagctctaagacattctaggtacaatggtacgcgtacgaatggtacctacgtgacacagccccccagtaaaagaccctgggcactgtaatctctaacaagtttccctggtaaacaacattatctcacatgtagtcacaattcagttgctggtggcatgaaacaacagatatgtgtgactccactggtaaagaggactctggaagcttatacctggtttcccccagactttgcctctgtacctattctctttgctgttttgcttcatatgcttttgctgtaactaaatcatagc

SEQ ID NO: 614222 - DNA, 238 bp, Homo sapiens
  misc_feature (6)..(6): n is a, c, g, or t
cgcggnacccaaatattatccttccttcttatgtgtgaaatctgtgtctgttacttccatgtatactacacatattcatttacacacatttttgcacacacttattgtttaaacctataaaaaagaatatcatacaatacgtagtcttttggaattaattttttaatattaaattgccaagattcatctatactttatatgccactacactttgttctttttaacttttgtgaaatat

SEQ ID NO: 614223 - DNA, 315 bp, Homo sapiens
  misc_feature (84)..(84): n is a, c, g, or t
tcctcaaggcggtggtttgaaaaaaataaaaacaaggaatggaagctgggtctaagtcctcttcgtccccgcccaagtaacaanttgggaagccctttccagcttacccttcttgcgttgccccaaagcttgggaaggaggcccttattcagggtagccttgggaacaggaaaccccctttagggtaagccctagccctaagcccccctggggagttttttacctggggaccccccttgcccatgcctccaggtaaaaaaaaattcaattggtttttttttttggtccaaaaaaaaaccccagctagttttgcca

SEQ ID NO: 614224 - DNA, 111 bp, Homo sapiens
gagtattggtgctacattattgcgctcgatatcgaggtttctacgacagatgtcattcatgactctttgtctaccatgatggcaccatcagagtgctccacgttggtgtgg

SEQ ID NO: 614225 - DNA, 455 bp, Homo sapiens
agtgtagtcgaatgaaaatataaactgttgacagatttggtgaaatagtcacaatttggctatcaaattcatttggttttcctcaaattcgtgtaaaaaaaaaaacagacgcacaaactggccgtcactgatttctccaggactgggcagtctgccctcaaaagcttcagacaagattcatgagtataagcctgaaaaagagaaacctacaacaccgggaaatcggcctaggtccccatataaatccgcttaacacctcagtacgaaactcccccatggtattagaacataactaacaggttcccataagtaagttccagaaaaccaacatatggccgacctcagggatttttaccaaccactcgcttacccttgtggccttgggacatggcatgctggtctaggatcctctacgcaaaggccgtgtcgctcctcgtgggttgccaagcaagccg

SEQ ID NO: 614226 - DNA, 420 bp, Homo sapiens
  misc_feature (357)..(357): n is a, c, g, or t
  misc_feature (379)..(379): n is a, c, g, or t
aatggaaacgttcaacacacacacagcagcagtcacccaaacaatttgcaggtgaagcataagccaatacatatatacgtacagtttgtcaagagtctagtctcaatgtctccaaaacatgaatccttatatttctatcattacagttacatgcaggtgctaggaattcactaggagaaagatgattagtcttatagaacgtaaattcacatattgtgcatcctgcaacattattgttacacggtcagttggtagcttgtactctctgaaatgtaatctatccagagattgctgtgatagctattagagaacagttttgacgtacgagaattgaacttcacattcagattggactgntcctgctctttcacattggaantttaattacagcgctctctctagagttgtttcgtgtgtcat

SEQ ID NO: 614227 - DNA, 642 bp, Homo sapiens
  misc_feature (130)..(130): n is a, c, g, or t
tccaagtaaaaattacgctatctaggaatgtaccaaccaaaatctcgtatggcagatcttgacaggctggacctgcaagatgtggcttcgaattttaagccatgttattgacataagtctcatagtgatncgatgcatctagttatcataatgaagataatttaaagaggtttaatgttggcttgaaaagcagtaagttgggtttgcaagatagaagatacgtttacagctctcacttttcaaaatatggaaaagtggttttaattccttatcatgtggcaaggcacggtagagtttagaggacaaaccaattgggggggggacaaaaacacatgggacaatttgcgtagggaccactcttgttgcattcgggttaacgtaccgatattggggcccagaatcacaagccacaaaccaagcgacaacgtgggacgttgtgggcaccccccccatatttccggtggggcctctttggcctgtcaagggaaaaacgaagccctgttgttcgttcgtcatcccattcacagccgcatgtcttggatttcacaacagccctcgcttatgcaaacagtttttcacacaaaagagtatgcgatcagactacttactcatcttacacaagttttcattgcgggaattcgg

SEQ ID NO: 614228 - DNA, 168 bp, Homo sapiens
  misc_feature (17)..(17): n is a, c, g, or t
tcttcatatttacttanatacatttcagccttgaaatatcaattcaaaggccatgcgcggtggctcacgcctgtaatcccagcactttgggaggccgaggctgacagatcacctgaagtcaggagttcaaaacaagcctggccaagatggtgaaaccccgtctctata

SEQ ID NO: 614229 - DNA, 1003 bp, Homo sapiens
  misc_feature (19)..(19): n is a, c, g, or t
  misc_feature (65)..(65): n is a, c, g, or t
  misc_feature (69)..(69): n is a, c, g, or t
  misc_feature (73)..(73): n is a, c, g, or t
  misc_feature (90)..(90): n is a, c, g, or t
  misc_feature (98)..(99): n is a, c, g, or t
  misc_feature (103)..(103): n is a, c, g, or t
  misc_feature (150)..(150): n is a, c, g, or t
  misc_feature (166)..(166): n is a, c, g, or t
  misc_feature (169)..(169): n is a, c, g, or t
  misc_feature (203)..(203): n is a, c, g, or t
  misc_feature (348)..(348): n is a, c, g, or t
  misc_feature (380)..(380): n is a, c, g, or t
  misc_feature (462)..(462): n is a, c, g, or t
  misc_feature (550)..(550): n is a, c, g, or t
  misc_feature (586)..(586): n is a, c, g, or t
  misc_feature (591)..(591): n is a, c, g, or t
  misc_feature (609)..(609): n is a, c, g, or t
  misc_feature (999)..(1000): n is a, c, g, or t
acatccgttgaattttaanatttcttgtgggcccagatgtatacccatcatgcgttgcaccaccngacnacgntcagcaacgtcaagatngacatctnncccnacatgaggcggcaggcagccctgggctcaagaggaagtaactgaagnccgtctcatcccatgnccnccatgtaggggagggactttgttcaggaagaaanccgtgtctccaaccacactatctacccatgacagacccctttcctatcactcaaggccccagcctggcacaaatggatgcatacagttctgtgtactgccaggcatgtgggtgtgggtgcatgtgggtgtttacacacatgcctncaggtatgcgtgattgtctgtgtgtgcatgcntgtaccgccacatgtctacctatgtgtctttctgggaatgtgtaccatctgtgtgcctgcagctgtgtactcctggacagtnacaaccctttctctccagttctccactccaatgataatagttcacttacacctaaacccaaaggaaaaaccagctctaggtccaattnttctgctctaactgatacctcaaccttgcgggccancatcnccactgctccaaatatantactatgactgcgtcccagaagttttgggtttaccacactccccaaccccccactcctattttctgaagggccctcccaagggtacatcccccccccccagttttccctgagagagatcaacctccctgagatcaaccaaggcagatgtgtcagcaagggccacggacccccatggcaggggtggggtttttattagggaggggcccaaagcccttgtggggggacctcccctgagcctgtttgaggggccagcccttagtgcattcaggttaaggcccctgggcagggatgccccccctgctccttcggaggaggtgccctcacccctcactggtccactgggttgagactcaccccgtttgcccagtaaaagcctttttgcagcaaannaaa

SEQ ID NO: 614230 - DNA, 125 bp, Homo sapiens
cgcattgtggtctggagaaaacctatgcttgccaggacaaggcaggctctgagcttaggtctgccatgaaaatgactttgtgggttatcggtaaacagtataaggactacacagatgccagcatc

SEQ ID NO: 614231 - DNA, 553 bp, Homo sapiens
  misc_feature (549)..(550): n is a, c, g, or t
catgtctcatctgtctcagattgttgtcattggtacaaatcacagatctatggttttcatgtacacaattcacatttctctgatgtacattttctgagtgtatgtgaatacacttcttcattcactcatgtatgtactaactaacaaagaaacagttagtcatgttgcttactatactcaacttgggcagattccatcctcaaatatagtactatatagtcccagagtttggttacaactcccaaccccactctattctgaaggcctccaggtaatccacccacatttcctagagaataacctcctgaataaccaagcaattgacacaaggccacggaccatgcaggtggctcttatagggggcccaaagcccttgtggggggacctcccctgagcctgtttgaggggccagcccttagtgcattcaggttaaggcccctgggcagggatgccccccctgctccttcggaggaggtgccctcacccctcactggtccactgggttgagactcaccccgtttgcccagtaaaagcctttttgcagcaaannaaa

SEQ ID NO: 614232 - DNA, 122 bp, Homo sapiens
gtcaactgattctcgctgaagtctgttaattctactttttgagtactatgaataaccacgtgtctttaaaacccatctacccatggaggttaaaacaatacccatcaaccctatttttttta

SEQ ID NO: 614233 - DNA, 135 bp, Homo sapiens
tcccgaactgacgcctgtaggtgaagcatgtaggtacaggtatctgtatctgtgaatgtgtaaagatatatatgtataagtatatagtatatatcatacatgtatatgtgtgtatagatatatatcgtatatcta

SEQ ID NO: 614234 - DNA, 415 bp, Homo sapiens
  misc_feature (6)..(6): n is a, c, g, or t
  misc_feature (142)..(142): n is a, c, g, or t
  misc_feature (411)..(412): n is a, c, g, or t
ggatgngagagagaggggagcgaaagaaaggttcagaaaagatagagaaacggagtgacaaaggtattgagcgcgctatctagagaagaaaagaggggggcgactatcccacttttccatgagaaagatcaaacccttcccnttaaatcaacccaaggcgatgggaaaagcaaaggacccatggaacccccaaagcaggggatagcgtcttcataaaagagtgggcccaaagcccttgtggggggacctcccctgagcctgtttgaggggccagcccttagtgcattcaggttaaggcccctgggcagggatgccccccctgctccttcggaggaggtgccctcacccctcactggtccactgggttgagactcaccccgtttgcccagtaaaagcctttttgcagcaaannaaa

SEQ ID NO: 614235 - DNA, 282 bp, Homo sapiens
  misc_feature (278)..(279): n is a, c, g, or t
agagagattaattttttgagattaattaaggtagatgtgatagtaagggtatgggattttatggtaggggtggtgtctttatgagggaggggcccaaagcccttgtggggggacctcccctgagcctgtttgaggggccagcccttagtgcattcaggttaaggcccctgggcagggatgccccccctgctccttcggaggaggtgccctcacccctcactggtccactgggttgagactcaccccgtttgcccagtaaaagcctttttgcagcaaannaaa

SEQ ID NO: 614236 - DNA, 251 bp, Homo sapiens
agacacaggctcacgatggagacacatgctcaagactgggggcacgctcgctggttcttcttcaatgggcttttgcctgcgcaggatgacagctgtgcacttggcccacatccaggctaccccccagcccgcttctcccctgcttagcccaggtaggagacagtataggtgatgatctgccgaggtcgtccgtatcctgtcatgccggcctgggaggcccctctgttgctgcccatcttgaccctgtgtct

SEQ ID NO: 614237 - DNA, 449 bp, Homo sapiens
ggggaacgagttactgacgcgggggtcggggtagacctggggggagagatccatcgagtgggtcagatcacagggggctgcagataacctccgggagccgcctggaactgggaagattcgctgggtggctagacccagaagagagacaacaatcactgcaagtgtggctcataggaagccacatccataggaaaaggggcagagtactatatgaagagaacaccccatgggacaaaagaatctgaacagccttcagccctagaccttccctctgacagagcctacccaaatgaacaaaccctggtaatatgacaaaacaagacgcttcaacaccccccaaaaaacatactagttcactggcaatggatccaaaccaagaagaaatacctgatttacctgaaaaagaattcaggaggttagttattaatcagggaaggaccagagaaagg

SEQ ID NO: 614238 - DNA, 704 bp, Homo sapiens
  misc_feature (424)..(424): n is a, c, g, or t
aaaggtcccggagagctgagcagtcaagatggtggggcccaggtcttgggagacgggcaggattggggacgagaggcaggaagagacgggtggggggcgaggagaaggcaggggtaggaggcaatagggaatctgtaggacccgaaaggttgtgaggtggggttgggaaagacgtggggccctgccgcgggaatgcgagtcttgcgagccgtggaaacgaggagtttagtggcgtcagagtcttgatgggtcacgaagttatgtggtggcatggtgatagaaacatcgggggattggctgtactagaatgcttgacacacttcccctcttctcgtgagcagtcgtgacttcaccgcatagatcgaaaccgcagcagttcagagggaggcctctcgcagctagtttggacgcggatacaggtgantggccaagatccatgttacgagcctagtcgttcggggaatagtcgatgaaggggcccttggggccaagaaacccgtatgcaacgccgtagtgtgcatcacaaggtacctgggtgaatccccaaaggaagtgatgagatggaagtggtgaagggtgctgtgactttggacgcaactattcgtgcccatggcgtgcaatgacgagctggccaacgaacaacggacgcagggctagactaaggagcgattatcgtcgcaaatggacgtttcggggtggtcgga

SEQ ID NO: 614239 - DNA, 169 bp, Homo sapiens
cacacagctcggggttggggcaaaagaatcgcttgaacccaggaggcagggctgcagtgagccgagatcgtgccactgggtgacagagctcacctgcacttgctcattgcaagatgagcaccctcaaaccaacctcaaacctgatctttttgtttgtttttttgaggca

SEQ ID NO: 614240 - DNA, 228 bp, Homo sapiens
ggtatttacaaagcttgctatctgggcatccccttgcttgggcaagacctactgctactgaatcgtgacgcgggtactcagtatacagtctcaccctcagcacgattcgtttacctttcacttcagtcttacccttcattattgcggacctagcagcagtccaactcctattgcttgcacgaaacgggatcaaacaaccccctaggaatcacctcccattccgataaa

SEQ ID NO: 614241 - DNA, 1209 bp, Homo sapiens
cacatttgaagaaattcacattagacttcaaacctatattttttaaataaattgaatcaattgctcataaccttctaaaagagaaagtaccagacccaatgggtttactggtaaattctaccaaacatttaaggaaaaaatactaagactctacagtctctttcagaagacagaagcagagagaattcttcccaactcattctgtgagtttagcattgtcctaatacccaaattagacaaagatattacaagaaaactacagaccaatacctctcatgaatatagaggcaaattatcaacaaaatattaacaaatcaaatccaacattgtataaaaattacactttgaccaagtgggatatatcccaagtatgccatactggttcaacattcaaaaatcaagcaatgtggcctgcttgtgctgcgttggttcacgcttgtaatcccagcactttggaagcccgaggcgcgcagatcacgaggccaggagattgagaacatcctggttaacacggtgaagccccatctctgttaaaactccaaacgattgcttggccgtgctgccgcccccctgcagcctcagttactcaggaggccttgagcagcagaatggtgtagagcccgcaaggcagaccttggcgggggcccaagtattgtcccattgtacttcagcctggttgacagcgcgactcttcgtctcaaaccctaccacacacaaattcaacgcatgcaatcttacaccttcaacggtctacacaccgaaagacatccccctggttttcttcatacgcgcctgaaacgcttctactccaacccctctcttgataaatttttcacgatctggccttggcgaactttttataactggctaagatatcttcagtgactttgggctacctcaacttaaggtgcgaaaccggaccttccccattttcgccacagccacggtggcccttttcaccggttctaaaccacccggcctttggtcccccttctcgcggcgcgaaccgttcccctcctttcgcactatactttttggcaatacacgttctcttcacaactctgaactcacaattccttccgggacccctctcccgtctgtctctcctccactacacgacctgtgttcttacccctcctcgctctgtccggtcccctcttctctccccctctctcctctctctcatctcccgccttcttcgcttcccct

SEQ ID NO: 614242 - DNA, 201 bp, Homo sapiens
tgccatgcatgagctgacctagcttacccagacacatgtcattctgctttcgtcgctgaggcacatcgggctcccatgactgtctctctgccattccgtaccccagtcacaggtcaaggctttggtgattgggagcagggcgagctgcattgtagaaggttaaaaccaatgcacagtcagagaaagagccatcactccggc

SEQ ID NO: 614243 - DNA, 239 bp, Homo sapiens
cgaagagcaagtctattctccggactaccctttggtctgaggacccaggacagagtcaagaccttcccaccccccggtcgaaactaaatacggaagacgggaacgtattaatgattataacggaggacaaagtcttcaagggacgaaacccggcgccgcaccaccgagtgggccattagggtcgtgaaaccctccgctgcgtccacctggtggactccagtccttaagttctggtcgga

SEQ ID NO: 614244 - DNA, 1191 bp, Homo sapiens
agcgggctctcggggaggggcggcgcgcaggcgcggtgggggtgcgaggctgcgcaggcgcggacggcgctggtttgaagaccttcagcgttgccctggcggagcagagacaggccctcggggtggcaggctctttggttcataagagccctgaggagagattcttctaacaatatgtgtacacacaccaacgtactgtgacctaggaaaggctgctacacggatgtcttcaccaaaggcattatggaacttatcctaactactggtcatgcttacactgatacagggcaaagcatcaggcaaccctagaaacccaaatatacggctcggtacactaatgggaccttaccctttcaccccaagaaatgacaccaccagaccaatacctctagcgggacagaacactctcttgggcacacgaacaatccagttgcacctgacacggcgtgtgaaaacgtgaactacttgataccaatactttgttacccggacaccacagcgcacacgccgcaggtggcgacaaacttgaaagagccttcctaataacagcggcccaccggccacacacgctgtcgcccacgcaacatggtcggaagtaataccggaatttgatccttggggacccgaacccatttttatttggcatggcgccatcggcgtatcgagcgcctttccgaacagagtatgggcctacgctatggcgctacatcaagaattcgcgttttgggaacagacatgccaaagcatccaaaaacttggtccaccgaacatacatttatcgggccccttcggggttacaccacagggatatggctagaagcatacccgcagggcgacagagccgacccacaatttgttgaacacccaaattgggccacctggaaagtttcggcacagggcgtacctacgatcttaccccacgaaatgcggttgaaattgcagaaccgcgattcgcaacacttttccgtatacaacctttgtactggggacacacgcttgggcgaaggttaaccaattacccccggtacaggtaacttgggctgcaaatcgagacaacatgcgtgaaagaggcataaacacatcactatctacagtacaaaaactaagtataagtgccggctatgatgacgactagtgtatataatcaacgccccttcaccaacgttgaccactgaacatccacaacctaac

SEQ ID NO: 614245 - DNA, 334 bp, Homo sapiens
gtctcggactcctgacctcaagtgatctgtccgccttggcctcccaaagtgctgggattacaggcatgagccaccgcgcccagccttaatttttgtatttttggtagagacgcggtttcgccgtgttggcctggctggtctcgaacccctggcctcaggtgatatgcccgtctcggcctccaaaattgctaggattacaggcatgagcacttgcgcccagcacgtaaattttgtttaagggcaggccaatacctattgggaggatttatacacaattattaatagtcgcactcacacattcactgagtagtatcaatttatacagatgtctctc

SEQ ID NO: 614246 - DNA, 219 bp, Homo sapiens
cgggtgactctagaggaccccagccctcctctccggtcaccaaatcccaggccaggcacgccagggcaggtcgaatacctccggggggtcacagggggaacaaggagagattcctactaaccacacacggtctagccaggcagggcggggtccttatccggaggcacagtagacatcagggaggtcaaggccccccccggaagggagcccaaagggtac

SEQ ID NO: 614247 - DNA, 706 bp, Homo sapiens
agctccagtgcactgcagatggcggctgctgtaggacggctgatccgagcgccggctgccctacatgtgctttccatgagcttagggcattactgccactgcagtacccaggccctgccccatttacctagaactgtgcaggggcatcgttttccaggctttcagaatagcatgttacggggggagggttccactaacaaagcgcctcaagcctatagtttcctgtgacgcataaaaataaatttcgtttggcgtccgtttctaccaacttacatctaaaacacaaaagatatactagtctctagaaatatataataaacttctaaaactctactatcctatttgtttgtttatctaatatcaacgatcccgcgtcctcttctactttatattatcttcttgttccgctctcgtccattcttatttcgtcattttcttttctatttctttttctttctatatttctctctctcttccgctcacccctttgatatttgttaatttctattatatttctttgccttatattttttcccctctttacgctccctttattatgtactacttaccgttcttttatattattctttcaatatacttttaatatctctttcattaatgcgcattctcctatacaccagcttcacatcgccccttatgtttgtctctctcctctttactctcttcgtacttacttttatataat

SEQ ID NO: 614248 - DNA, 446 bp, Homo sapiens
tgctgctccctcttcaaaccaccacctgccggtggagtcaagtgccctgacggcgaggtcatgaagaagaacatgatgttcatcaagaactgtgcctgccattacaactgtcccggaaaaatgaaatttttgaattcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcag

SEQ ID NO: 614249 - DNA, 637 bp, Homo sapiens
  misc_feature (502)..(502): n is a, c, g, or t
tgaggcagggtctcgcaccctcacccaggctggattgcagtggtgcaatcacggctcactgcaggctcaacctccgtgggctcaggcgatcttcctgccgcagcctcccaagtagctggggactacaggcacgtgccaccatgccaggctaatttttggtatttttggtagagatgaggtttcgctatgttgcccaggctggtcttaaactcctggactcaagcgatctgcctgcctcagcctctcaaagtgctgggattacaggtgtgagtcactgcacttggcctgtttggtttggtttaatttttttggaggcagagtctcgctctgtcacccaggctggagttcagtggtgcaatcttggctcactgcaggctcaacctcctgggctcaggcgatcttcctgccccagccttccaagtagctgggactacaggcacgtgccaccccaggctgtgagtgcagtagcgtgattataactcgattcactgtaaccttgaanctcgtgggcctcaagggattctcctggcttcagcctctcagtgctgggactaccggggttttgccatcattgcatgggtttcttatgacttggtggattccattttgggggaaaggggttgcttgtgcccagctc

SEQ ID NO: 614250 - DNA, 283 bp, Homo sapiens
  misc_feature (6)..(6): n is a, c, g, or t
  misc_feature (173)..(173): n is a, c, g, or t
cctagnatatacgggtcttgctgtgttgccctgactggtctcaaactgctggactcaagctatcctcccgacccggcttcccaaagtgttgggattacaggcatgagccaccacactcatctatttttttaaaaaatttaaaaggtttatagcctaacgtatttaaataatancatttaaacgtatgtcatgatttcaatagttgttatttaaaaatcctaaagttactaagctaagaggaacagaaattaaatggcaacaaattttaaataagtaatttatg

SEQ ID NO: 614251 - DNA, 1506 bp, Homo sapiens
  misc_feature (995)..(995): n is a, c, g, or t
taattggagtggagttatacattcggcaaacactagccacatgagtgtcttacggggcctcaagtgctcaccacctttccagaaaccggcggccagccacccacgtgagtgccattcaggaaggtgtccagtgggttgggacgtggtttcttccagcacctacaatctccagaaggaggtgattttcctacaggtgaggacgtgcagatagctcccttttctacacacgcgtggtacgcggcacaaggccgtgggctcccctttcttgggtgtgggcacgtgggctagtggggcggagaaaaatccacgttgggttctggggcggagtgacgccagaaagggtcaagtggtgggctatccggaaagaccacagggtcggtgtaaagaagtgcacagcgtggcgaagggggcttgcggctcacccagaaattcgtggggggcttccctcctcctaccagtgtgtcgtggggccctaaaagctatatcgtctcaaatatacgagccaatgtgggtgtggcccagagggagccccagaaaaccccgatggtggtggcacatatagaggggccaactataatcgaggtgtggactcacagtggaggggaatagacagtgccttgctacaaacgggctgtaagggcgtcccagctaaagccattctgtaagcatcgcgccgctttaaaaacctaggggggcttgccaccccaaagtgtttacacccgtgtagaatcacccttgacaacaggccaattcgtgggtttcaaggcaatcccggaaatggggcggtgggtccacccaaacttctgtggggggaacaagaaaccggggccccacagtcggggcaacaaacgaggggacatcgtctggaggggacgcctccccaacgaggttcgggcggacgaacgaacaaaccgcggaccgactcatggcgtattgtgcgcccgatgcggcgtccgcggggaggcttctcagaccagggttgggctccccaaggngagccaacagaaagaccaataacaacagactgcaccgaagcacacacatcaaccacagcacgacatacacgaacggacgacagcaataacaacacaagacgcgggcgggggggggcggccacataagaaagagaatcatcaccccgcgacgagggcgagcacaccacagacagaaaggcggagcacaaccggagctgtggtcggccaacaaagacgcggggcccaccaaaagcggacggcgcaaaataatcaaaacgacggagaccgccggcggcccgcggtcaaaaaaacagtagggcggtacggaacacacacacaaccaagagacacgtagatgagaagaacagccacaaccatgcgtggcggcagacaactagatgaggacacacacacccaacgagaagtaaaccgtcggcgagacaacaaaaaaaccagacgcatgacagagtacgacaccacacgctagcgccggcgccatgccgctgcgtactgataccccagccgccacgcg

SEQ ID NO: 614252 - DNA, 157 bp, Homo sapiens
tgtttcttctggggagacagtatatgggaaggagtggaggggaggcccaagggggtgtggagaaaggagcagaaagggcagcatatggggtttcataagccctaacgggcagacaagggacttacccccgacatgggctcttcatagcaagtaggac

SEQ ID NO: 614253 - DNA, 763 bp, Homo sapiens
agcggagtgggtcctgcctgtgacgcgcggggtggtcggtcctgcctgtaacggcggcggcggctgctgctccagacacctgcggcggcggcggcgaccgacgcggcgggcgcggagatgtggcccctggtagcggcgctgttgctgggctcgccgtgctgcggatcagctcagctactattgaagtaaaacaaaatctgtagaattcacgttgctgtaatgacactgtcgtcattccatgctttgttactacatatggagtgcacaaaacactactgaacgtatacgtcacatgtggaacatttaaaggaagagatatttacacctttgatggacgctctaaacaagtccaactgtgcccactgacgtttagatagtgcaaagaaattgaagtctcacaagttactaacaggagatgcctcttctgaagatggataagagctgatgctgtctcacacacaggaaactacacttgtgaagtaacagaattaaccagagaaggtgaaaccgatcatcgagctaaaatatcgtgttgttcatggtgtgctccaaatgagatctatcttatgtaatctcccaatttttgctatactcctgtactggggacagtttggtattaaaagacttaagatatagatccggtggtatggatgcagaacaccaattgctttactttgtcgctggaactagtgatcactgtcattgtcattgtggagccattcttttcgtcccaggtgatattcattaaaggaatgctactgcc

SEQ ID NO: 614254 - DNA, 1107 bp, Homo sapiens
  misc_feature (119)..(119): n is a, c, g, or t
  misc_feature (348)..(348): n is a, c, g, or t
  misc_feature (405)..(405): n is a, c, g, or t
tataaagaaaaagaacacattcacagataaagaaaggaggtcctcttttaaccgtggtcccggattcgtggtccccttttccttctttcaccctctcttcttctcagaaggcagtgggntcctcataggccatgcctgagtggattttaaccggggcggtacttttctatttttttacaacacttagtagtggtggactatagtctgtggtgtttttaaaccatttctagcgtaaaacattttaaacttttataaatctatcttaacaacataacatgggttgtggggtaccactattttggggcaacctataatttcctacaggtgtttggttctcgtggcgtggtntattctcccccaattagaactcgtggggatataatttccaattctcaagagcgggcncataaaataactcctcttaatagtgtgcggaacatattttctgtgggtaacccctatatatttttatccccatatttgggggaactacgacaccacttttcttcataactctcctctctttcaccagacacagattacccaaacggttgtgtttctccccgaggggcgttcctcttaaaacttagaggagaaaggtaaattcacggcttaagagggggagcggaacattgttgggcttaagagggaccagtgcgggaatgggcgcataaaatttgtcaactctttttcttcgttagaaaattttttggcgcccaagttcggcattggccccaaagaagggggccacaaattaaccctttttccccaccccaggctcccctcgtgttggcaagaagggggggcaagaatcttttctcccacaaggggtctccattccacccccactttggtggcgaacctgtgtgtcgtggtgggcacctcaactaaactcttcttggcggcccaatttgacgagcaaatctggggggactctcccacgtggggctctccatcctcctaacattttggggcgggtcaacgctggattttatactcctctttggcagacacttcgttgggagcgcgctcggcacacacacatcttttccttaaagactttatttggggcccacatcacaagatttctccctcccctcttatgaa

SEQ ID NO: 614255 - DNA, 422 bp, Homo sapiens
gcaagagaatctcttgaacccaggaggtggaggttgttgtaagtcaggatcacgccattgcactcaagcttgggcaataactgggaaactccatctcaaaaaaaaaaaagaatcccggtttgtccttaatgaaaaacactaacctgaccatctaagattcacagagatttccaggtatcctataaactcaaagggatccacccttaaacacattatagtcaaactgtgaatgacaaagagtgtcatgaaggcgccaataaggcaattcatcccatacaagggattccaactaaaattaactgctgacttcttaatcagaacctatgtaaaggccaggcacagtggctcaggcctataataaaaacactttgggagggagaggcaggaagaatgcttgaccccaggagttttagaccagcctg

SEQ ID NO: 614256 - DNA, 399 bp, Homo sapiens
  misc_feature (51)..(51): n is a, c, g, or t
aacctcaaggcccaaaaattcggcacgaaaagcatttggcaagcacatccngggtgccaggcccaagcaggctggtctcgaactcctgacctcgggtgatccgcccacctcggcctcccaaggtgccgggatgacagctgtgagccaccgcgccccgcccagaagcagaggtgttttaacgggaagacttcaggcttcatcggacggccgggaaggaatcagagcaggggtttcttccgagatggccagtggtcacctgagatggagcagagagcacctgtggcgggcatcttctctagaagccgcctgtgagccctacggaggccctgggcttcgtgccgtaagacagacggtgtcctgcaggcctcccatggagacaccatgtgtgattgtaccaaa

SEQ ID NO: 614257 - DNA, 879 bp, Homo sapiens
  misc_feature (571)..(572): n is a, c, g, or t
  misc_feature (651)..(651): n is a, c, g, or t
atccagcagcaagacgaaggggggcctgggctccccctagggcaggcgcctctgattctctccaccgagaggcacctcccatgccggcctcttcctggggtgactcccagaaccttcttggacccatgaacatttcaatctggggtggggccttccctgggcatccaagtggtgggaatctgtccctagcccctagaactcctggagggctgggcccacctctgtctgcatcccgtccccattccccgccccgggtggcaggggctggagaggaaggagcttcaggcttgaaaaccatcaaagcaggtttcttccgagatggccagtggtcacctgagatggagcagagagcacctgtggcgggcatcttctctagaagccgcctgtgagccctacggaggccctgggcttcgtgccgtaagacagacggtgtcctgcaggtacgtgggggaaccctgtaggcagggactttgcctgctttctcagaacaggacagaggagtttggctggggcagcccgaggtgaccggatgctgtcgccccagctctggtcttgctggtggaaggtaccnnggagggacagttacgggccaggctgacgtgggaagggagggaggagggaggtaggagggacagaggcctggctgctctncagggctgggctccgtggcatctcctggtggctgtcaggtcctgcctggccccacgctgaggccagtgtgatggaggggcctggaagcctcatccttcttgattgccacgcggtgagggccacaggcatgcgccaccgcactggactccccctttcatcatcaaagccaaattttcttcttgtttcatctaggcctcccatggagacaccatgtgtgattgtaccaaa

SEQ ID NO: 614258 - DNA, 731 bp, Homo sapiens
gcctcattgtgcccaggagttctccaaacctcgcgctgcggagatcttcctcgggaggcggcgaaaggcagtccacactgcgcgtgatcctttatgcccggacccgtgctccctccctccgtggtggcacttcctccctcgaacgccagacttaacgcgtgagagatcgtctggatctctggcggggtgcgagaactgagtcccaggccacagataccctattcacgctctgtgcgttgtgccaagtgcgggcaatggccggcttcctgtgttcatactgcatcactgggcagaagatgcctctgattaggtctgggtacctggaagagtgagcctggtcaggtaaacgcagctgtgaagtatgcccattagacgtaggctacgcgcacattgctcgtgctgctatctacgggcaatgagcctgagattggggaggccctgaaggaggacgtgggaccaggcaaggcggtgacttcgggaggagctgttagtgagatccaagctgtggaacacaagaatcaacctgaggatgtggagcctgcctcacggaagacatcgtggcttgaccgtccagacgtggaggtatcctgggacctgttaccctgagtgcagtgaccttaatgccctattgcagccggggcgacaaacaccttccccgcagacctgctgatgggactctatgctacagactccaaaccaattaacaagggacgacttggaaaagctcttga

SEQ ID NO: 614259 - DNA, 857 bp, Homo sapiens
  misc_feature (2)..(2): n is a, c, g, or t
  misc_feature (5)..(7): n is a, c, g, or t
  misc_feature (17)..(17): n is a, c, g, or t
  misc_feature (34)..(34): n is a, c, g, or t
  misc_feature (60)..(60): n is a, c, g, or t
  misc_feature (68)..(68): n is a, c, g, or t
  misc_feature (80)..(80): n is a, c, g, or t
  misc_feature (176)..(176): n is a, c, g, or t
  misc_feature (187)..(188): n is a, c, g, or t
  misc_feature (192)..(192): n is a, c, g, or t
  misc_feature (206)..(206): n is a, c, g, or t
  misc_feature (228)..(229): n is a, c, g, or t
  misc_feature (289)..(289): n is a, c, g, or t
  misc_feature (382)..(382): n is a, c, g, or t
  misc_feature (433)..(433): n is a, c, g, or t
  misc_feature (436)..(436): n is a, c, g, or t
  misc_feature (521)..(521): n is a, c, g, or t
  misc_feature (594)..(594): n is a, c, g, or t
  misc_feature (597)..(597): n is a, c, g, or t
  misc_feature (607)..(607): n is a, c, g, or t
  misc_feature (611)..(611): n is a, c, g, or t
  misc_feature (618)..(618): n is a, c, g, or t
  misc_feature (656)..(656): n is a, c, g, or t
  misc_feature (667)..(667): n is a, c, g, or t
  misc_feature (689)..(689): n is a, c, g, or t
  misc_feature (694)..(694): n is a, c, g, or t
  misc_feature (702)..(702): n is a, c, g, or t
  misc_feature (711)..(711): n is a, c, g, or t
  misc_feature (727)..(727): n is a, c, g, or t
  misc_feature (738)..(738): n is a, c, g, or t
  misc_feature (749)..(749): n is a, c, g, or t
  misc_feature (774)..(774): n is a, c, g, or t
  misc_feature (819)..(819): n is a, c, g, or t
tnctnnncttgtggccncgtatgccgacctccancagcagtcggcttctctacgcagcancccgggantaggagactcanaatcgaatctcttctccctccccttcttgttttcggctttgtagatgaaaccttacacatcaaacacgatgtgctctagcaacgttatccaacaanacagatcctcnntccntcgacactcccgtnatcacttcattggcgaatctcnncactcttgtggtcatcgaatgtcttactgtggatggcaactcttttctgaagtatggcanaacttgtgggctgctctgttcattaagggctttgccttcgttcatgtatgttaatgagagaaatgcccgcgcgctgctgtagcagcgagaggntggcagatatgatctgctggcgcaggcttttagatattaacctcggctgcnganccaacaagtgaaccgcaggacataagcaggtgctgaaacgagtctgcgagcggggtatgtacgcgctcctcttgttgactttggncctaatgacttttcaactgggactattcatctatagggatgtacacgttacccagcacagtgtacctcctccnccncctaattgcncggngctgtantgccctcgaaacgtcagcgtgtatcaggaaacacttcncgaaggggcanaaagtggcttcaattctaagantgganagcggggntcttccaantctggaaagttgaaangagatgacctncaggccattangaaggagctgacccagataaactanaagtggattctctcctggtaaacctggaaaaaattgaaaaggtanagagcatacaagcagtagagatgaagaatgataagtca

SEQ ID NO: 614260 - DNA, 792 bp, Homo sapiens
  misc_feature (25)..(25): n is a, c, g, or t
  misc_feature (64)..(64): n is a, c, g, or t
  misc_feature (92)..(92): n is a, c, g, or t
  misc_feature (124)..(124): n is a, c, g, or t
  misc_feature (143)..(143): n is a, c, g, or t
  misc_feature (484)..(485): n is a, c, g, or t
  misc_feature (564)..(564): n is a, c, g, or t
tggagggaacaacacagttgctatncctgactagggcatgacctggagcctttgggccacacancctccttgggaaaggaggatcaggtggncctcacacccaggaattggaagtgggagaganaacagctgctgggtagtgnggtagagctgtgtctctcactgccctgcccctccaaggaccaagaagaaaggaatgagccccgatccgcctgccaggtttcttccgagatggccagtggtcacctgagatggagcagagagcacctgtggcgggcatcttctctagaagccgcctgtgagccctacggaggccctgggcttcgtgccgtaagacagacggtgtcctgcaggtacgtgggggaaccctgtaggcagggactttgcctgctttctcagaacaggacagaggagtttggctggggcagcccgaggtgaccggatgctgtcgccccagctctggtcttgctggtggaaggtaccnnggagggacagttacgggccaggctgacgtgggaagggagggaggagggaggtaggagggacagaggcctggctgctctncagggctgggctccgtggcatctcctggtggctgtcaggtcctgcctggccccacgctgaggccagtgtgatggaggggcctggaagcctcatccttcttgattgccacgcggtgagggccacaggcatgcgccaccgcactggactccccctttcatcatcaaagccaaattttcttcttgtttcatctaggcctcccatggagacaccatgtgtgattgtaccaaa

SEQ ID NO: 614261 - DNA, 681 bp, Homo sapiens
  misc_feature (201)..(201): n is a, c, g, or t
gcaagttacccgtagagataacagcgcaatcctattctagagtccatatcaagcaatagggttgacgaactcggatgttggagtcaggagcagtcccgagtggtgacagtccgctattgataatggttcgtttgtaacaaacgataaagtcctacgtgatctgagtgcagacggagtatccagtcggtgactattatgcanatcctccctgtacgaaaggaaagaaaatgggctacttgtcacgtcgcacttccccgtggtgatatcattcaattagtatatactcacatccaccagaacaggtagtaagatggagagcaccggtatcgctaaacttatgacttgacaggcgaggtgcaattcctcttcttaacagatcatagccgtggacaactgctagtcctcattgtaccctattctagtcgcaatggcatgcctaatgcttaccgagggaaaaattcgtgaggctatatacgaaatacgcaggaggcccgcaacggtgtgatgcccctgagggctactactaaccgcttcgctgactgccagtaaaattcttcagcaagagagcctgcgtataaaccggcacatctagcatcaccctctaccatcacctggccggacgttagctctcagcatcgcttcttctacgtatgaaaccccctactcataccgaaagccctg

SEQ ID NO: 614262 - DNA, 802 bp, Homo sapiens
  misc_feature (51)..(51): n is a, c, g, or t
  misc_feature (494)..(495): n is a, c, g, or t
  misc_feature (574)..(574): n is a, c, g, or t
aacctcaaggcccaaaaattcggcacgaaaagcatttggcaagcacatccngggtgccaggcccaagcaggctggtctcgaactcctgacctcgggtgatccgcccacctcggcctcccaaggtgccgggatgacagctgtgagccaccgcgccccgcccagaagcagaggtgttttaacgggaagacttcaggcttcatcggacggccgggaaggaatcagagcaggggtttcttccgagatggccagtggtcacctgagatggagcagagagcacctgtggcgggcatcttctctagaagccgcctgtgagccctacggaggccctgggcttcgtgccgtaagacagacggtgtcctgcaggtacgtgggggaaccctgtaggcagggactttgcctgctttctcagaacaggacagaggagtttggctggggcagcccgaggtgaccggatgctgtcgccccagctctggtcttgctggtggaaggtaccnnggagggacagttacgggccaggctgacgtgggaagggagggaggagggaggtaggagggacagaggcctggctgctctncagggctgggctccgtggcatctcctggtggctgtcaggtcctgcctggccccacgctgaggccagtgtgatggaggggcctggaagcctcatccttcttgattgccacgcggtgagggccacaggcatgcgccaccgcactggactccccctttcatcatcaaagccaaattttcttcttgtttcatctaggcctcccatggagacaccatgtgtgattgtaccaaa

SEQ ID NO: 614263 - DNA, 225 bp, Homo sapiens
  misc_feature (3)..(3): n is a, c, g, or t
  misc_feature (31)..(31): n is a, c, g, or t
  misc_feature (47)..(47): n is a, c, g, or t
  misc_feature (51)..(53): n is a, c, g, or t
  misc_feature (74)..(74): n is a, c, g, or t
  misc_feature (143)..(143): n is a, c, g, or t
  misc_feature (191)..(191): n is a, c, g, or t
  misc_feature (198)..(198): n is a, c, g, or t
  misc_feature (216)..(216): n is a, c, g, or t
tgnggtgaccattatcatgacggtcatcggngcgattctcacctcgntggnnngtggcgcgagaatgggaacgnggcaccatggaggctctgctctctacggagattacccgcacggaactgctgctgtgtaagctgatcccntaattactttactagggatgctggcgatgtttgctgtgtatggctggngtcagtntttattctcggcgtgccntatcgcggg

SEQ ID NO: 614264 - DNA, 763 bp, Homo sapiens
tggggttgggaagggaaacttccctgattttggtctgatgtgaaaaagcctgggtattaacttttggaaattccaaaaaacgcttaatataaaatttggcttcctccccaggaaaaagcatcttttggtttttgtgtctaaattggttgtattttggtgcctcatatacaagaaatgttcttaaatgggatttaacagtcctggtaatggctggatggtttaaaaataatcaactaattttcatatttttaaaaaagacaaatcttcatattatcctggtgtcttcccggacgggtaatattgtggtggggattcacaggtgtaaaagtcagtaggatgggacacattaagttgatttaaactcctataaagaagcttaaaatccagtagtctttcccccctataaaagaaggggggacactctcattaaattcacaagggaatctcaagcggaccatttacggtatgtaacacacttttcgtgttaagtgctcccctttctttttcaagtgctcggtgggctggggaaacccatgagaatataccagtctcgaaatatacaggttctcttaaagccctctccttaggaacatcgaaactttggccccttttgaccagagttggtatgtgacactgtgtgctgctttgaaaaaattttcctagcgccaaataaccttttcaatcgctttccaaaaaaacaaaagaactaaaacatacagaacacgaaaaacgacgagacgaaacaacacactcaagaccccag

SEQ ID NO: 614265 - DNA, 145 bp, Homo sapiens
gaccttcttaagcgccggcgtccttttgtctaaacaaacaatctaaaaattattcttgtacctttagggttagtcgggaagttgttttaattttatgtctttcactttaattttcataagatgtaatttactgaaaataaatttt

SEQ ID NO: 614266 - DNA, 170 bp, Homo sapiens
ccccctttttaaaaaataacccccccatccaggatatggaatccagccccccagtgcacaggtcagggctcggaggaagcctctgtgcaaatgtgctttttttccaggggctgtaaaaagtttgtttttattatgtataaaatgttgaaaaataaaaaaaatggatttta

SEQ ID NO: 614267 - DNA, 355 bp, Homo sapiens
taccgctctcgtgagactggtcagctttcggaaaatctgcacttttttgattgaaaagtgcacaaaactttaggaattttctgctaatcagaaaaagttcaataagtttcacttatacttttatggtcaaaaaatcattaataatcattgggatatgtcgtgttggaaacttcttgttacaccatatgatgctttggacatcttatatcaggcagagtttcacactgctttttgttatattttcgtggtgaaggttacttttgtttcccatttgaggtggttgttatgaaaaaaattgcatgtctttccgcattagcttgcgtagtagcactgggcgcttctagcgcattcgcag

SEQ ID NO: 614268 - DNA, 697 bp, Homo sapiens
caattttttaatttttaaaaggttttaatttattctaacaagatatgtttttcatactgagttttagacttttaaccactttttactaagatttatatgtcagggactatcattactgttcatggtttatatctgagataaaagaacatttaacttgtaggaaaagaagaggcaaaacatttctgggcaagaggaaagcagctgcagtaccaaaatctaaacacttttggcatggcttttaaccagcaaatgaactaattatttatccaaaacaaatccattgaaaaatgccattttttgtttcatagacagagaataatggcatgctcatattagatattatatattatatccacatttatatgcggattaaatatggatattatcaatatggggatatttcgtatatcccaatatatacttggacaaatatatatatttttcccaaagctctttgtaatataaagccccaattaaatgggcccagaaaggtgaaaactaaatgtttcagactcttggaaatccgtccatgttcctttccctcttgaggaaaggtttcgtcgcttcaattagaccttgggaaacacagttatactggacacccacccagtgcgaaaaggggaatgctttttttttttatgttggggcaaaagacatatttagtttcttctccctcgggaaggctgggcgagaatcg

SEQ ID NO: 614269 - DNA, 366 bp, Homo sapiens
ttgtcgtgtatgtgtacaaaaaagcattccgtaagagttgcatatgcacatactatgtctccaataaggagaataaagtgttttgtcacaattgacagtgtactcatcagcatctcatgtttgcacaaagtctgtaactccattctcaactgttacatgctctcagaatgtacagtgtagaagagtagtgagcataggcaataatcaccaaggctcgcatttctcttctcgcgattttataatacgatgagcagcctcactttcgtgtgcatgcacagtatgcaccgcctctgtaataagccgagctaaagagaaaaagaaggagtatacaggttacccattacatgtgcaccaagtgcgtgtggg

SEQ ID NO: 614270 - DNA, 726 bp, Homo sapiens
gggtcatgctccagtcgctcgccactcacctcctgccatggcagtccagttcctaacaggcctcagaccagtaccggtctgtgggctgggggttgaggacccctgctctaggctggtactgctgatgcttaaaaagagagggtttgccagaaatcagatgggacaaaagggcaataggcgcgtgccacagagtgcccatataggggatgagcacgccgtggagccttcgagaggcatgccagagaagcctggagactgtcatttaccggagtctgctgcctgaggccaccctccaagtgtccccacagcgcaccacaagagcacaggagtgacctcctcactggcaggtattggggaaacgactgctgtctactctttcgggtaacacacgtgaaacaccaatagtttaagttgaggattctcagaacacttgaacatatgaacaaggccgaatacacagtactacgtaagttaagaacaccaaaatatgtccacggaagtatcgatgagaatgtccacgttcaacggtgctccaactgcggacttgctcacagcaagcgtcagaagccctaggttctcctcttgcacctattaacacgacacatctcagcgacatgcgctcgctgtggacgccaccgacttaagcctaggcagactaatgcgctccttcctaccaacgcaacgggcgttctctcagtgacactctatgcatccatgaccggcttg

SEQ ID NO: 614271 - DNA, 248 bp, Homo sapiens
ttcggcacggcacggttatcgaccattgtcctgcgcatcggcgccttcgagtttcccgacgatcatgtacctgcgcaacgcccgcgtcactgagtgcctggctcagcccacgcgtacgccgtgcagtatgttgcagtcaggccctcgcggtcaaaggcgtgcaacacctggtggcccacggtatttccaacaaccgcttcaagcgcctggacctgggggctcctctcacagtcgcacctgctcaggct

SEQ ID NO: 614272 - DNA, 169 bp, Homo sapiens
aattccctggaaaaaggggttttttttgggaaagggcggccttatttgtttcccccaaaggggggcccttccccttttttaaacccaaaggtccatttggttttcccttttcccgtttgggtggaaagggctttttttaaacccttaaatttttggtttccggtttcca

SEQ ID NO: 614273 - DNA, 1754 bp, Homo sapiens
aagacaagtttttgggctggatgtggtagcttacacctataatcccagcacttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggatgtttgagcgagggaagttgaggctgcagtgaactatgattttaccactgcactccagcttgggcaacaaaatgagaccctgtctcaaaaaaaaaaaaaaaggtttcctagaaataagcgggatgatggttcaattggcacgatggaccgggaaacctagagggcttttaaaatactcggtcttcatttcacctgtcgacgggaataacggcatatcaccatgagttggtttggctttcatacagactggtatgtgtcattggaggggttcccaggagggagcgaggtaaccggatctaatgaccgcattttttccttacctcgtgcaccgggatcccactatggcaagccttagaatgcataactctgagaatggtttgccacacccctggattaaaaggctgtaattgacgttcagaatagattcgccgtaaacacgcggggacttcccgtagtagcgggacaagcgctacaatattttcaaaaatgcgcacgagaactcgtggtgtataaacgcgtcttacgcacactacggtggtatatagatactatatagttctgcaccataagcagcgggcgaaagcgcaggagggagagaaagaagggggggagggatgaggagaagggggcgcggcgggcggacggcaggcagcaaagcggaacacgaagcgtggacgaacaagaaaacgagacacacagaaccacgcccacgagccgacacagcgagacgcggagaacgcaggcaagagacagaaaggcacgcaggagcacgacagagcaacgaagcagccagcatccagcaccatgacgcacggagccgcgcaaccctcgcaacgccagccagccccgcgacctcgtccgcatgcgctcagtggcgaccagagcggcagccgagaggccagccgcgccgagcgccgccgcgacagcacgcgcgacgcggccgcacggccaccacagccacgagcggcggcacgtggacgcacccaggcgcccacgacagagctcgaagcaccgacagccgccggtggaggacgccacgacggcgcgcaccgccgcaccgcacgcagccgtcaacaccactacaccaacacacacaacaccaagaagcaagagcgccaggcacggggcacggggaaggactgcgcagccggacaagaactacgccacagccccgcccacacgcgccccgacactggcgctcggcaacgtcacaccgcgacaggcgagctgcgcagccggatcgacgcagggggaagtgggagggacgacaacgagtggacgaggatgagagcgagaggcgacacgagagcacgcggcacgcacagaaacggaagacagacagcacaggcagacgaagcagacgacacccgcgcccccaccacgccgcacgacgacagcccaccgcacaccgcggcagccacccacacgcacaccactcacgcgacacgacgcacagacgagcgcagacgcgagccgcaggcagggagacgacgagccggcagagaggcgccggctacagacggcgcgcaaccgacggacagcgcgagcgagcagagcacgaa

SEQ ID NO: 614274 - DNA, 139 bp, Homo sapiens
tgttttgggccccccccccggggggttggggtcggggtccaacccttttggcctgttttgattttgaaccttttgctttgacccccagtgaatttttttcctgggggcccaaataaaaggataattttttcccgcggga

SEQ ID NO: 614275 - DNA, 293 bp, Homo sapiens
ctaggttaccacacaccactttttgattgggaatgctcaaccatttgagaagagaaactcgtcttctgttttcgcacaggaacctgactcacgatagtcttcccttgtgcagagggagaaattagtgggtgaacaatccgacgctaggtgaagcccctgatacatccgcttattattcttggtactctacctgttactccatatgcgctgactgctgcttggccgccacaagccagttatccctgtggtaacttttctgacacctcctgcttaacacccactaggtcagtagg

SEQ ID NO: 614276 - DNA, 420 bp, Homo sapiens
  misc_feature (136)..(137): n is a, c, g, or t
  misc_feature (149)..(149): n is a, c, g, or t
tgtccccccgcggaagactggcggaaggcccgccaaggccaagtcgcgcccgtcgcgccggcctccagttcccagtggccgtgtacaccgcctgctgcggaagggccactacgccgagccgttggccgccgccagnntgtacctggggncagtgctggagtacctcaccgctgagatcctggagctggcgcgcaatgcgcccggagcaacaagaagacgcgaatcatcccccggcacctgcagctggccatccgcaacgacgaggagctcaacaagctgctgggcggcgtgacgatcgccagggatgcgtcctcgccaacatccaggccgtgctgctgccaagaagaccacccgcaccgtcgggccgaacgccttcgtgccggcaaagaagggccacccaggcctccccaggagtactaa

SEQ ID NO: 614277 - DNA, 92 bp, Homo sapiens
ggtgtactggtctggaagtgtttggatgggcgcgcgagcggtgccagctcggggctgcggaacccagagaagctgagggggcggtagcggcg

SEQ ID NO: 614278 - DNA, 291 bp, Homo sapiens
ggtcttttttccccctaagtttttttttttcccatcaaacccttcccggccccccttgttttttgttccccttttattaggaattcccaagtgaattttattaatgtgggagtggacccaatgctaaaagccatcccgggattttgtttctgtttgttttaaattttggggttccttccctttcccccccctcccatgggtaaaacgttttgggtaccccccattaaatttgggacaaaccccctccccaaagctggggggtcaaaaaaataaaatatattgttttttcca

SEQ ID NO: 614279 - DNA, 290 bp, Homo sapiens
  misc_feature (9)..(9): n is a, c, g, or t
  misc_feature (32)..(32): n is a, c, g, or t
  misc_feature (86)..(86): n is a, c, g, or t
  misc_feature (227)..(227): n is a, c, g, or t
  misc_feature (288)..(288): n is a, c, g, or t
caatctctncgacttcccgggaccacactggnagtaccacaattgtcttaggaccatagataaaatacactaacagtaacgatagnctgatgagactaaaaaaaaaaaaaaaaaaaaaaaaattctgaaaaaaatatcataacgttttaagtaaagtttatgaatttgtgttgggctgcattcaaagccatcctgggctgcacgtgggcctatgggcaccagttggnacaagcttgcccgaggactttaacctcacatcctatacaaaacccacctaaaattgaattnta

SEQ ID NO: 614280 - DNA, 178 bp, Homo sapiens
ccaagaatggaaacacaaaccagaaaggagcacaccccacagcagatggcagcgcagaggagagagggcaacggaggccgggggcttctctgccaaggagaagatggagaagcctgtgggccccactgccaccatctgccccagcctctcatatcccttctgcctgggtgcctgcctc

SEQ ID NO: 614281 - DNA, 1024 bp, Homo sapiens
ggtgtgcagtagcagcagtgggctagacactggactgtcaggtggcaatcatagctgttggcagtgagctgtggcagtgatgaatgggacagctttctagccccctaggtgatgcacttgggtgggcactggtgttaggtggtgcaggcctgttcaggccttgggattgtgtgcgtgggcaccagtgtgtgttggatggggttgggccgagtctgtcagggatgccttacagagcatatatggtcagcagtagtgtgccattagtggaaaagatagcgctggagaacagttgggtgacgatgtggggtggatgctatgtgacttgtctttagagtgcattggatggcaatatatggtcatacatggtcctcagggcaccctggaggtgcacacatggaatggtgtttgccatgtgagaggggcaagagttctgttggtgggtattgggagtaggcgtacagtacttgttcgcaagcctgtgggagacgtgtcacggtcaacgtttgaccatggtgatgaggatagccgaggttgtgggtataatggctgttccgtggggatataagacacttcatggggtcagagtacgtggggaactgggtgactggtgggtgatttgtgatactggaacttctggatggatgtgggaggatgttcttggggggtccggggaatgtggaatgcaggggttattggacccaggtgggcaggatatatctgtcgggggtaatgctacttaaatgggggcggggggacaggaggaagttcttggcgatgtgagaggatccagtggagtcgctttggaagagggattggatggaataaggagcgattatgacatagagggtacgcagagactgggggcacatggtggaatgtctattgaggttggttatggcaaagggtccttgtgagaaaaaaggggaattgatgacagcaaaagcagaacagtggagcaaggagaatagagcagagatgaagaagaaagtgcagagaaaatagtggagtataggaatagtagtgt

SEQ ID NO: 614282 - DNA, 330 bp, Homo sapiens
tcaaagataggaaacaaagttagtggtttataccataatattaggcatgaattcttactgcttacattttctgccagttcatctctaaagatgggtgactataagacagaggaagaaagtagtaaagaatcaatgtcatggagcaatcgaattgtgtagaagtcacttaagaggaaatacgtacaccatttccccaccacagctactttaatttagttgatgtgtttttgttttttttttcctacagggaatgcctctataacattactattttattttaagttctgggatgcatgtgcaggatatgtaggtttgctacatagtcgacgc

SEQ ID NO: 614283 - DNA, 957 bp, Homo sapiens
  misc_feature (24)..(24): n is a, c, g, or t
  misc_feature (209)..(209): n is a, c, g, or t
  misc_feature (228)..(228): n is a, c, g, or t
  misc_feature (237)..(237): n is a, c, g, or t
  misc_feature (249)..(249): n is a, c, g, or t
  misc_feature (262)..(262): n is a, c, g, or t
  misc_feature (290)..(290): n is a, c, g, or t
  misc_feature (299)..(299): n is a, c, g, or t
  misc_feature (379)..(379): n is a, c, g, or t
  misc_feature (424)..(424): n is a, c, g, or t
  misc_feature (436)..(436): n is a, c, g, or t
  misc_feature (445)..(445): n is a, c, g, or t
  misc_feature (455)..(455): n is a, c, g, or t
  misc_feature (488)..(488): n is a, c, g, or t
  misc_feature (557)..(557): n is a, c, g, or t
  misc_feature (563)..(563): n is a, c, g, or t
  misc_feature (571)..(571): n is a, c, g, or t
  misc_feature (576)..(576): n is a, c, g, or t
  misc_feature (578)..(578): n is a, c, g, or t
  misc_feature (582)..(582): n is a, c, g, or t
  misc_feature (597)..(598): n is a, c, g, or t
  misc_feature (604)..(604): n is a, c, g, or t
  misc_feature (606)..(606): n is a, c, g, or t
  misc_feature (622)..(622): n is a, c, g, or t
  misc_feature (687)..(687): n is a, c, g, or t
  misc_feature (739)..(739): n is a, c, g, or t
  misc_feature (904)..(904): n is a, c, g, or t
  misc_feature (906)..(906): n is a, c, g, or t
  misc_feature (926)..(926): n is a, c, g, or t
  misc_feature (936)..(936): n is a, c, g, or t
  misc_feature (939)..(939): n is a, c, g, or t
gcagaggcagccttggagagcccnaggccagccctggtgagatccgcctcccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacggnccccgcagatggactggancaataattnctaacttttcantaacctctgagcnccctgctgccacccagttactgtcaggncctatccancattccaccccacctttttccttctccccaattactccccttaatcaatgtacaaatcagcacccatatccctttttttnacaaatgatttctctagagaactatgttcttccctaactttaggnaaagtgaatttnttcccgtcntcccgcattnagaaaggagactcttcctccctcctcctcactnagtgcctcatcctaccgtttttcccttttccacccttcctgggacatcgctggaacttgcaccattccnttattnttttactnaggcnanaggncaccctcccttcctnncccatntnataaatgggtccaggnctgatcaaagaactctgactgcagaactgccgctctcagtggacagggcatctgttatcctgagncgtgtggcagacacgtcttgttttcatttgatttttgttaagagtgcagtantgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagcncngtaccaccattgtaaggaancccttcaganatncagctggttcctccaaaa

SEQ ID NO: 614284 - DNA, 402 bp, Homo sapiens
  misc_feature (290)..(290): n is a, c, g, or t
cacgaggggcgggcatcgagcgcgcgcgcctgtaccggctgcgcgatgaatcgctgggtgccggacttgatccagacgatcgtttcgttattcggcccgcgcacgaccgcctcgctcggcagtgcaatgcccttgacggtatcggtcagccgggccaggacggtgacaggctgcccgaccgccagcggcacggcggccccatcggcgagccggaacgtcagcggtacggcgccgttgcgtagactgcggcccgcgccgacgaactgcagcgccccgccgtcgacattggncaatgcgccgtcccggatccgggtggccaaggatgcgtcggcgctttgcgcctcgaccagcaaccgcgcggaatcgacgatctcgtaaagcacgtccgttccctcgacgaac

SEQ ID NO: 614285 - DNA, 115 bp, Homo sapiens
tgtagaatactcctcggaccgggccccgcgggtatctcccatcggcgcataccactgcgaacaacgcgggcggcgcgcggaggagggaagagaaaagaggagagtgttgcggccg

SEQ ID NO: 614286 - DNA, 101 bp, Homo sapiens
  misc_feature (96)..(96): n is a, c, g, or t
ggataaataaacagttattttataagctgcacaacctctacacacatattatggaggacagaagagcgcgtcttttttttgcgaagaagaggaagncacag

SEQ ID NO: 614287 - DNA, 242 bp, Homo sapiens
ccctgatctgcacccgctagtgggcgtctcatcccatagtccctggtcttcccacgccgctgtgggcgtctcagcccattgtccctgctcttcccacccgctgtgggggtcccagcccattgtacctgctctgcccacctgctagtggggatctgagcccattgtccctgctcttccgaaccgggcagtgggggtctcgagcccttagtccctgctcttcccaccgcggtagtgggggtctc

SEQ ID NO: 614288 - DNA, 184 bp, Homo sapiens
agtcccgtatacttgaggctgaggcaggataatcacttgaacccaggaggctgaggttgcagtgagctgagatcataccactgcattccagcctgggcgacaggatgagacaagtgagactccatctcaaaaaaataaaataaaggccatatgtttaatcacattccccaaaaggagaacttca

SEQ ID NO: 614289 - DNA, 112 bp, Homo sapiens
gacccactccaccttaccaccagacaaccttagccaaaccatttacccaattaaggtataggcgatagaacttgaaacctggcgcattagagtttagtaccgcaagggaaag

SEQ ID NO: 614290 - DNA, 175 bp, Homo sapiens
atgatctaatggcagggaaactaaataataaacacagcagcatccttctgattgtagaaatgcttattgactctctcaagggacgttggaggaacatctcaggtggttgtagttatcaaggcccactctgctttacttaaactacctaactcattctaaaacaagactatagcta

SEQ ID NO: 614291 - DNA, 339 bp, Homo sapiens
  misc_feature (72)..(72): n is a, c, g, or t
  misc_feature (206)..(206): n is a, c, g, or t
  misc_feature (222)..(222): n is a, c, g, or t
  misc_feature (225)..(225): n is a, c, g, or t
  misc_feature (235)..(235): n is a, c, g, or t
  misc_feature (280)..(280): n is a, c, g, or t
  misc_feature (292)..(292): n is a, c, g, or t
gctgagtgtgatgcctacctgacctctccatgttacctggagtgctcacaacgtggtagtttgtcccaaganacacaggcaaatactacaaagcttcttaggacctagccttggaggtcctagaatacgacttctgctgcatcctattggaaaagcaagtcattgtgaccagcacagattcaagaaatgggagattcgactctacntgtcaatgtaaacagnagnatgtgcatgnagggaggaaagaaattgagggcatcatcttgaagactatcatatnacaccattattncaactagtgaacattatgttttagatgggtagtactagctactcata

SEQ ID NO: 614292 - DNA, 460 bp, Homo sapiens
gctactcaggaggcagacaggaagataagagtcaaaaacgatcattggaagaggcttttcactggagataaagagtgagggaggggacgctggggaaagaagtaagtttgagggaagaatttgttttttttttttaatcagggtctcactctgtcgcccaggctggagtgcaaaggcaccgatctcggttcaccaaaacctccgcctcccgggttcaagtgattctcctgcctcagcctgccgagtagctggaattacaggtgcgcaccaccatgcctggctaattttggtattttaagtagagacgggatttcaccatgttggccaggctgttctcaaactcctaaccccaagtgatccacccgccttggcttcctgagtagctggggcctcctgagtagctggggcctcctgagtagctggggcctcctgagtagctggggcctcctgagtagctggg

SEQ ID NO: 614293 - DNA, 424 bp, Homo sapiens
ggctgaagttcctatgatgttgtttggattaaagagtgtgtgtgccgaggccttccccttcctttattttcttactccacttatccttcctcttcttcactttatcccaatcctctctcttattatttttctctacagtttttctctttcctctttccttcctaatcctacattccctcctcccctacatccccctccctttcttttcacctctccaaccttcaacttttttcatctaattttaaccacttgtttcatctcctttctttcttctcacactcccctacatcctttctttttccctaccttccctccctctccctacacccctctcatttccttttccctccttcattctcacccttcctccccctcaccccccctcttcatttctcctcttttctccttccttctcttccacttc

SEQ ID NO: 614294 - DNA, 289 bp, Homo sapiens
ccccccgccccccccccgataggaaccgggggccagtttttttttggtccggccttggggggtttccccaaccggggggttttggccccctttggaccccccgggcccggccgggttttttaaattttccttttttcccgggcagggggggaacttttttaaatttccccccgggggggtggggaattttgtctttttcccgggggttgccccggtagggtttttccccagggtttctggggtttccccattttttttttggtttaaatttttcgggttcttcccccca

SEQ ID NO: 614295 - DNA, 697 bp, Homo sapiens
  misc_feature (326)..(326): n is a, c, g, or t
  misc_feature (335)..(335): n is a, c, g, or t
  misc_feature (337)..(337): n is a, c, g, or t
caggaattcggctcgagagtatcattagacatctttgccaagagactgtagcagccagctgccccccgtggattaaggtttaaagacaaaattaaatggcacctctccttaagatctgcttgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaanggagtcagntntgacagcttacaaactgggaagttctgtgcatctccagggattccagagttgaagatctggttgttggaagctgggcgcccagtgcttctatgtttttatttttctaagcccagatccggcaggacccactgaacaagggtgaactcggctgtgggctcggctggccaaggctgattggaccgctaaggcacaaccccagatggaaggggcaatggggtcttaaccatgatgcaggagatccaattacaggagttttaacaggggctctattaaccgggaagagctacggtccctttgaacgcaatatttattattaacgcgctggggattgtaccttatactccccgttgaggcgctcc

SEQ ID NO: 614296 - DNA, 160 bp, Homo sapiens
cgctctccgatctctctatacaccatgctatacaccctataccctctttaccaccataccaccatatccactctataccaccataccacactccccaccttcaccattttacagtataagaaaagcactacctccatgagaatacgtgggtggtatagct

SEQ ID NO: 614297 - DNA, 184 bp, Homo sapiens
atgaggcgcccccgaggttcacagtaatcaagcagtcaggtgttgatgcaacttttcaaggtccagccaccgggagttgcctagtccgctcttggaaccttgtaaggcataactgctgggactcaacttggctgagaaatgcacaagatgccaaaggaggaaggattatagggggcctcatgtg

SEQ ID NO: 614298 - DNA, 352 bp, Homo sapiens
  misc_feature (174)..(174): n is a, c, g, or t
ggtcgaccacccatttcattctgggcttagtgaaagtgaccccgtggctgggcacagtggttcacgcctgtaatcctagcactttgggaggccaacgcgggtagatcacctgaggtcaggagttcaagaccagcctggccaacatggtgaaacccatcactactaaaaatacanaaaattaaccgggcgtggtgacgggtgcctataatcccagctactcgggaggctgaggcaggagaatcgcttgaacccaggaggcagaggttgcggtgagccaagatcacgccattgcactctagcctgggtgacaagaacaaaactccatatctaaaaaaaaaaaagaaagtcgacg

SEQ ID NO: 614299 - DNA, 661 bp, Homo sapiens
aggtgttctagaggatcccgggatgacgacatattcagacatggaggtacccacgtacagatgtccgtataatacagtatacaagaaccgtaaaggagtatcatcaagagatggagagaatttcggcaaacaggtcacatctgtgcttcagacacagggcaaatcctggaaattagatatgccagagtacttcagtagactgggcggcgagctgaaccaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggcagatgaaaattactaccaaaaaaaacatggcgggttattctaccagattgaaatggtcgccaatcgg

SEQ ID NO: 614300 - DNA, 1240 bp, Homo sapiens
  misc_feature (959)..(959): n is a, c, g, or t
ggttagactgccactaccgacatgctgtcgtggacacaggaccccatggatgccaacctatggataacggatactgactcataattgagacagtggtcggacgagaggagcatagtactattgcgggaacagaatctcactcacctaactgcgcacactcgtgtatctaataacactggcgagttggacattctgaccacctaagaaagcactatgtgccaaacatccagacgacacggagagcttgcttaaagtcatgagagaacatagggcgatcgtccgtgtcgacacttcatggccatgaaggtcctagtgggatttagaactgacagacatggtagcagctgctggaccggtggttcatccacgcaatggaagtaatcctccttatgcgtggtgccaacatgtaatgaacacaacgggcacgagtcatcccgtctatgcacagatgtgttgaattccataccacttcacgttctgacagtgacccaccacagtcagaaaccactactagcgaaaggaacaccctcgtaatacatccagactaaagaaaccacggtggaaagtgagcataggaaggcaatgccacattgcgtacaattgacgaacattcgacccattgatggggccgtcgggcatcggcagtagaaaattcatgtcctcatgagtccctatactcgatgagggcaatagccatagtggatgggctagtaccacaattaatatagaccaatagggtctgtggaggagtaggaatttcctgtacaccggtgagcacgcaccaaccattggaagatcgtcgccgcagagtcgaaccactctcttgtagcaagtttgcaacatcccggaattgtgcgcttgcacccaaatatatcacctcggtggctgtccaaattatactcacagagatccacacattattggagccgaagagttatagtggatggtcgcatcaaaancttgaacactggcaaataaggccacctatatggcatgctggcagttactgagactgtacaaaagcacaggaaggactcgccattgcggacacattattctcccacactgtgtggagacagaattcctcgagccccaacatattaaacacaacgccgtgccacggggataccaggcgagtgccacttaacatgagactcgcggcaaaccaacatgctggcatagtcataccggtgtcacattagcctaccagcgtcaacaaacagcaaccaccgccgacatt

SEQ ID NO: 614301 - DNA, 1000 bp, Homo sapiens
gagggcgctcttggttttgttgggtgagctctgtttgtgtccctgatggcgatgatcgtgattggtgatcggccatgcgtaatcctggtattctgcctcatacagagtctacaacttgcatgatcttcgttgcaaaacccttacaccaggaaatgatcaattctatattcttgtacttggagcccagtagattatcatcgaaataggtgtaatggtcaagatgccagagataaggaagggcatacccgcctgaacagaagaggctcatctttgttcgacagcctatggaacatgcgtctgcactcatttcatgactataatatacagaaagagtcagacctatgctcatggtccttttgtatgagacgtgctactgtaggactctgtcagattgatgcaacctgccatggggccagaacattacatcatgggaactatggttgacccaatgagcttttatctggataatgtagtaacggtctatagactgccacgtgcacttacttgatagagcttccttcccgggacatgtagaggctcctattggtgggtcaacagttgttgcatggggcgactctctttctgactgaccgatatgcgagataagaggtgccatcctgtccttgctttctgccccttggagaaggtggataggacttatctctcttgatgtaacttttacctgggtgaaggcattcatttattaaggagggtggcaatcctggcgaacgacatacgagaactgttgaatcggtacatttgcatgattttgaaaggaggcccatccgactccgtagtgagcgcatttgcatgcaagaacccctgaagattgacgggggcgtcgtcttctaatgcgcaggggtgcccctcccttgtgtcctgccagcaagtcgcgtcagacaccagggcgttagcccctcgcggggaactctctcacccaacgtgtgagtaaacacctcttacgcaaaaatggggtgtgtgccacacaaaattgggggcg

SEQ ID NO: 614302 - DNA, 438 bp, Homo sapiens
  misc_feature (5)..(5): n is a, c, g, or t
cattntgttaatcttttgatttgctttcttctggtgtttttgttatgtatattattacttgttactttttttatactagtctcatagctttttcagtattgccctatagactttataagcttcatttttaaatattatataacatttcaagatgtgtctattttgctgttactgaatacttaatttgcttataattttaaaattgttatggttaggatccacacagataagatcatggaattcctgtatttcaagttatttctttagaaaaaaaattgctgaaggatgcccactgctagcaatattaacattttatgtcttttattatcagttgtcaaatttctttctaaatggttgtagaaatgtatgtcattcattttaatattattaaaatattagcaaagtattacataaatattaaaaatattaataaaaatc

SEQ ID NO: 614303 - DNA, 124 bp, Homo sapiens
ctgctctgaggatccctcagatagcggaccccctctgctgaagcctattaggagtcaccgcgtattgcgctgcccgggttccttggaggcctcagaaccctgagctgagggggtccgcacaagg

SEQ ID NO: 614304 - DNA, 794 bp, Homo sapiens
tgagtgttcaaaactagctttagtataggctccatagatgggggtgtattagtccgttctcatgctgctcatgctaagtaatttataaaggaaagaggattaattaactcacagttctacatagctggagagacctcaggaaacttacaatcatgtcaaaaggggaaccaaacacattcttctttatgtggcatcaagagagagaaatgctgagcaaagggggaaaagccccttataaaaccatcagatctcatgagaacttagtcactgtcatgaaaatagcatgagggaaactgccctcatgattcgattacctcctactgggtccctcccacgacacatggggattatgggaactacagtacaagctgagattggatggggagttcatgtaaagagtgtgtaatctgcatatattaggtatgaagtgacacataattttggtaaaaggtgggtgggaaaattatattcatttaggagcctatttggaaagatatttaaaaaacaacacttttggaaaagaggttaatggatggtaggacactgtcgtcaatcagttcatctaggaccattacctgtcatttaaagtgctgaattgagactgtgattaaaaaagcacaacacaacacacaaaaacaaaacaacacacaaaaatcttgtggccgcgcgcaccaaaaattataacaatagtgggggcgggcccaggacggacggccaagtccagaaccggccgacggggggtccccaaaaagcgggcacgggttcaaccgggtgggccggtcacaggacggcta

SEQ ID NO: 614305 - DNA, 351 bp, Homo sapiens
tgggtgaggtacaggctcgaagcacagtcaggccacccgcgctgctcggtccccgctcaggtgcaggaggtaatacctaggtgggctggagtcaggcgtggagcggtagctgtgcgtggtgcgagcgcgccgggagcccgtgcgttggcgagcccgggagactatcggagtatgacagggagcggttcagcgacgacggatatgcggatagtatgcatcaggttcgactgcttcgtgatcttcgcggaagagggagctgtgctgcttgctgcgggacagggagggggccaagcgtccttgacctggacgccagagctcagggctcctcccatttcacggcctcacaacggt

SEQ ID NO: 614306 - DNA, 144 bp, Homo sapiens
gttccccggcagtgcgagagaatcgagacacattaactcagatttgcaaaccaggtttctgaaactttgggtaaggtgtatgcttttaacttttgataatgtataatcacccagctgtaaacgtatacctttcacgtgcatagc

SEQ ID NO: 614307 - DNA, 205 bp, Homo sapiens
gctattggagcacggccgttgtctcggcccggtcgccgaggcctgatcttcggttaaccgcttgggttctaggtgagcctttccataatcgaatgctccgttttcagtacatggcatattcggcacaattccctgggccttcactcttttaagtttgcacataggacatgtacaatgtacactaagccaggtatccatgctagat

SEQ ID NO: 614308 - DNA, 557 bp, Homo sapiens
ggtcagagaatggcgctgagaggcgagcggtgagcccagctgacatggagagtgagctcaccacgcgcagcgccatgatcagcaatggtcccgaggaggagcacccatcgtgtgacgctcttccgcacagtacctgcgtatccgcactgtccagcccaagccatgactatgtgaagtctgctgatggctttgctttgagtgagacagaccctgccatgactgggacctgggctgtcatgacaagtacgaggatggtcaccttggcttatgtgtgtgacctgtgttagacccttggccatggctatcgcatagcccgtacatctcctcgctcctatcgttgtcatcaatgtcgccaacagcaggattgtgtgtgccgtgttctttcatatggacacgattggaggtctagctgaccccttttagaggtccttcaagggagttcctgaggggcgtacgagtctattgccacggggatgccccaggacgatgaacgatggcgtcaggcgatccaagtacactggtaagcatgtgaaggagtggctgacaggttggaaggg

SEQ ID NO: 614309 - DNA, 806 bp, Homo sapiens
  misc_feature (408)..(408): n is a, c, g, or t
agcggcttctccgcccgctcccccctccccccgagcgccggtccggctgcaccgcgctcgctccgagtttcaggctcgtgctgagctagcgccgtcgtctgtctcccttcaggtcgccatcatgattagtctaccgggaacctcatcagccacgcatgcagatgttctccgcacatctacaacgatccggtgagatcgcggccgggattgtgcctggaggtggcaggggaagactggtcagtacggcacacgaacggtgaacattgatttactcgtcgtcagttgggtggaagatgcctgcccgctgagaggctcccgagggctgaacggtacctgacatggcacgacgtacatcagctcgagtgatcgatacttgtcagtgagaccatcagcctgcacggaaacaangtttcatcaaaacgagagcctatcaagaagttacagtcgctaggattaccagtgaaagtcagatcataagggaactcttgaacgaacaggacgaccaggaagatgacgtgaagaccttttatgagcagggggcttgcagaaccagtgttcacagcatcatccttgcttaattttcaagaatagcttaccacgtgctctgtactgtgcgtgagaaactattgacatccgagatggacatgagttggctctattgggacgtacctgtgagcgagtggtgtgacccccatatactgattgtctttaaggactggttaagagatggaaccatgttaatcaaatgtggcaatcactttaggatctatcacctgtcatcataactgggcttctgcttgtcatcc

SEQ ID NO: 614310 - DNA, 377 bp, Homo sapiens
gatccccctgctatccacgcatgtcaaggattgttcatgtgtgggctgtgctacggacattgcatgactaaggaagccactacggagctgttcctccaaagacgtaacacatgcaggataataacaaaggacaggatggtcatgccagtggatgaaagcattaacgaagcggatcaattcccctgtctactgttgctttcttaaagttctctccctcctgtggaatgctcagatgacttcaaaactttggaatcctggagaatccctttgttcacttgaagtgagttttcaagctctgtaaaataaaattcggtcttcggatacttacttctggctggggatgtgtatggaaaatacaagcagattgaaagttctcc

SEQ ID NO: 614311 - DNA, 183 bp, Homo sapiens
ggtgctgggtaccaaaagtgctggggagggctcagcacactggatcttgcagtcaggtgggagaagccgaatgtgagacagtgggatgcgtcctgtgtccccatcatcaaactctactgtgatgagatcgccatcttcctccagatccagggttcctcggacaactgtccctggggtcgacgc

SEQ ID NO: 614312 - DNA, 360 bp, Homo sapiens
  misc_feature (1)..(1): n is a, c, g, or t
ngccaaatcagcatggcattggtaaaaaacaaaacaaacaaaccaacaaaacaacccagacacaaagaccaatggaacagaacccagaacccaggtgtaaatccacacatttacggccaacccatttttaacaaaggcaccaagaacatccaatgggcaaaggacagtctcttcaataaatggtgctgggaaaaccggataaccatacgcagaagaatgaaactggacctctatctctcactatatacaaaaaaatcaaatcaagatggattacagacttaagtctaagacctgaaattatgaaactactagaataaacattggaaaccaggtgtggtggctcatacctgtaattccagc

SEQ ID NO: 614313 - DNA, 198 bp, Homo sapiens
agagacgtagaaactccagacccaatcaattaatattacagcactgattatgacattgatccaaatgctggaccatttgctttgatcttcctttatctccagtgactattaagagaaatggaccatcactcggcttaatggtgattttgctcagcttaatttaaagataaaatttcttgaagaacactcgggtaccga

SEQ ID NO: 614314 - DNA, 113 bp, Homo sapiens
acgcgtgggcttgcatggacactactgctgaccatatgcccaatcaatgaagtgaagaaaaagcttgatgatgcatttccataagcttccaagccttctctcgtgtgatgatg

SEQ ID NO: 614315 - DNA, 815 bp, Homo sapiens
tttctgcggactgggtagaagaagggtgggtgtgggatggggagggcgcagagtggattttgccctgtggcagaccctggcagaaggggcacggggcagtgatgtgagttccccactagcagtgccagtgtgagctatgtgtgctgcacctactgctcttcttgctgctgaccccacagggtgggcacagctgccagtgtgctggatgctggccctgggaacttgttctggccaatggtgagggccctgttcttggatgccttgtgggcccccctgtgtgtgaccagtggaagtgtggggaccactgtgagtcatggctgtgctgccccgaagacatgccctgtggtggtgcttcacacacaggggctctgacccgaggaagaggaggatgtctcccaagccatccttttaccagccaacagatgccagctgtgaggacaagtcatgctgccagagggctggcccatgtgaaggctatgagagaagggagcctctttcaagattacaattgtacacagagccatccacaggacattacaacagcaagaacatgacacagtgttgactctcatagcaccaaagctagtgaggtatccaaaaaagcctgggagctttgtggaacaaagagccacatcgagagcaacacaagtaaatggccaatcacaaaattaacgcatccattgaagaaccacaatggcttaaaggacctttggctagtgcaacatatggtacagcacgagtgaaagaaccaccatgatagtaattgtagtcgccaaaagtgtacatattgagtgacacaatacgtatccccccaa

SEQ ID NO: 614316 - DNA, 928 bp, Homo sapiens
  misc_feature (74)..(74): n is a, c, g, or t
  misc_feature (88)..(88): n is a, c, g, or t
  misc_feature (113)..(113): n is a, c, g, or t
  misc_feature (116)..(116): n is a, c, g, or t
  misc_feature (118)..(118): n is a, c, g, or t
  misc_feature (123)..(123): n is a, c, g, or t
  misc_feature (132)..(132): n is a, c, g, or t
  misc_feature (135)..(135): n is a, c, g, or t
  misc_feature (139)..(139): n is a, c, g, or t
  misc_feature (152)..(152): n is a, c, g, or t
  misc_feature (162)..(162): n is a, c, g, or t
  misc_feature (172)..(172): n is a, c, g, or t
  misc_feature (177)..(177): n is a, c, g, or t
  misc_feature (185)..(186): n is a, c, g, or t
  misc_feature (211)..(211): n is a, c, g, or t
  misc_feature (216)..(216): n is a, c, g, or t
  misc_feature (230)..(230): n is a, c, g, or t
  misc_feature (237)..(237): n is a, c, g, or t
  misc_feature (240)..(240): n is a, c, g, or t
  misc_feature (287)..(287): n is a, c, g, or t
  misc_feature (296)..(296): n is a, c, g, or t
  misc_feature (309)..(309): n is a, c, g, or t
  misc_feature (319)..(319): n is a, c, g, or t
  misc_feature (321)..(321): n is a, c, g, or t
  misc_feature (353)..(354): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (372)..(372): n is a, c, g, or t
  misc_feature (378)..(378): n is a, c, g, or t
  misc_feature (407)..(408): n is a, c, g, or t
  misc_feature (423)..(423): n is a, c, g, or t
  misc_feature (427)..(427): n is a, c, g, or t
  misc_feature (443)..(443): n is a, c, g, or t
  misc_feature (496)..(497): n is a, c, g, or t
  misc_feature (501)..(501): n is a, c, g, or t
  misc_feature (537)..(537): n is a, c, g, or t
  misc_feature (542)..(542): n is a, c, g, or t
  misc_feature (545)..(545): n is a, c, g, or t
  misc_feature (554)..(554): n is a, c, g, or t
  misc_feature (566)..(566): n is a, c, g, or t
  misc_feature (584)..(584): n is a, c, g, or t
  misc_feature (767)..(767): n is a, c, g, or t
  misc_feature (810)..(810): n is a, c, g, or t
  misc_feature (821)..(821): n is a, c, g, or t
  misc_feature (920)..(920): n is a, c, g, or t
gggtgatcgtgcaccggcagctggacggccgcgtgctgctgaacacgacggtggcgcccctgttctttgcggancagttccttcagcngtccacctcgctgccctcgcagtanatnanaggcntcgccgagnacntcantcccctgatgctnagcaccagcnggaccagganaaccntgtggaanngggaccttgcgcccacgcccggtgngaacntctacgggtctaancctttcnacntggcgctggaggacggcgggtcggctcacggggtgttcctgctaaanagcaatgcnatggatgtggtcntgcagcagancnctgcccttagatggaggtcgaaaggtgggatnntggatgtntanatnttcntgggcncagagcccaagagcgtggtgcagcagtanntggacgttgtggganaaangttcatgccgccatantggggcctgggcttccacctgtgccgctggggctactcctccaacgctatcanncgcnaggtggtggagaacatgaacagggaacacttccccntggangtnaaatggaangaaatggaatanatggactcccggaggacnttcacgttcaacaaggatggcttccgggacttcccggccatggtgcaggagctgcaccagggcggccggcgctacatgatgatcgtggatcctgccatcagcagctcgggccctgccgggagctacaggccctatgacgagggtctgcggaggggggttttcatcaccaacgagaccggccanccgctgattgggaaggtatggcccgggtccactgccttccccnacttcaccaancccacagccctggcctggtgggaggacatggtggctgagttccatgaccaggtgcccttcgacggcatgtggattgacatgaacgagccttccaacttnatcagggg

SEQ ID NO: 614317 - DNA, 468 bp, Homo sapiens
ccagcgcatttcgcagggcggccatttgcgccacgcccctgacgaaatccttgaatgcagccttccactggtgtagctgcaaggcttcggccgagcgcttgaacaaggtgtagctgcgccataccaccagcgggtaggcgagtttgccggccatgaactgcaccgccgtcggtatgtccttgccgaacagacgcgttgcgtgatcccacagggtcttggcgccttcttcgaattggctgcccagcaccttgagcaacatcaatgtgttttcactgaacaggtaatgcagcacattgcccgtcactgccgaagcggccaggcggatatcgggcgggctatgctggttgtttttcagcaagtggcggtaagtggcctgatgcggatcttccaggtgcataagcacccagtcctgcagggcgcctggcccttgtatctcatccagtaagcccgtttcatccgcgtattcct

SEQ ID NO: 614318 - DNA, 767 bp, Homo sapiens
  misc_feature (13)..(14): n is a, c, g, or t
  misc_feature (129)..(129): n is a, c, g, or t
  misc_feature (144)..(144): n is a, c, g, or t
  misc_feature (165)..(165): n is a, c, g, or t
  misc_feature (189)..(189): n is a, c, g, or t
  misc_feature (193)..(193): n is a, c, g, or t
  misc_feature (197)..(197): n is a, c, g, or t
  misc_feature (277)..(277): n is a, c, g, or t
  misc_feature (284)..(284): n is a, c, g, or t
  misc_feature (327)..(327): n is a, c, g, or t
  misc_feature (356)..(356): n is a, c, g, or t
  misc_feature (364)..(364): n is a, c, g, or t
  misc_feature (373)..(373): n is a, c, g, or t
  misc_feature (379)..(379): n is a, c, g, or t
  misc_feature (407)..(407): n is a, c, g, or t
  misc_feature (463)..(463): n is a, c, g, or t
  misc_feature (476)..(476): n is a, c, g, or t
  misc_feature (506)..(506): n is a, c, g, or t
  misc_feature (509)..(509): n is a, c, g, or t
  misc_feature (533)..(533): n is a, c, g, or t
  misc_feature (594)..(594): n is a, c, g, or t
  misc_feature (664)..(664): n is a, c, g, or t
  misc_feature (681)..(681): n is a, c, g, or t
  misc_feature (693)..(693): n is a, c, g, or t
  misc_feature (703)..(704): n is a, c, g, or t
  misc_feature (754)..(754): n is a, c, g, or t
tctttgctcacanntaatttttattttgattttttttaatgctgcacaacacaatatttatttcatttgtttcttttatttcattttatttgtttgctgctgctgttttatttatttttactgaaagtnagagggaacttgtgnggccttttttcctttttctgnaggccgccttaagctttctaaatntggnacanctaagcaagcggaagggaaaagggggtttcgcaaaaacactcgggggaagggaaagggtgctttgttaatcatgccctanggggggngattaactgcttgtacaattacgtttcacttttaattaattgngcttaaggctttaattaaatttggggggncccttctnagagcagcncgtacngacgaaggggcatgcgctgaatgatgtnacggcagtggttgaacacacggcggatgttctcagtgtccacagcgcaggtgaaangagggtagcagtngtgacgcccatctccactggcagtgctganccncagaaactcatctcgaatgaagtncttggcccgggtcacgcgtgggtcctctccgggctcgggagttgcatcctcaggagttgtntagcgagcaaattctggaaagtagttctcaatcttcgatttcccagcaaggactttctcagcgagcagancttgcttgttgaggaanaggatcacaganatggtgcgcnncattctgttgttccagaagctcttgaagaggttcagagcctcctgcaggnggttggtctggtt

SEQ ID NO: 614319 - DNA, 230 bp, Homo sapiens
  misc_feature (20)..(20): n is a, c, g, or t
  misc_feature (106)..(106): n is a, c, g, or t
gaaaagatgggaagggccangcgcgatggctcatgcctgtaatcctagcattttgggaagctgaggcgggcaggttattgagcccaggagtttgagaccagcctgngcaacacggcaagaccgtctacaaaaacatacaaaaatttacttggtgtggtggtgcgcatttgtagtcccagctactcaggaggctgaggtgggaagtcagggttttgggggaaattccctac

SEQ ID NO: 614320 - DNA, 107 bp, Homo sapiens
gtgatctgaggaaagtacgagacctttctgagtctcagtcaccctctatagtaagtgacaggaatgaagtggagcgtatttcctgaggttgtagaggggaataaagg

SEQ ID NO: 614321 - DNA, 459 bp, Homo sapiens
  misc_feature (27)..(27): n is a, c, g, or t
  misc_feature (376)..(376): n is a, c, g, or t
  misc_feature (387)..(387): n is a, c, g, or t
  misc_feature (443)..(443): n is a, c, g, or t
ctctaaactgaaaaggcccttgtggtnggcgcacagtagctcaagtttgtaattccaccactttgggaggctgaggagggtggatcacttgaggtcaggagttcgagaccagcctgaccaacatggtgaaaacccgtctctactaaaaatacaaaaattagctgggcacggtggtgggcgcctgtaatcccagctactagggaggctgaggcaggagaatcgcttgaactcgggaggcggaggttgcagtgagcctcctgagtactccagcctggggtgacagagtgagaccctgtctccaaaacaaaacaaaacagaacagaaggcccttgttgaaggttcagattgagagagtcttgttaaatccctttaggcntgttaagttanttattggttttaccctaagtttttccaagcattattttagtttttttttgtctttnaaaattttatttttaa

SEQ ID NO: 614322 - DNA, 145 bp, Homo sapiens
ggggacttatgacagtggatccgtcgggatcgccatcgtagggaaaggcaggcaagtggttcagcgagagtccggggggacgttgagaagttcctggttgggggcagatggtatacccatcatgcgctggcaccaccggaccacg

SEQ ID NO: 614323 - DNA, 525 bp, Homo sapiens
  misc_feature (10)..(10): n is a, c, g, or t
  misc_feature (39)..(39): n is a, c, g, or t
  misc_feature (72)..(72): n is a, c, g, or t
  misc_feature (74)..(74): n is a, c, g, or t
  misc_feature (104)..(104): n is a, c, g, or t
  misc_feature (108)..(108): n is a, c, g, or t
  misc_feature (140)..(140): n is a, c, g, or t
  misc_feature (156)..(156): n is a, c, g, or t
  misc_feature (217)..(217): n is a, c, g, or t
  misc_feature (225)..(225): n is a, c, g, or t
  misc_feature (391)..(391): n is a, c, g, or t
ctccaattancccaaaagttcttgggggcaggtccaggntgccacccctatggccacagggccctttgaggnanggttaattttgttgccggtcttacgttgtncttnctcatacctggcaggccagattgaaccacaancccgctggaagccaancggggaaggcacatcctagaagggcagtgacctctggaatgctacaggcacgtgtggatgnatgaggcnccatggcggccaaggagatatctgctcctgagtaaggtcacctgaccacagacagcaccaggggctggggggctaagaaggagatcttgagaaggatggacctgagctaaagatgtaacttagatggtgatctgaaaaaaggaaaaaagaataaacgctggaactnaaatccactgtttagggtacaggagtacacagctaagttccaggtatccagaatcttgtgtccaaatcatagcacaaggagaacaggaattctcttgagttaaggcaaaatcaatcttcactcgtgccgaattc

SEQ ID NO: 614324 - DNA, 621 bp, Homo sapiens
actaaaaaaaaaaaaaaaaagcttcttatctgggcatggtggtgcacgcctgtagtcccagctacttgggaggctgaggcaggagaatcgctggagcccaggagtttgaggctgcggtgtgtcatgattgcaccactgcactccagcctgggtgacagagtgagaccctgtctcttaaaatttaaagcagccgggcatggtggctcgcgcctgttgtcccaacatgttgggaggccgaggggggcggatcacgaggtcaggagatggagaccatgctggccaacatgaaaccccgtctctactaaagatacaaagatcagttgggcgtggtggcacacgcctataatcctagctactcgggaggttgaggcaggataattgcttgaactggggaggtggaggttgcagtgagccgagatcacaccactgcccttcagccttggaacagagtgagactccattttcaaagaaaaaaaaataaggctgggcatggtgggtacatccataatcccagcattttgagagcccgagacgggcagatcacttgaggtcaagaagttgaaggcaggctgacccatgtggacccctgcctttactagtccatgcgggaggatccctgct

SEQ ID NO: 614325 - DNA, 220 bp, Homo sapiens
tctctagcaggatcccgcatatggctttgacagacaccatgccatcgcgggccagcccgctcccacacaagcgttattcgtgatcagctacgcctttgagatacggcgctggcgccgcgcccacgttgtcgagcttccgctcgctgtaccaatccacaatattcaccacgccaaactcatacgtctcggagatacgtcctggctggatatgccacagtac

SEQ ID NO: 614326 - DNA, 708 bp, Homo sapiens
  misc_feature (13)..(13): n is a, c, g, or t
  misc_feature (82)..(82): n is a, c, g, or t
  misc_feature (86)..(86): n is a, c, g, or t
  misc_feature (91)..(94): n is a, c, g, or t
  misc_feature (108)..(108): n is a, c, g, or t
  misc_feature (113)..(113): n is a, c, g, or t
  misc_feature (124)..(124): n is a, c, g, or t
  misc_feature (147)..(147): n is a, c, g, or t
  misc_feature (210)..(210): n is a, c, g, or t
  misc_feature (215)..(215): n is a, c, g, or t
  misc_feature (218)..(218): n is a, c, g, or t
  misc_feature (233)..(233): n is a, c, g, or t
  misc_feature (237)..(237): n is a, c, g, or t
  misc_feature (299)..(299): n is a, c, g, or t
  misc_feature (310)..(310): n is a, c, g, or t
  misc_feature (322)..(322): n is a, c, g, or t
  misc_feature (330)..(330): n is a, c, g, or t
  misc_feature (338)..(338): n is a, c, g, or t
  misc_feature (355)..(355): n is a, c, g, or t
  misc_feature (360)..(360): n is a, c, g, or t
  misc_feature (369)..(369): n is a, c, g, or t
  misc_feature (374)..(374): n is a, c, g, or t
  misc_feature (395)..(395): n is a, c, g, or t
  misc_feature (415)..(415): n is a, c, g, or t
  misc_feature (418)..(418): n is a, c, g, or t
  misc_feature (425)..(425): n is a, c, g, or t
  misc_feature (427)..(427): n is a, c, g, or t
  misc_feature (432)..(432): n is a, c, g, or t
  misc_feature (448)..(448): n is a, c, g, or t
  misc_feature (498)..(499): n is a, c, g, or t
  misc_feature (561)..(561): n is a, c, g, or t
  misc_feature (563)..(563): n is a, c, g, or t
  misc_feature (571)..(571): n is a, c, g, or t
  misc_feature (576)..(576): n is a, c, g, or t
  misc_feature (583)..(583): n is a, c, g, or t
  misc_feature (601)..(601): n is a, c, g, or t
  misc_feature (607)..(607): n is a, c, g, or t
  misc_feature (627)..(627): n is a, c, g, or t
  misc_feature (631)..(631): n is a, c, g, or t
  misc_feature (639)..(639): n is a, c, g, or t
  misc_feature (642)..(643): n is a, c, g, or t
  misc_feature (646)..(647): n is a, c, g, or t
  misc_feature (704)..(704): n is a, c, g, or t
ctttatgaatttnctcatggagatagcatttacatcacagagctgttgtgaaaataaaataagaatgtacagcacacctggnatanaaaannnntcccaataacttanttggngcgccgcggcnatccatccctcacatataaatanaatggaccagatgaagatccgtgtccgtgtccatgacagcaatccattcagaagatcaaaganaaatngtntagtacaccaatttntganatttgcttagcactgcagggctcatgaggggctgccactcatattatctcatttaatccctncaacagaaacntaggctctgggnggtgagtncttgcagnaagaacagtaacaagantccantggtttgcnaaaantgccatatgtgagagggctgngggggcctttgatagtgggntgngggagcncngctgnagctgcagctatgagngtgttctagcagcacgactgtggcctggaggggacattcttcctccgggnnagggaagggagctctcatggtgactgggcccctcctgggcaatggcaatgccactggagaanangctggaanccatntgctacngggatgtcttttatttgnatattnatatttcttcacagaaaatnaagnaagtggcnatnntgnnctggattaatccatttggacttggtcccattggtgtccgtggcagcttctgctttgnctgt

SEQ ID NO: 614327 - DNA, 372 bp, Homo sapiens
gtgatctaccatcgctaacgtagcccactgtacttcccacagggtagtttgttttccacttccgcactgaatattattattattcgattctaaaatggatgccactcatatatatcgtagaagtgcatgagataaagtccctgtgctcaacagctgccatgaagtacttctagactttactgcacacatggcaacacatatatgcacactggtacacagacctatatatatgtaaatcttttaccctaactagaatattatacagatggacctatgcgacatcacttattttctccttaagaacacccttatgggatatctttccatgctcaggacaatctatataagagtactaccttccttttggggcgt

SEQ ID NO: 614328 - DNA, 501 bp, Homo sapiens
  misc_feature (12)..(12): n is a, c, g, or t
aaaagttgctancccagcgtcccattctctttcctccgtactaacagaaccccgtgcctctgccccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggacgctgggcctttgctgacgcagaacgcgggaaggaccctgggcctttgctgacataccagccccagactacttaaattcagctttttttttaatgtgagaaaataaatgcacccctctctggtttaagaaaaaaa

SEQ ID NO: 614329 - DNA, 112 bp, Homo sapiens
ggcccgaattgaaactttatcactaaataattccatcgctttttttctactgttgttggtttaaaatctgttacatacgatacaaaaagagtatcccttgttcttctttttg

SEQ ID NO: 614330 - DNA, 493 bp, Homo sapiens
tctgtgatcatgggagcggggcggaggtcctcatcgtcctctccatgctgctcctgcgccgggaagaagccctacggggctatcagccatggcgtggtggaggtggaccccatgctgaccctggaggagcagcagctccgcgaactgcagcggacggtatgagaaccccatttaccgcttcctggaggaacgaccctgacccggatcgtttaccccttcagcgagaccagacctcccctctttctggaggcgcagaagcccgaatccctagtcgtaggggagcagggatgtcttgaagtgatcatttctagcaccacttttgtgagacggttggaaatacttatatcccctcctttccaattcgcaaatatttccgatctctctaaagaattgccctaggatagtcgacagggaagcttccgccatgtgggaacctcctcaccgttaagtttcagtgccaagaggttatatttgatggctcgtctagggggga

SEQ ID NO: 614331 - DNA, 115 bp, Homo sapiens
  misc_feature (10)..(10): n is a, c, g, or t
  misc_feature (69)..(69): n is a, c, g, or t
  misc_feature (84)..(84): n is a, c, g, or t
ctcaaagcanaggtgttggacatttgatcactgagtagatctctaggtatagggcccaagtatctgcanttttcacaggttctngtaggtgactttctgcaacctaaagtatgag

SEQ ID NO: 614332 - DNA, 269 bp, Homo sapiens
gtgctgctcgaattcctgagcgcttctttcctggaaaatccgacatatggttccagtctcatcagattttccatgtcctcggtggtggcagcagctttggtccacttctatggagtctccaaccttcaggaattccgttcacggcctagaaggcggctgtactgatgacaccattctctgagccttcccacctccggggtggagcgaggagctaccaagtgcttttaaaaataactactctactgagtgagagaagatctgagttgtct

SEQ ID NO: 614333 - DNA, 659 bp, Homo sapiens
  misc_feature (3)..(3): n is a, c, g, or t
tgngttgatacccgcgaatgcggccattatggccgggtgcgaggacacatgcctgatatgggagcagtcagggaggcgaaggggggcagggcacttgagatgaggagcccgagacccaccaggacaacaaagcgaaacccgaacgctacgaaaaagacacaaaactagccaggcatggaggcacacacctggaggccgaggtactcaggaggctgaggcaggataacgacttgaacctgggaggcacaggctgcagtgagccgaaaccatgccactgcactccaggctgggagacagagagatctgagactccatctcagaaagaaatagcaagaactcgccaagctagaaaagtaaacggactccacattaactaaataccgaaagcgaagattaccaaaacagggaagatagcgacaatctcacagcacgcaactacagaacacggagtcgtcaggacgccgccaagaaggcccctcgaggacggcccctagccaacgaccaccacaacaaacgacaactaaaacggagcgcaaaccaagcctgggccaacgggcggcactccggccgccaaacagcacggacgcaagctagggcgcggaggaccaggcccacaagcgccagccgcgcaaccaggccggacgcgccacgcgcggccc

SEQ ID NO: 614334 - DNA, 288 bp, Homo sapiens
ctcctcctagacggcaaactagtgagaagatttataggtgaggcgacacacctaccgcatcctggtgatagcttggttgttcaatgatagatctcttagttcaacttttcatttgcccacagaaccctctaaagtccccttgtatatttaactgattagtccatagtaggaacagctctcttggacactagtgcaaaaaccttgtagagagagataacacatttgacaccctttgtaggcctactagcagccaccaattaagaaagcgttcaagctcaacacccacta

SEQ ID NO: 614335 - DNA, 197 bp, Homo sapiens
ttcttagcccatcttcatcatattccgctataatatctaagtattatcacagacctttcggatttcattattcttatcagcattaggtctatgagatatgcggagccgtgtttcctgattatgacgtctcttgtggctcggtggaaaaccatctggtagaagacataaattatctgacacacaaattcatcatcttc

SEQ ID NO: 614336 - DNA, 766 bp, Homo sapiens
gatgcattttcccaatgttttcgccgtgctgaaactttccctcaggcccagcctcatgtagactctcagttgtttcgatgctatctctgcacaggtctaaaccttaccgcctacttatcaatatctctcctcgggacctggcgcctcgaagtattgcacgcgttgttggagaccctattccgtctggcatgggtatcctgctcagaatcatcggcctttgggctgcccctgctcaatcgactgcaagtaatcggcgcgtctatgtgagaggcatgcagtcctacagcctcgtaccgctcttgcgggctgcctaaagccccggacgcttatctgtttaacatcggggcgcccacgagtttcacctatgcacctgactgccgcatcaagggcccccagcccagccgcccgccaccctcatggacgctgcgattttccgtcgtcttcacctcgcggtcgtagttggagaccgtcaatgcaggctggagatgcagccctccagcgccgctcgctggtcctgaggccgtgatatgaggccccacggcagccacgtggactgctggctgcactcgtcgctgccggttcaggaggccatcctctagcagatctctatggagcgaccagaccctgctggccacttgacccttcagggacaaccagcctgaagctacaccttttctcccttccaagtgctgtccctgttgctccgtggttcagcctaccgccacactgagtacctgcggctggggtttcgtctgtcgaaggctca

SEQ ID NO: 614337 - DNA, 153 bp, Homo sapiens
atgtctgagatgagcagtcttgagaacagactcccaactcatgtacagaaaacttactttcaagtcttcctgacatcaaattttccatgggccagaaccagtgtaggtgacaagaaaatagccttgaaaacccagaccctcatgtcatacatg

SEQ ID NO: 614338 - DNA, 115 bp, Homo sapiens
ccgcacatagaatcatgctgatgagagacagtgtccaagcccaggagaccaccatgagttccagaaaaagtgagagcagagcggccacttttcctgtctcggagatacctcctac

SEQ ID NO: 614339 - DNA, 331 bp, Homo sapiens
aactagagtgttagttaaacaacatatcttgagactcaacaccaaataaatgcagatcatctcattatttgtatatagtatatagatatattgatttacccaatacataattacagttaatttcatctattttgattaatcttttttaaatgtggctactgtgaacatttaaattatgtgtacagcttacaatatatttctactgaacagtacagtttgttagtatagttttgtttgagatggagtctagctctattgttcaggctggagtgtaatggtgtgatcttggctcactgcagtctccgctacccgggttcaagtgattctcctg

SEQ ID NO: 614340 - DNA, 1135 bp, Homo sapiens
aagctcactgcgacgctgcggtcgtggcgtcgcggaggggcaggaggtgtacacgtgaactttgggtcgtagaagtggtggtcctgtaggacatgattcgtggctgaatgtactgagctgggttgagactatgcttcaaggaggatatgataagacgtgcaggagagtggaacggtatctgtgatttgtgtatacctaacattcactagtactcgagtacgctctccattgcggggttcactcttacttgggaaatcataaatccacagcgaggcgcatggtcgccatagacggaaggcattcgggagtaaagcaaagatttgactggctgcgcggccctcgtgggggcctccaaccccctggtatccacccttggtgggcccccccaacaattttggccaattaccgtccatgagattcatcacaagtcgccttcgggtgaacccccctgtggtggcccgcgttccaatttttcacggggccgccaaggacccccaatgccattggtttgcacggcccatgtgcacccaggttggagacgtttcacagggtacccatggcaagttctgggaccccccaagaaagtgaacaggcgaacacattgcggccatccaacggcgcgtttttcaacgggccgacaggggtgggagaccacccagaaccgcaatagggaggggcgattggtataggccacctagaacaaggtttggccaccaatccacccattgggactcggggacggaccaaagattccagaggacgtaagcagagggtctttaacagtgtggccttaaccaggttggggggacactcctaaattgcaaccacaagaagggccccgggagtgacagtataccgcaggggcataaagccagggcaaccctttacaccatgggggaacctttggggctttgggcaaagccaaggcacacaatttagcccccccgagggaggccaaaggtaggccaccaacggcacttaggcggggggcacccacgtaggcgttaggatagcactagtgatagccccttgtgggcacccaggaagacacccactgaagtatccatattccagaagaaccagtcggccagttggattaacccaatgggcaggcacatcaccatatcattaccaa

SEQ ID NO: 614341 - DNA, 126 bp, Homo sapiens
cagaagcagaaaattaaaaggagccgtgctgtaacacaaaaaaattgtctgtccactaaacaattattcaatgtgagaagggagaaaaatcctctgtttccacttgtctccactaactttccccca

SEQ ID NO: 614342 - DNA, 219 bp, Homo sapiens
  misc_feature (29)..(29): n is a, c, g, or t
  misc_feature (145)..(145): n is a, c, g, or t
gagacaggatcttactctgttacccaggnaggcatgcagtggcacaatcatggctcactgcagccctgacctccggtgctcctttcatctcagtcttgtgccacacccaactaattttttgtagaggtgggattttgccatgttncccaggctggtctccaactcctggggctcaagcagtctccctaccatgggactaccaaagtgggtgggatgcac

SEQ ID NO: 614343 - DNA, 1275 bp, Homo sapiens
gtcgcgtgcggcttaggtgttgtgttgtggtggtggtcgcgctattgtgtggtgtcccgtcgtgtgtgcggtgcgtgtagtgttgggagtgtgtggaggttgtgtggtcgtgtgtggtggtgcgtgtggtgggtagtggtgtgtgtcggtgtgtccgtctctgtgttgggagttgggtgacgttagatgttgttttgtgtgtgtggctgtttcccagagggacagtggtgtgcgtttacagtgtagtttgtgtgtggttgtttgtgtggatggtgccctttgtgtgttgtgactcctgctttgttgtgtgtggtgtcgtgtggtggtggtttttgttgtttgctcgtcttcttttttatgtcctgtcgtgtgttgttgggtctcttgttgttgtgtcctgtgttgctttttttttgtgtgtttgatttgtgtgccgcatgtgttgctgtgggggtattgtgttgcgtgtttggtgtggtgggttggttgttcttgtgtattaggtgtcctacttggtgggtggcctctgtggtttgtggtctgtgtattggtgtttgtaggtgtggttgtgtgtgggtcgctgtgtattgtcgtttcttgggggggtggtgcctgtgtaggtgcgcccggtgtgttttgggatggtggtccgcggtgaggtggtagggttgtttgtggtgtataggtgggtgtcgttttggggttatgtgcctcttgcgggttggcgggggtcttccgctggtgtagtttgttcgttttcgtcgtttgttggtttttcgtcatgttgtgggagttgggctgggctaggctcttgttgtggtggcttgggccatgtggtcatgttgctttattcatcgtgtgggatgctgttttgatggtgtttgtgagtgcgcactggtgtggtggttgttatgcatgtctgtttgtatctcgtcgagaggagctaggtgggtatcctgcgtctggagcggaagtgtggtgtgtgagtcgcgccgtgtctgttgtgctgccagtgatgagtgatgaagagagctgtgtgagtatttgctcaagccctctgtccacggttgtggacagcgttctcacacgcgagtaagtagcacgctgacacacgtttctgtcgcctggttccttttatggggaaagaggcagtagaaagttcgtgggaacatatacagtgttagcccttttctatgccatttattttgtaaaatatcgctattgtacagttattttattataccatatttttagaaactaaatgaaatataaaat

SEQ ID NO: 614344 - DNA, 1644 bp, Homo sapiens
  misc_feature (102)..(102): n is a, c, g, or t
  misc_feature (117)..(117): n is a, c, g, or t
gggggaggcgcccagcgagccagagtgtggctggtcccgcgcgaaaattctgagctgtacacctctaggaaatgaaacactagttcagaagaagctgtaaantctcttacaaataanttggttattcaccatgaggttagcaaagcctaaagcgggtatttctcggagctcaagccaaggaaaggcctatgcagcacaccacagcgccacacacaccaggcccggccagctggccagcaagttggggccatgcactcattctgcattctgcactccaagcttcaagtcagcactccagcacagcaagcttgcgcatgcacaacacccctcataacacatgtccctagccacatgtcgcacacagcaggtttcccaggtccagcaggttccaaaatactctatatacaacaacacaacacagcacagcatcccatcacctgcgcacccaggccaaatcgcaccatcacccatcgtcgcctgagttgtaggggcaaacacaggtgacgccatatactccagcagactatcataaaattcatcaaatttcccagccgatcagcacggcattcgcgcattaccgcgcggccgccaaaaaagcgcctaacacacatggtagcatcggcagataagtagggcaagcacaacaagccttctcacaaaaaccagaccagcattcgagaaaaatacgatcagaatataccaacgcgtagccacaggaagcgaaatgacacaatcaactgggcgacaggcaactaagacacgcacacttcaataagcaagatgggtaggcaatagccacgctaggtagggagaccagcggatggtatcacaccaacagcgcacaatggcaaggcattccagcgcaacacagtatcaattaaccacaaacactacccacaggacaggcgaacgagccaccgacaagcacacatgaggagaggccagacaaagacaccgccgtatacgccgaaggagtgagcacagcggccaaacactgtggatggggggcccaccagacatgggatcgcagccacagagcatccaacaggcagagaccgcaccgtcacacagccatgggaccaggggaaccagcggccagcccttgacacgacggctcgacgagttcaacccggacccagcgagcgcacagaacacacaggaagaacaccaccacccggggcgcgagggcacccaaccacagatgacctaaccaggcgggcgggacaaagacatcaaagcaaacatagtaaacacaccaatacgttgggaggccaaacaagcgccgctcgcgtaccacggagacaccgcgggaacacgcaacaaggcatgaggacagggagaccaccaggacacaagcgaatataagagggaggcaccagcagcacgcacagcatacacgcacaacccacttcgagaagagagacaacagatacaaaaagcggtacacacccagatgaccagaggggcaacctcggacgaactaagaaacacaaaccaacgagaagttctatagtacactacacaagacaagccgacacgagacgaccaggcagaccaccagcaacagacgacagacgaaacaagacgccggtgcacaacataccggagcagacgagcaacggagaaaagcaacaaaaagaagag

SEQ ID NO: 614345 - DNA, 455 bp, Homo sapiens
agagcaaacattcttggaagaagcaaaaatataaagagtcttacagaaaaacagaaggtataaaaaagagaacaaattggaaattttagaactgaaaaatacaataacagaaattttaaaaatccattgatggactcaatagcaaaagagatgatagaggagttgatttgaagatagaacaatagaaattatgctttataaacaacagagaataaaataagagcctcagagaactgtggagcaaggttaaaaggtttactatttatgccagagtcccaaatggacagaagaaaaatgccccatagacttcttttttcatttgatgaaatcataggtaaaaacatccaattttggtgaaagacataaacatacaaattcaagaaatggagcaaaccttaaacaggacaaaataaggaaatccactcccagatacatcataatcaaactttaaatct

SEQ ID NO: 614346 - DNA, 853 bp, Homo sapiens
  misc_feature (102)..(102): n is a, c, g, or t
  misc_feature (117)..(117): n is a, c, g, or t
  misc_feature (375)..(375): n is a, c, g, or t
gggggaggcgcccagcgagccagagtgtggctggtcccgcgcgaaaattctgagctgtacacctctaggaaatgaaacactagttcagaagaagctgtaaantctcttacaaataanttggttattcaccatgaggttagcaaagcctaaagcgggtatttctcggagctcaagccaaggaaaggcctatgagaacaagcgcaaaacaggcggcagcggcaagaaagtggggcatgactattcgattgtgactcaaagcttcagtaagactcaagaagaaagtgtggatgaacaaaccctattaatgtactggaatgtggacaaagagtttcagtcagagttcaactcttttttcaaaccagaagatccatatgnaaagaaatcccataaaatgtgctgatgtgtgggaaaagtttctttcagagttctaatctcattcagcatcgaggatccatacgggggaaaagccctacaaatgtgatgagtgtggagaaagtttcaaaagagtcaaatctcattcagcaccagagaattccatactggggaaaaatcccaatcagtgtgatgcagtggggccgggttcagccagagtcccatctttttgcagcattcgaagacccccactgggcggaaaccctaacagtggcgctgaatgtggcaacatgtttcaccagaggacccaactgggggagacatgaaggcgggtcaaaaaaagaccgtaaacacggggacaatcaggggggactcaccctcggaaaggacaggcaaagcacggtcggcgcacataaagtagacagcggactctctcagaaaaaacaaaaaatagctgggggacacaaaattgggcggaaaa

SEQ ID NO: 614347 - DNA, 193 bp, Homo sapiens
  misc_feature (94)..(94): n is a, c, g, or t
  misc_feature (190)..(190): n is a, c, g, or t
cagagctgggccgtgacactggccgctttgatcgccaggcagccagcgaggcctgcttctacaactccgactacgtggcagcccgtgggcctgngcggcactccaggaacaagaagaggagctgctggagagcctggatgtgtacgagctgttcctccacttctccagtctgcatgtgctgcgggcggtngag

SEQ ID NO: 614348 - DNA, 688 bp, Homo sapiens
cttgaaattggaaattaggccaggcgtggtgactcatgcctgtgatcctagcactttgggaggcggaggcgggtggatcacctgaggtcaggagttccagaccagcctggccggcatggtgaaaccctatctttactaaaaatacaaaaattagctgggcatgttggcgcacgcctgtggtcccagctactcgggaagctgaggcaggagaatcatttgaacccaggaggcgggggttgcagtgagccgagatcgcaccactgcactccagcctgggcgacagagtgagactccgtctcaaaaaaaaaaaaaaaaaaaaaaatggaatgaattttttaaattaaaattttacaggattggggtttatattcttttatatttaaaagcaaaatttacttttgtcatatgagactatgttgcagctctaaaccaccttatgctaaatttatcacttatttagctgaactcttttttgttttaacgctctaatatacatgaaagattgggaaaatgttttcttttctttaacgctgggaaactatccggagagttttgagcaatttaatccacgccattaaaatatgacagtggggacctttaaaatggaggaagggcgcatatcaagactatatttaaaacccacattttcctggggaaatagaggctgaggatttctggaacgaggcag

SEQ ID NO: 614349 - DNA, 209 bp, Homo sapiens
cctggaaccagtgaccaaaagtgtgggtgtggaaggttttcaaaaggaatttagctgaaggatggcttatatggactacatttttcttatctctccttataagaatttttgattagatcatttccagcatcctttttgctctaaaatttcatggttttgtgtattacatgtcatccccgactctgctttaaatagaaaagtcagaatta

SEQ ID NO: 614350 - DNA, 151 bp, Homo sapiens
cagaacattaatgagctatcactgtctttatcggttgagtgcggattagatgaactccattagcagagtattgcgttgcacactgcgattacagctaaataacccgaatatgagtgacatgtttgcatttctgacaagtgaaacaggatct

SEQ ID NO: 614351 - DNA, 88 bp, Homo sapiens
cccaggacactcccaggttgggttttttttataggtttggcggggggccacagggaggggaccctgccaataaaaagattggatccca

SEQ ID NO: 614352 - DNA, 220 bp, Homo sapiens
tctacaagggacatggtactaacgggcggacccaggcctccctgcagactccgaagggggccagcactgggaggggcccacccacatgaattttccaatggaccagcccttgagcacccgggcctgggagacagcagagtcccacggatcgccctcaagacacatggaaacccaaggggctctgggttccctggtgcccttctctcccggcttcctccaa

SEQ ID NO: 614353 - DNA, 164 bp, Homo sapiens
agacctgtctcaaaaaaatttttaatttaaatttaaaaaagtaggacagaacagcatagtgtgtgtgtgtatgtgtgtgtgtatgtgttgggggctggggcccaggacgaggggttgtggattacaggaagcctcttttttaaatttaaattaaaaatcttttt

SEQ ID NO: 614354 - DNA, 751 bp, Homo sapiens
cgtcgggctgggtggacggcactagagggagtggagctgagctgatcagtgagataagccagcaagggcggtcgggtcccgaggtcagcctgagatttctcaggtccctccgtgccccctccctggagtccacagtcgcctccggtgtccagaggatcggacacgggtccggcccggacatgagctcgtatgctgagaggtggagtcagtgaatgtgaagtctcagaggttggattctatatcgagggagcggactcacaatgtgaggcagagagaccttgcgtggcacacatttaatgtcccaacagaagtatattacgaactctgatagtctttctcgaagtgaaccagatccttaaagcagtccagtgaccctaagctcgagatccactactgagcatgaagtcgtccgcaggtcccgtgaaccgccattcgttctcgaccgaatacgcccatgagtgcgacttggcatggctcccagcgttatagagacagctgaacggtctggcatgaggtgtgagagaatgcgcttccaagggaacccaaggttgttatgtagactgccgcaagtgggactgctcgaaaatgcagaccagcagcttggttggaccattcattgagcacaagtgacaacgctgacgatcccggctgcttgattcgagacaattgtaacacgtgtcaacaatgttgggtacaggctccttgaattcccagggatagaacgatgtgaaacacacctttgggggtgtac

SEQ ID NO: 614355 - DNA, 157 bp, Homo sapiens
ccaccttgattagccacctacccaggccacttcgaagagcactgcgttctacaggtcgaatacatcctcccagtcctccagtcctggcagtgaggacatggacaaagtgcggtttaaaggcatgaccgacgcaagaaggggaggcaccgggagaatc

SEQ ID NO: 614356 - DNA, 791 bp, Homo sapiens
  misc_feature (267)..(267): n is a, c, g, or t
gtgtaaaaccatgcgtcgggtggacccagtctacatccacttggctgagcgattatggggaccccaaagctaaagtcaacatcctgatgcggaaggagttggatgaacaagttgagaggatgctgggatggaacttcctaagttcccattgtacccatcagaggtagccggtgccagctttgcatggacttgcgacgatgacacctcagggccggacagtgcgagtgagcaagggctggttgatctcagctggaatcatcacgtggntattgcgcacaaacaccatccccgctcaccctctcgttgctactgtggaccggtcgtgtaggccggtcgtacctggctgcggaggtaacctggatcgaaagaatcacatcaatccgccaactgccaatcccgtgatgcatgcaactgaattgtgcccaagactgtcgaagacctattggtctacgagcagccctagaggtgtagatagggacaggtggcgtaacgggacaccacgcttggagaaagggttctgaatgctatggagggactgagtcaaacagagcgatcctcgcgccgcgtacgtttgcgtcttagggaaggaaaaagcaaggcttagcacaggcatgggacccggattgggtcgctatgcgatctactgcgatccaattatggaggggaaagaacgactgcgatatctcggcggtgtacccgagaagggacttcattgtttccccacgacacgtctacacattcccgctggggttagtggacatcgtgtcgcacggtcctcgcaaggtagaacc

SEQ ID NO: 614357 - DNA, 469 bp, Homo sapiens
  misc_feature (51)..(51): n is a, c, g, or t
  misc_feature (123)..(123): n is a, c, g, or t
  misc_feature (129)..(129): n is a, c, g, or t
  misc_feature (152)..(152): n is a, c, g, or t
  misc_feature (156)..(156): n is a, c, g, or t
  misc_feature (167)..(167): n is a, c, g, or t
  misc_feature (209)..(209): n is a, c, g, or t
  misc_feature (216)..(216): n is a, c, g, or t
  misc_feature (226)..(226): n is a, c, g, or t
  misc_feature (234)..(234): n is a, c, g, or t
  misc_feature (258)..(258): n is a, c, g, or t
  misc_feature (319)..(319): n is a, c, g, or t
  misc_feature (335)..(335): n is a, c, g, or t
  misc_feature (384)..(384): n is a, c, g, or t
  misc_feature (429)..(429): n is a, c, g, or t
  misc_feature (452)..(452): n is a, c, g, or t
  misc_feature (455)..(455): n is a, c, g, or t
  misc_feature (458)..(458): n is a, c, g, or t
ccaccaaacctccccagggcaacccttgccaccccccaaataggccgtagnccaatcccctgccctttgcacagggccttagctgtagaccaaaaagggcaggaggggtttgctggcataacnccccanaaccaagggaaatggatgggccnctgntcagttttccnccatcctcaggttctggcctcatcccctcctagaatgagtcncccgtanatcagggttnggggaaanggctgatccctggcgctgcccggntccctcgctgccctttggagctcagggcagcccggaatagggcttttttaaaaggaagtanaagccccagggtaatnaggcaaagacccctcctggcagtggttaggtgggggcatgccccctccnttttgtaccgtgtgtgctggctccatagtttttttttttggacanataagcatgcttgttttgaaatnaanaanatttgaagtga

SEQ ID NO: 614358 - DNA, 167 bp, Homo sapiens
gtcgatctcttacaggatccccgcgttcctggacttgggtggccgtgacctcacggatctacctcatgaagatcctcacagagagaggctattcctttgtgaccactgccttaaagagaaattgtgcgagacatcgaggagaagctgtgcggccggtggtaccagag

SEQ ID NO: 614359 - DNA, 160 bp, Homo sapiens
  misc_feature (139)..(139): n is a, c, g, or t
caggtctgggggctgagttgcattcaaagactcaaggagtgaatcgtacacatcaatcatggggttggcttggccgccaccctgctggaacactaccctgggccttctaacctcatggagagcctgacaggcctgcacnagactgagcaagcagggggat

SEQ ID NO: 614360 - DNA, 141 bp, Homo sapiens
acttgctggtgtcccataggtgtctgaggcttgttcatttttattcatcactattgttatatctcttttattagttctggaagctgaaagtacaacaggaaggtgttggcagggttggttccttctgacagctgtaaggca

SEQ ID NO: 614361 - DNA, 266 bp, Homo sapiens
aacttcgaggatccccgacgagttgtccgagttagggtgctactgcctatcagattgacttgtagatctgggcctaatggccctcgaaacagtgacaggtagtgccagcttgtaagtgaaaatgtgatccattctttcctaaactctactttgttgaacgcccagcgaatggtgggggctgacgtggactgaaatgaggtacccctcaaggaattcactatcactgcgatcttggtctcagtcatagtgaatctatgctacaaaga

SEQ ID NO: 614362 - DNA, 112 bp, Homo sapiens
gcctgaccagcatcagatttacactgcatggtcattaccattgagtccccaaacactagagaaagacattatttctttctatataaacttaattacgcagagattatcaacg

SEQ ID NO: 614363 - DNA, 131 bp, Homo sapiens
acagaggaggacagaggagtacacaatgctgtggtacactggctcacagaggagggggggggaatgtatcataagcggggagggggcttcgcggaggtgaccggttgagtaggggtcctcctctgtgctgt

SEQ ID NO: 614364 - DNA, 727 bp, Homo sapiens
gtgcagcgggggggcccggggtgccctggtggccctggtgattgggaaccgcggtggcgtccgcggagtgtttcggcagtggcatccggggccgtgggtcgctggcctgtggacggggccggggccgaggccgcggagctcgcgtgagtgcaaggccgaggataagtgagtggatgcccgtcaccaagttggtgcctgcttggtcaaggacatgaatgatcaagtccctggaggagatctatcttcttctcgcctgcccattaaggaatcagagatcattgatttcattcctgggggcctctctcacaggatagaggtatttggagagattaatagcgcagtgcaggaagcagaccctgtgccggtccagtctgcatccatgtgttcaaggcattttgtttgctaatctgtgaggtacttacaataggcacacgtcggtactaggagtgttaaaagtgctccaatggaggtggccacctgcataccgtggtggccatcatcctggccaagctctccatcgtccccgtgcgcagaggctacttggttgtgaacaagatcggcaagccccacactgtcccttgcaaggtgacaggccgatgcggctctgtgctggtacgcctcatccctgcacccaggtgcacttggaatcgtctctgactgtgcttagacgctgccatgatggctggtatcgatgattgtaacctcagccgggttgaatgccacctgg

SEQ ID NO: 614365 - DNA, 724 bp, Homo sapiens
  misc_feature (194)..(194): n is a, c, g, or t
  misc_feature (724)..(724): n is a, c, g, or t
ggcgacttgcccagaccctacaaaaaattggaaattttcaaaaaaaaaaaaaaaaagggaaaaggagggaaaagaaaaaaggaatttggcccttctgcccaaagaatttgaaaagagtggtctttcaatgtgaaattccaggctttgaaccttagttccctttcaagaattgagttaagaacttctccacaagncttaaacttattgttgtcaacaggaagagggttggaacacgaaggacacagtctcaagcaagcaattcttattctcgagaaaaagggggagatatataccagggggaacacacaatatgtcagagacacacacacacacacacacactttgtgtgtcgcccccagtttgtgcgacacaaaatatattatgcaacagtgtgttttgaaaattatatccccctatgtgccaactgtcttgttttgtgcgcacaaaggaagacacaactcatccaggcgcatctattacgtcgtgacacttgttgaacccgccacacaaggggtcttgtggggaaagcacttttttgttatctcctcccaacaccgcccctgttagaacaacagagcgttcttatgcggcggaattttcctctccactataaacgtgttgtttcgtggcgccacaacggccccagagagaagcgctctatatttacacacaaaagcggcttttttttccaacccctgttgcgggagaaaaacgtggtggcgan

SEQ ID NO: 614366 - DNA, 239 bp, Homo sapiens
tcttgaggatccactgcttacttacagtgtgatcattccaatcatcacaaccgcatctgagtctgtttctgatacttgatctgtctgtttaaacagtgtttctgtctgatatgcattgtgatgttgtgttgaaagccagatataatataccaaagttaaaatgaacagaggtaattaggcctttattatgaagttatgtttatctggctaagagttatgctctatttactgattgctat

SEQ ID NO: 614367 - DNA, 232 bp, Homo sapiens
acacctgacagaccttgcgattcggagcaaggcttcatcactgaagatctcaaatgctgtatctggtggagatgccgggcaattgtggcaccagggacccacatgtcccatgctcactgctgctggacaactcggctcctgtggattagacaagttcagacgcagatgaagggctgtgaggtcacggtggcaactataatgataggactttgatcgggaaacagacccctgg

SEQ ID NO: 614368 - DNA, 623 bp, Homo sapiens
agacagcaacgtgtcggatccgcaggcgcagccgtgcgatgtttgtcctctacagccatgtattacggctgctggcagagacttggggatggaacccgcacagagccgcgggccctttgcagctgcgatttacgccctagcttttcaacggagggtactatactggcaattgctggagaagattttgcaatcgttgccttctgattactcgattgagctgaagggttaccaagttcatacgcgggatagccccaaatgttacaaattaacagacaaaacagtcattggcctgcagcggttcccagtggagacttgtccttacgctgacaaagattcatggaagcaagactaaagatgtataagcattccaataataaggccatgactacggcgggccatggctggcaatgctgtctacaatcctgtatccaaggcgcttctttccatacctatgtttacaacatcatcggtggacttgattgaagacgcaacagggggctgtatccagctttgcacacacgtagggtctaaccagagagactccttcacggatgggaggtcagcatgtgcatgtacagacctgttgacaaccagggtcgtttaagaactgcacgatggcgagg

SEQ ID NO: 614369 - DNA, 207 bp, Homo sapiens
ggagagagcttgcctgaagaaatggagaacacttgtacagaaagggtcagcaaacacagcacactctgagccacgtgcacttcattcttccatgcattagccagtcaaatcaagattcaaaagcatcacagttcatacttaatctcatttaaagcacagtcacagcaggagcccaggcagtgtgtttcagcagacaagtttttccat

SEQ ID NO: 614370 - DNA, 169 bp, Homo sapiens
cagaaatactccagtgtcctctcttgctatctactacctccttcaattgattattcaggcccacaacctttctctacacttcaattctggaaggatttgcccccacccaggactggcaaattagctttactcaacatgccccgagtcacaaaaactaagatacctctaa

SEQ ID NO: 614371 - DNA, 115 bp, Homo sapiens
cctgggccgtgtctgcgagatagctgcgatagatgatgcgcgacaggcggtccttcttttctgcagaggggaggccaggcgggtagtccacggcgccggtctcgatgcgcgccag

SEQ ID NO: 614372 - DNA, 428 bp, Homo sapiens
  misc_feature (354)..(354): n is a, c, g, or t
cacgaggggtttccaggtgcagtattcgggcgatgccggcgaggttgatgccctggccgaccaattcgctgatccgcttgaggcgctcgagatcgtcgtcgctgtagcgacgggtgccgccgtcggtgcgcgacggcgtcagcagtccccgtcgttcgtacagccgcagcgtttgcggcggggtggcggacagctcggcggccaccgaaatgccgtagacgccgcgcgcggatcgagcggtcgcatcgccggtcaactggtttctccctgtcgaaatgacccggtattcctggctcggaaagaatacctgcgcaggtggcacaaaatctatgtcaactgaagcacatcaatggncagcccaccgaccggccgatcccgctggatgcaaatgcgtgccgctgacccgggtcggcccgccgagggcagcc

SEQ ID NO: 614373 - DNA, 255 bp, Homo sapiens
gacgcatccctaaccagctccaacccctgtgttggctccatcatcaactcaaactatgctaccagacccggttccgtcacctctcccgaggccgggttctacgcagacactgtgccttgccccaggtttaggaccccctcttggagggctcttctccattctcagacactctctttgggaacggggaacccccagggaccctttccaactcagacattgtcattaactccagcatcatcccttgttagggatgct

SEQ ID NO: 614374 - DNA, 164 bp, Homo sapiens
gtttttaaaacccccccttttgtaaaggagcttgggagccccatggctgctcccttccccctggggaacagtgtagtatcctgtgaaaaaataaatgtattcctttatgtgtttttccaaagccttttgggatgtggggaaattaatttcccttaagccgttta

SEQ ID NO: 614375 - DNA, 103 bp, Homo sapiens
tacagtatcagatgttgtactcagagtcttgtttccagaatatatacgaatcctacaactaattctacaaccctataaaaattaccaaaataggaagatgggt

SEQ ID NO: 614376 - DNA, 374 bp, Homo sapiens
tttttctgttttctttttaagacggagtaccattctgtcgcccaggccagagtgcagtagcgtgatcttggctcactgcaacctccgcctcccaagttcaagcaattctcttgcctcagcctcccgagtagctgggatgacaggcatgcaccaccgcgcccggctaacttctttgtatttttagtagagacagggcttcatcatgttggccaggatggtctcaaactcctgtcctcaggtgatccgtccgccttggcctcccaaagtgctgggattacaggcatgagccaccacgcccggctatgcccttttccatcttaggaacgttatgctatcacttatcgtcgacgcggccgcaatttagtagtagtagg

SEQ ID NO: 614377 - DNA, 138 bp, Homo sapiens
tccccggcttactacctcccactctattcaaagttatctctctgctcactgagatagatacatatctgattgcctcctttggaaaggctaatcagaaactcaaaagaatgcaactgtttgtgtctcacctatctgtga

SEQ ID NO: 614378 - DNA, 375 bp, Homo sapiens
ccaaaatcacacacacacattgatgtccccatagctttccataatactaaataattttggtaaatgaacattattgtgactatttacataagtttatatatgtaaagctgtagcaagcacttacatgttagttctttatttgtgtaatgctcttcataggtcagcctgggcaacagagcaaatccgtctcagaacacaaaacaaaacaaaacacaaaaacaaaaatcagccggatgtggtggcgcacacctgtaatccactcgggtggctgaggcaggagaatctcttaagcccaggaggcggaggctgcagtgagccaagatggcgccactgcactccagcctgggcaacagagtgagactctgtgtcaaaaaa

SEQ ID NO: 614379 - DNA, 250 bp, Homo sapiens
atctccaggatcttatccccggttctgggtactccgccgccgtataggggtagtggctgctcactctatctgagattccagtactctttagagtttcttttactcttataataccctatatggttaataagtctgtatgttgtatttaatctttccctagttctatattaaccatctatatttcttgtttccttggtttggagcctgtatgaatacaactaaggaattaggaaaactaaataatggtatt

SEQ ID NO: 614380 - DNA, 482 bp, Homo sapiens
  misc_feature (5)..(5): n is a, c, g, or t
  misc_feature (482)..(482): n is a, c, g, or t
actgngaaggttcctttgatttcacctagattcacctactctaactccctctaactgactgggggaaatgaaatgataaggtctgtagtaaactaaatggtattcacaattaacaaaataaaaccccagggaaaagctccaacacctccactattaaattgggatttgctatgaaataaatattataaacaaagaacaaaagctaacaatacaaaaaaactaggtcctttaaagaaacaagaaaaatcaagtggaaagacaagagcacatctatatagacttcaaaacatgaaataatgtttacactaaatgaactaacatctcattttggtggacctaagagaactattctaattccctaagtattacaaatccatggcacaacaaataactggtcattaacacaagctcttgttctctccatgggaaataatagctctacattttatttttggaaaaacagtaacaagtctggaaataan

SEQ ID NO: 614381 - DNA, 113 bp, Homo sapiens
ctcggtacctatcgaagcggtgtcacggtccagcaccttgtccttggtgttgtccatcatgtagcgatagttgacttctcaccgtttggattgagcactgggacgaggtaggt

SEQ ID NO: 614382 - DNA, 142 bp, Homo sapiens
caaaggcctgggggacccctggttttgggccgggcctggggctccaaaattccaaggcccaacctttcggggggggggggggtttccaaaattggttgtaaaaactttgcattttgttttttttaaccccacccgcccccca

SEQ ID NO: 614383 - DNA, 178 bp, Homo sapiens
tgagaagcatctgaggtggacagtgcagaaggtcttttctggaaaactcttaaaatgtactgtgatgtccaaggaagagctgaacttgatgcaagaagatcagatagcaaaccaattggataatgccatttcagtggtgtgccttcatattcaaaccataactcaggatgcttcttga

SEQ ID NO: 614384 - DNA, 806 bp, Homo sapiens
tggcctgcatccactgtctggcactccctagtgagatgaacccggtacctcagatggaaatgcagaaatcacccgtcttctgcgtcgctcacgctgggagctgtagaccggagctgttcctattcggccatctgggtctggattcggcattacatgtcttaacggaaaaatcaactcaagatggattaaggacttaaacctaagacttgaaactataaaaattctagaagataacatggaaaaacccttctagacatgacttagataagtatttcatgaccaagaacccaaaagcaaatgcaataaaagcaaagataaataactaggacctaactgaactaagagctttgtgcgcaaaaagaacagtcagcagagtaaacagacaacctacagagtgggagaaaatcttcacaatctatacatctgacaaaggactaatattcagaatccaaacaaacacaaatcagtgaaaaaatcctatcaaaaaagtgggctaacggacctccatagaccattctcaaacagaagatatccaacgtccataacatgcaaaaaatgctccaccatcactaatgatcaggcaaatgcaattcaaaaccacaagtgatattactttggtcctggcagattggcataatcaccacattgaaaccggcgatgtggcgtggtggggtgacagcgaccctctacctgcgggggattgtatagtcccgcacgggcaagggggcatcctaaaagacagtcatcccttgtccaccctatggttaccaggaagctttaaacatacgcccttatcaccccgaccg

SEQ ID NO: 614385 - DNA, 709 bp, Homo sapiens
tttccactaatgaaccgttcttcttattcaacgtccccgcacgattatgattctcgataaggagggagtaatcccctcgtccctagagccatttgtttggagaaagtcctctaatcgctgccgccgcatgtgtactcttggaatgactcctctgcgtcacccgtgcatatccggtcttccttttggtctactctccttacacttcggcaacgcggcttaacagaatgtgtgtgctgtcctcattctattgacaacattccacaatgtctaaaggtgttgttatgatcatcatgctctcttaaaccatacgtgtttcctaacgcatacgctagccgtgtgcttcgcagtacactcgcactctctcgcgtatctcttgctctcgaacaccaatctaatccacggttatacccactcatctctctcttcacgctctaaatcttatctcaccacacgctctccattttactcaatcttccaccacatactaccaacaatctctgtacagtgaaaccaacagcttgctcgaagcgccctcctccaactcatcattgaattgctacccttactgagattctccacacacacactccactatacacctctcgctacttttagatgacacaacagaatccttcctcaacataaaattaatataacataaaataaaacaaaaacaaaaaataaaaaatataatcaatataccacaaaa

SEQ ID NO: 614386 - DNA, 143 bp, Homo sapiens
cccgcgggcggggaccaggattgacagattgatatctccttgtctcgaattccgtgaggtcgtggtgcattgccgattcttagttgtgtggagctgactttgttctggttaagttctcgaataagcgatatcgcacgactctg

SEQ ID NO: 614387 - DNA, 804 bp, Homo sapiens
cacagcggcttgcacctgtaattccagcgctttgggaggccaaggcaagaggatcagcagtccaggagtttgagaccagcctaagcaacatagttagactttgtctctatttaaaaaaaaaaaaaatgtggttgggtgcggtggctcatcccagtgcccgtcattccagcacttggggaggtcaaggcgggcagatcacttgaggtcaggagttcgaaaccagctgtggccaacatggtgaaaccccatctccacaaaaaatacaaatattacctgggcatggtggcatgcacctgtaatcccagccactggggaaactgagcgcaggagaatcgctgtgagccaggaggcagaggttgcagttgagccaagatcatgccactgcactccagccagggcgaaagagcaacactctgtttcaaaacataattaacttacttaactttaacctaaattacacaactaaaaattttttttaaaaagcatagaccaggccgggcgcggggcctcacgcctgtaatcccagcactttggaggccgaggcgggtggatcattggagatcaggagcttcgagaccatccctggccaacaccggtgaaagccccatctcttactaaaaattccaaaaaattagctgggcatggcctgtgggaaccttgtagtcccaactacatgggaggctgaggcaggagaatgggccgacccggaggccaaaccttggagtgagccagaacatgccattgactccagctcgggagaaagaaagttcctttcaaaaaaatcaaaaacaacaaaaatttggc

SEQ ID NO: 614388 - DNA, 1016 bp, Homo sapiens
gctgtcatttgtgccaggcaatgactttgagatgtccaaacacccaggctgctgctcatcctgggcaagctgatcctgctgcaccacaagcacccagaacggaagcaggcaccactaacttatgagaaggaggaggacacaggaccaaggggtgagctgcaacaaccagtggagtggtggtgcgcgactgcttggagcatgctccgggaaaacaccttggattacactcgccaacatctcgccggcactctggacctatctccataccccgcgcgcatttgcctgcctgtcctggacggactccatacactgggccagttctgcccttcagctgacgccccggaccccttctcccaccctgggcccccactgccgctcctttccccgcacgaagcactggctccttgcgaacaccctcagccacaacctcagccatccaggacaacaactgtggacctgacttctggccccaccccccttcagccgcctggcgaacgttcgtcactagcactatggtgcgcttcctcagtgaccgaaagcaaccccggttgtgcccgggagattggccttgtggctactgcctgcccaacgctgtgtctcagtgcggacatccctggcacgctctttgccacttgcacgcgcaccaacggcgcacgcatcagcggaacctccctgccgcttcctacgaggacagcccttgacccgcacacaagttgccagccagaaggccacgcccacgcatcctcacatcgcagaaccgaccccttagaacccactcagtgtggcaccctgatgcaggccggctgcccgcgagatgcatgcccttggcacaaacggtgaggacgaagcaaccacatccgaacgatcacatctggaacgcaaatcacccgtgcatagaccactctaccgtctaaaccctggcatgaagccaatgacatacccaagatcacactcagactatcctgccttcggaaacagaccacctaccaccagccgtagcaaacctccaccccacc

SEQ ID NO: 614389 - DNA, 226 bp, Homo sapiens
ccctgcctatcatcggcaccccagcttcttccacgttacgcggtccaacattgggctggcagcagtcaccaagcagaatgtcaacgctgccagggtcttcgaattctgtgggtagccaaagtctagaatctcatccagcagctcatatatgagcacaaagtggttcttgatgttttcctcgctgatcgtgccaaagtaggcagccatcacgtcacacatcttatag

SEQ ID NO: 614390 - DNA, 183 bp, Homo sapiens
aggtggtgtgatggggttgaggagaggtggtgtgatggggttgaagagaggtggtgtggtggggttgaggtggtgtgacggggttgaggagaggtggtgtgatggggttgaagagaggtggtgtgatggggttgaagagaggtggtgtgatggggttgaggtggtgtgatggggttgagggtc

SEQ ID NO: 614391 - DNA, 774 bp, Homo sapiens
  misc_feature (266)..(266): n is a, c, g, or t
tcaatgaaaagcttagtaagtttttcctttaaaattaaaaaagcttgttcatcaaaaaacatgtcaaaatccaagcccttgtcaaaatacaacccccaagcggggggacgatgatgaaaaatgttctttcctcaacaaaaaaaaagaactctttttataatcccctccaaattaatgaacaaatgcaatagaaaaccacccatttcttagaagaggaaacccaaatgggtaataatcacaaaaaacatgttcagctccactaatcnggggaattcaatttaaaacaataatgacctattccatacctatcagactgacaatatttttaatgtataatgttaatgagtggcatgataggaacctagtgcactgttgctgagaacaacacagtggagaggaattaagcaatatctagcagagttgaagacgcatataccctatgacccaacaaatctacttgtaagtattatagaaacttgcaggccaggcgcagtggctcacacctgtaatcccagcactttgggaggccgaggcaagcggatcacctgaggtcagaagttcgagaccagcctggccaacatgtagtaaaaccccatgtctactaaaaaaaaaaaatacaaaaattagccaggtgtggtggtgcacgcctgcagtccagctacttgggaagctgaggcaggagaattgcttgaacccaggaggcagacgttgcagtgagccgagatcgcaccagtacactccagcctgggtgacagagcaagactctgtctctca

SEQ ID NO: 614392 - DNA, 388 bp, Homo sapiens
taaggatccttggggctccagtcagggacacactaccttcatattggtcaggggggtggagtagccgggtgccgggaaaggccaggctgcacgaagggcaggggcgggagagggtacatcaaagacggcgtcaccctgctcctcacagggggtctccggcagggggaccaccactctgggggtgagggcacgggcctccagttcggtggagaagaccacagcatcctccacctggaccgggtaaatgccagagtcctcaggcctcaggtctggagtcgggaactcatagcgcttccccagccggcgcagacggggctgggttgggtggtcgaagccataggggatcatctcaccatccttatacaggtaaatctggctctgagaatcc

SEQ ID NO: 614393 - DNA, 1108 bp, Homo sapiens
gattttaatgaagctatgctaacctaagatattgctagaagctttcccagcctcgtagcccagcacgttctcaaacttggaaagtgcactgcgaagtcacccggggcttcgtgattaaaatgcagagttctgactcagcaggtctgagtgggtccaggattcgtgtggtttctcacatgttcctgggtgatgctgatggggtcagtctattgaaccactagcgtggaggcaaccaggttctaggacgtttctcaagtattctagtacgtttctgaagcattctggaatcgctccccacattctagaattctcccgaaggattattttgttcttgagacagaggtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaattattagtatttttagtagagatggggtttcaccatattggccaggctggtcttgaactcctgacttcaggtgacccacccgcctcggactctcaaaatgctgggattacaggtgtgagccaccgtgcctggccaattccaacattcttaaattctctcatccctccaagggtccccgtgctatgtactctttagcacattccacctcttactcttgctcaggcctgcaccactgcagccagcgttcatatattcattcattaaacaactgaagcactcactctgtagctgaggtccgggaacaggtgaggggggtcaagaaccacgcaccagcccctggccgtcaagtgaactggccaggtcaagcaccaaggacgggaacgacgatgtgcgacccagaggcttcaaaggcagaaaccagagacaatggaggagccaggagtacagcagagtgcacagggacagcgggccactaagagacccacaggaccacaagccgggggaaggggtcccgcggacacggacaggatcccaacgagaagacacaaagcagaagagacaataacacacacacgaggacggacagagcaaggttgtgagacagccgatcgttgggaaggagcaa

SEQ ID NO: 614394 - DNA, 877 bp, Homo sapiens
agcggactttcgccggggctgctcagtgcgtccgggtcagctgctgccggcgatgccgtaccgctgcggccgggggtattgggccgggtgtctccatcgccgatcgcaggaggagcagcggctccgcgtcggtccatgctttttgcagacctggtcagtctagctccgcacgatctgccggccgtggtagggtgcgaatgaggactgatgggggccatggcgttcctcctgggtgggacatttggctcccgtgaattatcacggagttctgtacgttgagcattggaatccaaggctagtaggctgcgcacaggtgctggacacttttacagacatgaactgggcaaagatgaccagattttccagtatacctgttatgcgagaagaatgcataggtagttgcaagcagagttagtactagcgtaatagaactgggactaagagggaccatgtccttggcttgactatagagcttacttgtgaagataattgggacgaagatgaagactatatggactactaggagatttatggctgagcacttgtgagtacctagtgaatggggatcatagtaatttgtcaggatgaatttggcataggtgatgtggcgggagaatttgccattatgatgggatttaggacgaaatccggtccagaaggaataaggtcactgagtgtccggaggtgggaaagactgaatcatgcccaagaacccaatgggactaacgtgaacgtcactttgagggaaagccggcatcgaatgtacgtggacatacgaccagcagcaaagggaacacaagagggactgtccggacgccatggccgtaatgtccccgcggattgcacggacagggaccacagggggaagaaaatgaca

SEQ ID NO: 614395 - DNA, 621 bp, Homo sapiens
gctgcgcgccgcctctcactcacagcctcccttccttctattctccctccgactcccgagcaccagcgcgctctgagctgaccccaggatccctcccccgaacgccagcagcccatatggagggaggaagtaaggggaagcggagcaggcacaggggagccgagaccgagtacccagcacagaagccggtgcaatgggtacgtggtgcacagaagacaaacagacacaaaaaacaaaacaagaaaaaacaaaacaaaaacaagacaaaagaaagacacaaaaaacaaaaaaaaaagaaacaaaagaaaagaccaacaaaacaaaaaagaaaagaaaaaagagaatcaaagaaaaaacacaaaaaaaaagaaaagaaaaaacaaaaaacaacagaaaaaaaaaaaaaagaaaaaaaacaaaaagaaaaacaaaaaaaaaaaaaaaaacagaaaagaaaacaaaaagcaaaagcacaagaagaaacacaaaagaagacaaaagacagcaagaaaaagaaaagaaagatgacggaagagagagaaacaaaaacaaaacaacagaagagaaagaagaaaaagacagagaaaaaaacaaaaaaaagacgaaaaaatagaagaagag

SEQ ID NO: 614396 - DNA, 344 bp, Homo sapiens
  misc_feature (4)..(4): n is a, c, g, or t
gganatctagaggcccagcgggtttgcacatggcagctgccttgctcagatgcaggaaactgtgagttcctttctcaccataatgttctcttggctgattctggcggggccccccactgtgtgtggctgaccctgatagctgtcctgtttcaatttttttccctaaattattcctgactcaagggcagggcagagacctactgcctagacctgagcccaggtctgggctgctatctagtacaagcagatggtgagaggcagagagagcacagggcagctagagagagtgctagaggaaaggagggtgagggcatgcttcttctttgataggttttctgaagact

SEQ ID NO: 614397 - DNA, 390 bp, Homo sapiens
ataaggacacgtggactcgattccaaattcatagcagtaacctgggcgacagtcggtaccagaagaaaaactaggaggttgattggtttgtttttgagatggggtctcgccctgtcacccaggctggagtgcagtggtacaatcacagctcacagcagcctcgacctgctggactgaagcgatcaccccacctccacctcccgagtagctgggactacacgaatccaccagcatgcctggctaattttttaaaattttttggtagacacgaggtcttgctatgtactccagccgggtctccagctcctagccccaagcgatcctcctgctgtggcctcccaaagtgttgggattatgatttgtgcatttataaagatgagaggtcagatt

SEQ ID NO: 614398 - DNA, 844 bp, Homo sapiens
ggcatatatggattctagacacaagaaagctcctttcaatatatttgaaagagacactaatattttggatggtgcatcattaaggttttcatcacagagaaattaaaatgcaggagtgcagtggtgtgatctgtggctcactgcaacctccgcctcccggattcaagcgattctcctgccttagccttccgagtgactggaattacaggcgtgccgccgccatgcctggtaattttgtatttagtagagatggggtttcacccgtgttggccagatctgtctcgaattcctgacttcaggggtctcactctgtcctgacttcaggtgatccacctgcctcggcccccaaatcaaggaagcacttcattggcttctctggcatatctaactggccagcatcactaactctgtgcttgggggccattcttaagtaaaataagcattactgtgaaaagcaaacaaaaaatgacattcacacacacacggaaactttaaaaaacaaacaaaaaagaacgagaaataaggccttactttaacaccaggcccttcgataaggacgaccaaagggcttgattcttgacaaagaagacgctactaagtgactaacagggtgcttcgtgccgacagtgttggttccctgggataaagagataattcactttctggatacaggagcaagaggggtgacattcatcatgccacttccaaatgggttgcggttaacacctacgaggttttattctggacacttcgggtccggttcacaatacgtggccccggttgaacccgcagaaactcggttcgggcctctctttccccctttactgggcatcaccgggccgcc

SEQ ID NO: 614399 - DNA, 139 bp, Homo sapiens
  misc_feature (14)..(14): n is a, c, g, or t
ccctgctacgctgncccgaaggcgccgggcatgtaggcaaagctgaagtccagcagagcatcttgtcccagtctcactcgaggagcaggcgtgtggatcacgacagtcagtaccactgccacagtgggcctgatcacag

SEQ ID NO: 614400 - DNA, 1435 bp, Homo sapiens
  misc_feature (890)..(891): n is a, c, g, or t
aggaatgctattttctttccgttgtcgcttaaaacacacaccctcatatgatctatggtgtcgtcccccattgaagagatgttcattatcccaatactgtcgcccgtctgtggttcaacaactaggaaaaatggttgttgtataacccgtttttgtagagcatccgtatatatagtgataaacaatacaatggggtgtccccccttataaatggcatgtgggtggaacaaccactgtcgctgggtttatttggacccccccgcttcccgacatacatggccccgccaaataattggcggccactgtgtcgttcgataaaatagttagtatccgtgtccccataagggaggtgccccccccctttgtggtgtcaaacatcttgtggtggggcccctattctgtgcattagcgtcttttcgtctttttactatactactttgtttcgtaataacagggagcgggagggggaacaggacattttgcgtggagtagcaatagttgaacgcgccctccgcttatgcgttatattttggtgcgaagttttgtgggctgtttctcttcatgcgggggaaaaaataggcgcccacaatatttcgctggagatgtttccccggataaacggcgctttgaacaacgggactgcccctttctcgcaaatagctccttactatggtagaagaagtgtggcataaatgggtctccccccgcccatattacggttaggggggccttctcccctatggtaccccctcacacaatcgccgtgtagacccgggtcgtcacacattcggggacaatgtatggtaacatatagatagatatgtacttgttggccttttcgaatggtctcgcacggcaaaacgtaacgagaaagccttatacacccttgnngggctctttggtgttaaagagttctctgtgacagacacgcctggtccgccaaggggaggcccgataggtgatccctcccctggtgtgtctttgttgattattacgcccttgctttctccctacggcgttcacctccgcctactgtgaatctggctagacctcagagtgcaccaagtaaacgtgctagttgacagcgtatgatgactaggtggtttctaagacacaggggacacctgcacacgaccgtgcggtgaatggatgggtccatcccaggcactaagtatcttgcccgccttgttctgtatcgccctttgcacgttgccttgccattccaacaaatccctaggcccttgagaagcgtgatacttctcctatttgctcacagctgccttggccccaccctgggagatgtagcaaattgagtatgggtttaggagtctgagccatcaggctcaaatccaggcgaagtgatctgggcaagttaatctctggaactttggtttctatcctcaacaaagcattatacgggtggaagtataagagc

SEQ ID NO: 614401 - DNA, 530 bp, Homo sapiens
  misc_feature (115)..(115): n is a, c, g, or t
ggcgggcgcggtggctcacgcctgtaatcccagctctcagggaggctaagaggcgggaggatagcttgagcccaggagttcgagacctgcctgggcaatatagcgagaaccccgntttcctccagaacaaagggaaccacaaaaaaacaaaccaaagggaccaaaaaaaacaaaaaaaaaaaaaaaaaaaaaatttggtttggggggcgcgccctggcgcccccgggaaagagaaggtttacaacacccacttctgtggggcggggggcggacccccatatgaggatatggtgcaacccgtggcggcaaaaagcggggcgtccccagaggagcagccgcggggcaacacgaacatgtgggcgtggggtttcctcccccaaagtaaaaaaaccgccgggggggacacacgggggtgtgctgtggacaaccccagaggtggagcgcgccggggggccctaggggggcttcatacccaaaggggcgcccaaggagcagaccagaaaataaaatttaacgccgcgagcggggat

SEQ ID NO: 614402 - DNA, 222 bp, Homo sapiens
  misc_feature (49)..(49): n is a, c, g, or t
  misc_feature (51)..(51): n is a, c, g, or t
  misc_feature (60)..(60): n is a, c, g, or t
  misc_feature (68)..(69): n is a, c, g, or t
  misc_feature (85)..(85): n is a, c, g, or t
  misc_feature (111)..(112): n is a, c, g, or t
  misc_feature (144)..(144): n is a, c, g, or t
  misc_feature (150)..(150): n is a, c, g, or t
  misc_feature (177)..(177): n is a, c, g, or t
  misc_feature (222)..(222): n is a, c, g, or t
ctgtagtacgcgggaaggatattactagtgccgaatattgagtatgagntnctgcgtgtncgcatcgnngtggaagtgcggtaantgttataaaattaatcagtgcagcgnncgttatttatgaatcacgtcgttgaaactgtncggtancgtatccgtatatatttttaaataacntttttcacagttttccggagttactgttgaaatctgcatcacggn

SEQ ID NO: 614403 - DNA, 190 bp, Homo sapiens
cttcctaaaaattttataaacccttgatacttttccctgataatgggtcgctccaataaacatatattgtgaaaatgcatccccaataaatggaattccttcctgcaaaatgtttttttttcccttatttttatggccaatattgatagtgaaaggtatgttttttataataaaaattatggccccgtta

SEQ ID NO: 614404 - DNA, 188 bp, Homo sapiens
  misc_feature (113)..(113): n is a, c, g, or t
  misc_feature (158)..(158): n is a, c, g, or t
tgctctagagtatccccctcacatgacctgctcacatgacctgaaaagtagcagcactcatgctggcgacagaggagactccttaaaaaaaaataaaataattcatctttganagttaacaataggaataggcatggaaatgctggcagtgagtgggntcagggccccctgggcagaagcaggaaggg

SEQ ID NO: 614405 - DNA, 202 bp, Homo sapiens
tatggatgaaatggctgtactacgagggctatgtggctgattgaagagtatgcatgagcgatttaggtctgttgtcgtaggcagatggagcttgttataattatgcctcataggcgatagtacaaggaaggggtaaggctatgtgtatagtcacgggggttaggcgctcgtaggaggggtaaccgacggcctcgaattcgta

SEQ ID NO: 614406 - DNA, 148 bp, Homo sapiens
caagagaagtaggaagcatatcaagcgtttaacttgatgtaaaaagtataatgtgaaaacttaaaatttattagaacttttatattgttttctttccctttcacagtaactttatgtaaaataagccattttcaaaagagctagaata

SEQ ID NO: 614407 - DNA, 154 bp, Homo sapiens
gatgcggcaggcacagagtgagctgggttattgatcagacggaactcaccggccggatgcgaagatagacgattgatactcttctcgatcgtggtggtgtgctgccgtcttagtgtcgagcgaccggtacgagtcgattcgaatcatgtcatag

SEQ ID NO: 614408 - DNA, 1070 bp, Homo sapiens
  misc_feature (1070)..(1070): n is a, c, g, or t
agcggagactccgtgcggggcgtgggattggtctgtggtcctctctcggttcctcgcgggtcgctgcggtcgaaggttcctgggactcacctgcttgcttgtgcccgtccgagtgggtcgcgtgcttctatgtctgcggcatgccctgtgttcgctggacggggaacgagaggggctgtgggcgcgttgcctgtcccgcgtgcctcccagtctggataggcccgagggtcgctgcctgtttgatgcctgttcgcacgggtgcggattgcacttgatgccggccggggacttgcaagtctgtggacccgagagggctggcgaccccgttgacttgccgtgtatccttggcgtagcaccttgcgcaacggagatgtgagctctcagaatacgtgggtcatagcagtgctgtacctagctttgacgctcggggggaacgcaaacgtgagacacggcgtttagcggtgcccaattataaggagttcagcgagccttgtgatgtgtagcacccatggggcagtttcacgccactgcgatcctggacgcaaatggaggttctggagggcgtttaagcatggtgcaatgtgtgttccggaacactagcgcctttagcagcggggtccaccgtggttgaaccaaccgaggagttggaaagcaaaccggctttgtggagagcacaactgctgaacggatagcctcccgacatctcatgtgccatgacagttgcgaggttgcaacttgcgacaactataatattccacgcatgccgctggatagcggatcctaaggcacacggcactagagtagcactagcaccctaagagcacaatgggagtaggaggtacggaaccgcgctcatgaatagccaacctcggcgaactaggaagtcacaccgcctatatgaccaagtaaacatcccggtccgggaggacgagacaccaaaggaagactacccaacgaatggaacggaacagccgataagggttgggcaacgcccgcacaccacaaacgagaacacagagcgtggcccacgagagggggtaccaaagcagcacggcaggaacaggcaaccn

SEQ ID NO: 614409 - DNA, 477 bp, Homo sapiens
  misc_feature (199)..(199): n is a, c, g, or t
  misc_feature (205)..(205): n is a, c, g, or t
  misc_feature (209)..(211): n is a, c, g, or t
  misc_feature (229)..(229): n is a, c, g, or t
  misc_feature (241)..(241): n is a, c, g, or t
  misc_feature (397)..(397): n is a, c, g, or t
  misc_feature (412)..(412): n is a, c, g, or t
  misc_feature (437)..(437): n is a, c, g, or t
  misc_feature (443)..(443): n is a, c, g, or t
  misc_feature (467)..(467): n is a, c, g, or t
taataccctgttgggtatcagttactaccatcatccaagtaacatagtccctgaaaactgttttctcacctgctttctctctctgagggatttcttttctgcttactcttttcccattgggtggcttggggcagaaattcctagtttttaactaaaacccaaatcattctggcagactctgtcaagcaagtcttacctntggggncagnnnggggaaggtgagccatcnggaggggaattnatgtcaataaaaccttggagaaggtgacgagaaactgaaactcctaaagccaggccttggatgctggtccctggctaagcagttatctcacagtgtgaccttggacaagccccgaactcctttttggctcagttttttcatctgtcaaatggggangactccttgcttccntcccacatgatcacaaaactccaanaaagantaaccagcaagatggcctgagacngggaacagta

SEQ ID NO: 614410 - DNA, 409 bp, Homo sapiens
tggttttggtttttcttaactttctcaaagggatgccaagacttccataatccttaaattccagtgaatttttctcgggtgataggggctatagattcaagtaccttcattggcgattcttccaatacgaagcagggagaaaatgtgtagcacaaaatatacaggatgtaagaaagcattgaaaaaattcctataagatacgtatatagcattgacaacaattcacacatttgtaacctactaaatacccacctggcaagttaaacttctcccggtagatgggggaatcataggttataccatggtgctgggcaaaacaaggactttttaacatctcagagcctagcaaagaacgtgggggctcctgtgaaagacaaaaaaacatttccaaaagttgcctatagtatcc

SEQ ID NO: 614411 - DNA, 135 bp, Homo sapiens
atcacaggttaggggtttttttaaatgggggttttaaaatttccagtgtttgctcctggaaggcagcaccaaaaagggcactaaaatgtactagctggatgtgacccatttttaataaacaggttttttaatcca

SEQ ID NO: 614412 - DNA, 730 bp, Homo sapiens
  misc_feature (308)..(308): n is a, c, g, or t
  misc_feature (335)..(335): n is a, c, g, or t
  misc_feature (353)..(353): n is a, c, g, or t
  misc_feature (520)..(520): n is a, c, g, or t
  misc_feature (560)..(560): n is a, c, g, or t
  misc_feature (643)..(643): n is a, c, g, or t
  misc_feature (668)..(668): n is a, c, g, or t
  misc_feature (685)..(685): n is a, c, g, or t
  misc_feature (699)..(699): n is a, c, g, or t
  misc_feature (703)..(703): n is a, c, g, or t
  misc_feature (707)..(707): n is a, c, g, or t
cacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgttaattccatgccagttgataacaggaaccacaatgaaggaatggtgactcgctgcatcattgaggtcctctcaaatgccttgtcgaagtccagcgctccacccatcacccctgagtgccgccaagtcctgaagacgagtagaaaagacgtnaaagacaaagagacaactgaaaatganaacacaaagtttgaagtnagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtngagcctctatccctccgacagccaagtctctgaagaagtnaagacacgccattctgagaagagccagagagaggatgaggaggaggaggagggagagaactatcaaaaaggggagcgaggggnagatagcagtgagagaacatcttgnagagcaggagagacacnatacgcttttctcnatgntatnaagcatgcttcagctatataaaa

SEQ ID NO: 614413 - DNA, 181 bp, Homo sapiens
cctgacaagcgcatcgccatggtcgtctataccgccgataccaaccgcgccacgggtcagatatcgccggtcgatcgcaccatccttgccaaagcgctcgcccagatcgaccgcatcggggtgaaaggcgtgggcatctacatcctgttggattcgccgcaggacgatgacccactgctcc

SEQ ID NO: 614414 - DNA, 351 bp, Homo sapiens
ctactactactaaattatcggccgctcgacacggagtcttgctctgtcgcccaggctgaggtgcagtggcgggatctcggctcactgcaagctccgcctcccgggttcacgccattctcctgcctcagcctcccaagtagctgggactacaggcggccgcactacgcccggctaatttggtgtatttttagtagagatggagtttcaccgtgttagtcaggatggtctcgataccctgacctcgtgatctgcctgcttcggcctcccaaagtgctgggattacaggcgtgacgaccgcgcctggcctaataccattttttaaaatggacaattctgggtcgacgcggccgc

SEQ ID NO: 614415 - DNA, 748 bp, Homo sapiens
tgagtgaggcatgtcttgtacctccatcatcaagatgtgtcggtgactacccccagtcttgtgctgcccaatttctgacatgcttatataaccatgtgaagcaactcctctccaatgagctactcctgacacaaatggagaagtgtgccctcatggaagccctgggttctcatttagcaaccaagttctaagaactacgagcgatcagacaggtgttccatagcaggagctgatggcaccaggtggccacgcagtcgtggccttgtcctcaagacactgcacagacgtgctggtcagactgtgtgactgcgttacacttgcggtatgtgcggtacagatcagaagagctgtgacccaggcctggaggcactccgtgtggcttaacaccggtgcacgaatgcagcttctagtgtatacagcatgctcgggtgttggtgcacagacgaacttgctggcccagctgacctagaagaggccaaaggctgggcggcatttgtcggtggcgttataccatccagcggcaacatccaatcttccgtaacccctgcgacaaagcgatgatgctgtacacttcttgatcagttcgcgttgcgccttataagaagccctacagatcacttttatatgcaccagcaaatgcttagccaaaatggcagagaccttttcagcaagggtctggatatgcttgacgcggcaaaatctgcaaattaggaatactcaaactctcttggaactccagaaccccagg

SEQ ID NO: 614416 - DNA, 264 bp, Homo sapiens
  misc_feature (9)..(9): n is a, c, g, or t
atgactttncagatactgtgctgagaacagtgatacaggcttagaggctctgaggcatggaacgctcatttgttcctaaaataaatgctcttccagttgcttggttttattttttcgtcaacataatcatttcttgggggcccttctcttggcctcgaagctaagcgcttttcccgccctggccttgttttgcctcctttaagcttctttccccatttgttcttcccgcggttcaacttaacccccggtggcgcaccacaagac

SEQ ID NO: 614417 - DNA, 1703 bp, Homo sapiens
ggttcccccctgcaggtcggggcctgagctccagtcccgcattctttgcctcccagggctgctgcccagagtaccattccaggcctgcgccgtgcgcccccgaccacagcacaccaagggcgcacggcggacgagaccccctccaggtaggactatgaatacaccggtgcacgaccgccgacacaggagtaccgccgcggctgcatgcggccagactgacacgcacgcaagcagcacgaacagacgagctaggacagagccacgccagagaacccactgaacagacccgaccatataccgagaagaacaccacacctaagagcacatcgacacccagcacaccaagcgacacgccaaaaaaaacacccagaaaaacaacaaaacacacaagagcacacaacacacaaaaaacacaaaccccaacccccgacgcagccgcgagcacaaccacacacagcgccaacgagcagccccaggagccaccagacacactcaccgaccagcagcagacgacacggacaaccacacgagcacacaacagaactacaagaacgaggcgagacaacacgacgaaaccagaccaaaccgagcgcccacaaacaccaacaacaccacacaagaagacaggaagcaggaaacgagacagaaggcacacacagagcgcgccggccagaggaccagacgccggcagccacagcaagcgccgcgaaccgcagcacgacacgcccacccgcccgagacgccacgccgacccaccccacggcagcacggcgagcgaggcacagccggaccgcacaaccggtgcaccgacgccgacccagcaacaccacgagaccggacacgcagacaaacgacgaacgacacaccgcgggcgaagacgagagaaggcaaacggcaggagacaggagggaagcgagaggacgaagacggagcgcgcacgaaaagcgaacgggaggcgagcagagaagggaggacagcagaggaagacggcgaccgaggcgacgggacggcggcgccgcactgcctgggccacgaggggagcgaagacgagggcggggagagcggcgggaggcaggccagggggaggagcggacgggggcgcgcgagccacggccgagcgcaacgacggcaacccgggacgacagcacgacgccacaacgggagacagagcacaccgacagagagcagagcacggagcgcagaccgcgacgagacagcgcgcacagcacaagcggcacaacacgcgcagccaccagggcgcagagacaggcagccgaagcaaacgcgccaagcacaccacagacggcggcaggcgaccgcacggcagcgacagccgcacaccaccgacagccaccgagagcgacgacacgaacaacacaaacaaaaaaacgcgacaggaaagacaaccacagcaacaacgcaacagacaaacaaacaacgacacaacacgcaacacacaacgaccacaacaacacagcaaacacccccgggcccacaccacacaggacccccccacgagacaacacaatacgacagaacacaacagaaccaaaccacacgacgccaccacacgcaccaccacaaccacacacagaccacgaagcagaacgacatcaaaccagccaccacgccagccacacacacgcacgcacgccaaccacaccagaccacaccgccctgccgtcgcaacgacgcccgcacct

SEQ ID NO: 614418 - DNA, 189 bp, Homo sapiens
  misc_feature (122)..(122): n is a, c, g, or t
tgtatctagcggatcctttttgcggtgctttcctacatcaagaactttccaaatgtgggcctggggcctagcaaaacagtggcttggcacaggctctgggcctctgggaggctcccatctgncatcaggtggcggcacagagcagggctgtcagcactgggcatgagaggctgggcacaaatgagtagc

SEQ ID NO: 614419 - DNA, 155 bp, Homo sapiens
tgaggctctccaagaggtcttagaggtggaagaggaggcacgtggacggaatcagggacctccctcacggggaggacacatggatgacggtggatcttccatgaattataacctgagttcttccaggggaaccactcccatgtaaaacgaggacc

SEQ ID NO: 614420 - DNA, 138 bp, Homo sapiens
taaagttaggtagtttgttttcttattattgagtttacaagtatcttgtatattttggataaagtgtgccttttgcgaataatttctccctgcctgtggctagtcttcttatactcttgaggttgagattcatttttg

SEQ ID NO: 614421 - DNA, 904 bp, Homo sapiens
ggcgatgagcagcaaagtctctcgggacaccctgtacgaggtcggtgcggctaagtcctgactgggaaccaggcaagctgcgaaagttcctggatgacggtggagttgcagatcagccttgaatgacacgtatgatccccgcagaaggagaaggcgcttctcagggcaccgatcaggctatacaggttcagtccccgccctaatgttctctgtgtagtggatccttgggggatacagcagtcattgtgacgaggctaacggccgttggtatatcccccacatggaaccatcgaggcgctgaaaaaagctcaacacagagatacataagacacatggtcacgaaagcttgggcacaagaagtatgatcgctgtttttggcctcagagtcgtcttgatcacagcacgacttccaggaactctcggcccaccggtataaactaccggcaggaccccgttcccatatccctgctccaccacaagcgaacaacatggttggaacaacacgtggatgaggtgaagttcacaaagtcaaggttccaactgacagaaggtgtactgtctggcatgtacgctgttggatcacgtgacgattgacagacgctgacgcgtcgtggtactcccacttacaacctgtctggtcacaaggttctgggaagcacaatatgcttcaattaaaaacactggggaagaaactgtcccggggcctaaatatcttgcaggacgcaacaatgagtgaagcgcccaagcagctataattcaaggcaccctttagaacataaatctaattagccagtttgacaatctacccaacacaaacaaacactagcagaattgattcacgagcgagcaaaaaaaccacttacaaagacacctcacagaactatcccttcccggacattagaga

SEQ ID NO: 614422 - DNA, 87 bp, Homo sapiens
cctctcgcttctgcgagcaactaatcgtcgaccacgcgtcgcccacgcgtcgctgaaaatccgaagtgccgcggaaagtggaggtga

SEQ ID NO: 614423 - DNA, 597 bp, Homo sapiens
ggctgtagtttagtctatgctattctctcctatctgtgaggatacatgcatcctggaaggacataccctggacagatttgactgtgggctgctcctattccgctatcccgtaggtggatctctcttgctccaacttgaaaagtgaatctggcttgttgcctccatgaccctattgatactcacgttgatgtaattctccatacttgaggtgctcttgctacaagaccttctgagactggtccaactagctgccgctccgtccctggttgaagcccgcagccacatcttcgaatgacaatgacccctcccctgaagaactgccttgctctctcctcacagacattacaatcgtggcatttttcatgtgtttcctgttatttcagctgggccttgcccatttcgttcaactcttaggggctagcaactctagtatgttctctctcttctgtctattctgggccttcccagaagtggtggtcaggtatcatctcaggtcaagctaccactggaaatgatgatcttccccagcctggaagctccttcttccattactgaaaatgtcttgtttctataggccagaaccacaaatatcggggg

SEQ ID NO: 614424 - DNA, 157 bp, Homo sapiens
ttgcttgtgctgacaagagcctttcattgcagcagtatggatggaattaaccatcacgttagtgatgtatcagtatagaaatgagaactattgcatgtgttcactcatatggcagaagcaggaagcagtagaagcaggatgcggcagaagcaggaag

SEQ ID NO: 614425 - DNA, 1440 bp, Homo sapiens
cgtcttgtgtcctgtttcgtgttccgtctctttgtcctctctctgtaccatctcgggacgcctgcccccctgttttagcacctcacgtctatggttgatcgttcactccgctgctgcctgtgtgcttgcggctcgtcgctacttccctggtcctcatgctcttgttggggacacttcctgtgttcacttgctggtgctctgcttcctgtcgcccaggtattctgtcgctgcttattttgcctctttgccgcgcccactgagcgtacgttcgtgcccctgcctgtttcgttgggtccttccccctgttcagagtttgcttcttagttgacctttcgcttcccgtgtccatcacgtgtcgttcggttcctttttctgattggtggttggctttggctctctgttatattttgtgttctcgtagccccttggttgggcaccgtgcctctcgggctcattggtcttgtgccgctttcttcggggccatatatgctgtgcctgacttttgtcgcgttcttgtctgtttccagctgttgctcttttatgtatcatggtctctcgggtgttgtcttaagggcgataccgggcgctgttcatcgtggtgttactccttcctttggctctcaaactatcttgggtcttctctggctcactgttgccctttccccatgctctcttttgctctactggtactgtgttctgcgcttgtcctgtcattgtctggctggcgtcccccggtccggattgtcgactctccacgtctctctcacgaggcctgctagtcacgccctagcctctgtcagtcttgtgtatcatggtccagtcttcgggtttcacctcttagtactccactaagctgctcctctctctgtggccccggcccctgcccaggtgtggatggttctggccagggaaggcacaatggtagtctgtgggccaagacaccaggccctgtcgctagccccgtctagtaatgacctttgcccaggagaggagaaggatgcctgggtgtccatggcaagacttagcccctcagcaggagaagaggcccagaggcttccatgtctggccaccgtgccccactgagatggcccctgtgtggttccctttaccgttggcttcctggcccagtccctgcctctcctacctgcaccctgcttcctggcccagtctcaggttggagtccctcggcatagctgactactcatgctattgctcttaagcttggcttttcacattaagtcaacaccaaacgtggttgccacatttcagtcagactagacacctccctgctggagatgcagttgtagtgacaaccttgttacattgtagcctagagccaattctgtgtggatatttaagtgaacaatgtttacaatttctttgtatatatcactctctccctctcctgaaagaccagagaataatgtcggggcagtgtcc

SEQ ID NO: 614426 - DNA, 127 bp, Homo sapiens
atgggtacgatctagaggatccagccatttctcccatttctacaaaaatgagctatgcacctgtagtcccagctactccagaggctgaggtgggactacaggtgcatgctcattgtggtagaattgg

SEQ ID NO: 614427 - DNA, 574 bp, Homo sapiens
tagcacgtacagatttcctaactgaaataaatctttagttattattcattccaaaacattcagattaaaggtttcctaccatatcttagggtagttaacatgcagcaattgagggtgatattcacagttggttctgactagttattatttccgatcatttatcatttatacttaaggattccctattcatgtctctcttctctagttcttaccactcctctctcaaaagttctcctccatgtattccttcccaagtgcttaatttttaattgcctccctagttcagattctcttcagccattcactcccaactcagcaagcatcacacccaagttttttagtccccttgccctcaatattcaacaaacctgagttcccgagacccatggactctttctcacttctgccgcaaaagcagaaacagtagggatgtataacacttcacagggatacctaaaggtgttcagaactgctgccatttttgttaaacctcacatccagtctgtcatctacatcagcagtccccaaccttttcgggaccagggactggtctcatagagcaacattcctccag

SEQ ID NO: 614428 - DNA, 616 bp, Homo sapiens
aatgaacaattgtatgatcaggaagtatgtgcgagaagtgaataccataatataatggaaagtactgaggaaggacaaccagacaaaacacaagaatactcagacagatcaagctctggtatgtacggtggaagcagaccacctttaaccggattctccttaaactatcctaacctcctgcaaagattgtcttgttaactccaggaccctactgctatagtttgaagaaaactgctctaccctgtttaacatgtcagcctttactactttggctgatccagcgagaatgtcaggatatctcttaactgtactccttagaatatcaacttattctttagctagtctccggtaggaaaaggttgacaatcatgaaaactgtgcttaacaaggactaaatggtctataccaggaccggctgcaaaagtcatggccgtctttataaacagtgggaaccagaccacacattgatattctgcagccagtgtctcagcatgtgattctagtgatttgtgagtagtgatcactataggtcctgtctccattttcttaaagactttgtgattcctccagactatgagtgttgtaacatttatggcagacaggtgcagcgtagaat

SEQ ID NO: 614429 - DNA, 361 bp, Homo sapiens
gctatttcttcttatcgtatttgtacccattaaccaacccctttttttaatctccttccgcctatatcctaacatctattacaggttcaggacgtacatgtgtgggttgttacatgagtaaatgtgtgtcatgggggactggtgtatagattatttcatcacccaagtaaaaaacacagtatccagtaagtagatttttttgatcctcaccctcctcccaccctccacccacaagtaggccccagtgtctattgttcccttctttgtgtccatgtgtacttaatgtttagctcctacttataagtgacaacatgcagtatttggttttccgttcctgagttaacttgtttaggataatggc

SEQ ID NO: 614430 - DNA, 270 bp, Homo sapiens
aagctccaacaagacatcaagctgtacacctggcccacccaccgtggtgcctcacagcattgtctcacctcccgaggataggacagtcaaagacagcacccaagttctctggactcagatactctgatggcatgctgctgaaacttcaagaagctgcaactacattgagtctccagatcgagaaaccatcctgggaccccaaccttcaggcaacactttaagggtacggcaatcactgtaatccccggaccgcagaacgctgggcatcag

SEQ ID NO: 614431 - DNA, 376 bp, Homo sapiens
gcgatactggttgggggcaggatcattttgccccttgtccacgcaccccccccagccctttcgcttttaacacagggcccctgctggggctcagggatgttaaggacgagttccagccccgcccctgccctggggagacccctccctgttcctgcctccctggttttgccgcccctctttctggacccccagtggctgtcccatgggtacatcctgtgggtgggggccccccacaggacagcaggacggtttgttttcagtggaatcccctccctggggtcccctggttccccctctttcccagccccccggggctggggcatgtttgccataaaggaaaggtttgtggcgcccgtcctggccggcctttcatgga

SEQ ID NO: 614432 - DNA, 1078 bp, Homo sapiens
tttactgaaaatagtctttttttctttgctttccagttttacacttttgtggttgaacacaaaaaagtgtggacaagaatcaaattaactagatgtggtaaaacacgtgatttttttaaaaattcacttcttttaaacccggtgagaatcacaatttcaaagtttgtggcccactgtggggggcaacctgtgtgtaaacctttacaaaccttttttctttaacaactgtgaccacttatgtgttgcacgtgaattttctctttaaaacaacaaatagtgccatttaagaaaagtgatttttgtgtggttgaacaccatttctgtggcacaaaaaaaaaaacaaaaaaaaaaaacaaaaaaaaacaacaaacaacaacaaaaaaaaacaaaaaaaaagagagaaagagagagaggaagagagaacaacgagagagaacaaagaaaagagagagaccgaggagagagagaggagagaggagagggagaggaagagcggcggagcgcgggggggggcggggggtgcgaggggcggaggagagacggaccgcgagcggagagcgagcagggagggacgcaggacgagaaacagacaggaaagaaagcggcgcacggcagcgaggcgggcacgccaaggaggcgggggcagacggaggcggcgacgcgaggggcgcgggcgaggcgtgcaagagacagggagagagacgacgacggcgcgcggaggagggagaagacggagagagagccaagagcggggcagaagaagaagagcacgggaggccgctagaagaggagcgagagcgagacaagaaagcaagaagcacaaggaggcaacaagagcagaacgaggacgcggagagggcagcgaagaaaaaaggcgaggagaaaaaaaaaaagacgtaagagaaaaagcgaggcacaaacaaaaggacgagcagcaacgcaccaaactgacgagacaaagacaaagaagaagagagcacgacggccaaaagccacgggagggagagcagacagaagctgatggaacgaaaagcacggagacagggagacgcacacaagacgaagagagaagacagat

SEQ ID NO: 614433 - DNA, 252 bp, Homo sapiens
  misc_feature (105)..(105): n is a, c, g, or t
tttttttgggggggggggggccccccttttttttggggggttttttggggccccccgggggcccccccctttgggggggggggatttttttttccttttttctcnttttttgggggggggggggggcccccccccccccccttttctttttttggggggttggggcccccccctttttgggggttttttttttgggccccccgggggcccccccccccccccctttgggtttaggggggcccctttttttta

SEQ ID NO: 614434 - DNA, 111 bp, Homo sapiens
attaagtgggtgatacatgtgaattgttacgacattgctttgcccatatctgcatgctgtatgccatattttcatcattgatgattacttcatgggaaatatttcgttatc

SEQ ID NO: 614435 - DNA, 1352 bp, Homo sapiens
atcttccgagctcgatttccagaccgacagcaggagctgagtgcttcaagatcaccaatgccatccttgtgggctgcgcttcgcggagacagctgctctactggttcttctagtgatgggggctacagtcaagcgcctcagctgagggtgtgtccatccgcactggtctggagctctcccgggatcccggctggacggatgaaagtgtccaagtgtcgtccgtgccaggtgctcgtgtcgtccagaatgcagcgcggccattcgggggaaccttcgaagaaggtgtatgattattctgctaccacgttgcatcgacctcaggggatgcgcttcctcctcaagccagcagatctgccctgtcctctaccacgcaggggacggtcctgctcaactgccgctcctggacaccgtgcctagtgcgcagtgtactgtggacgagcttgtaggcattagagtattccctcatgaaggatcctgtggcttccaccagcaacctggacatggacttcccggggggccttcgttcccccgtgactgagaggaactggagcctccccaaacgggcagtggagccccagctgcaggaggaagagcggatggtgtatgtggccttctctgagttcttcttcgatctgccatggagagctacttccggggcgggggccctgaagctgttgctggttgggggacaaggtgcccaggaactggacatgcttgctgagggccaactactatgggaagcatgggtcttgttgagcccaagaagtgattgactcacacatagaaggctggagctgcagggtcatgggcccaccggcttcgacagtcatgccctctggaccaccaactctggcacatggtagcgtcaccatggccgggtacaaccagaacagctgaggtcagctgcagcgctgacaacaaggaagcacgaggcaaaggcaaagaggggtccagggagagaagccagcggaacacaaaaggacacgacggcccaacattacacaaaaagtacgagagcgagaccaaccacaacagagcgtgaacacgatagcaaaagtggggagaccaaaacaaggacagaagggggagcacccacaaggcaggacccaagtaggagagacaagaaaaccagaagagaacgcaacgggagggaaaacaggggaccaacaaacttagggtgccgcgtcgccacccagctctccacgagagccaacaaaccgaacaaacgagaagaccagcacacagaaaccgcaccagcaaagcgaccagacacgacgaggacgcaaaccacacaaggaccagcaccagcaacaacgacgaagcggcacgcagacagcacgagcaagagagag

SEQ ID NO: 614436 - DNA, 132 bp, Homo sapiens
tagcccgatcgtttggctcgcggctgcagatcccagatttcaggtggtcttagatgtgtcctagtagatcgctgcccattgagtacgtgctctgtgcttgtcaccatatagaagaaagctcgtgctccagca

SEQ ID NO: 614437 - DNA, 370 bp, Homo sapiens
cttagaagttgtggtggatatgtgtgtgtgtattaccaatattctaatttaaaggaatgacttaacacaggggtgcaggttaagctaaagtgtagtatgaccacctaaacttggggatacactcactgaactaaataaaaactgctttaactgtgtcaactggaacaccaattaatgatcaatgacgagaggtattcatctaacactttatcaatataactcttgtttgagtgaatgcaatcttaatgggcacaatcaatactcttttttaggtcacagtcaaaattctttattgataaagacctctcatgtttatctcaaaaaaagctttaagaattgtccaggaatcaccacaacttctaagggtaag

SEQ ID NO: 614438 - DNA, 578 bp, Homo sapiens
cacagcactcaccgaccccaggcgtgactacgtttgaggcaaccatgaaggcttcagacattcaaacttcttaatagaccaggcgtggtggctcacgcctggaatcccagcactttgggaggctgagctttcctcattggccgtcatgccttggatcattaaggacactttggaacggagctttgctattctctgaagatacacaaaatcctccactgctcacgtcataatctatttaccaactgtggaaaattccgcggtgcctgtggtttttaaagtgatgctgaagcgagcacctttgtgcatatgtcttgatccacgcctgattttaaaatttcagataaaatcctagaagtgaaatggctggagagagagttacagcagagccaggttctccgtcctgcgcggtttctaagtgaaatggctggagagagagtcacagcagagccaggggctccatcctgcgcggtttctgcatttggtgttgagttgtcctttctgcatcggaattctgactcctgaaatcacatttctcaccgtgtctaggtcatactttcaataatctttcaataaccaaa

SEQ ID NO: 614439 - DNA, 147 bp, Homo sapiens
ctggacgatctcatagcacggatcccccgttctatctactgtaaatatattgtgtgctccctacgattaaccctaggcaagccaattgatatcatagctcagaccatacctatttatcccaatggttcttttcttccggagtagtaa

SEQ ID NO: 614440 - DNA, 219 bp, Homo sapiens
gttgtgcacatctgctgagggcccgtatcactatgcgcgtgggtcatacagatcgtaatgtacagttgttgcagatcacggtggacgaagttgttgcgcaagaacttcgtccattcagacctgcggcggtctggatcttcggcgtgtgcaaacaacttcgtccaccctgatctgcggcggtctgttggctcggcgtgtgcaacacgccgaccgcccaga

SEQ ID NO: 614441 - DNA, 899 bp, Homo sapiens
  misc_feature (615)..(615): n is a, c, g, or t
  misc_feature (634)..(634): n is a, c, g, or t
  misc_feature (651)..(651): n is a, c, g, or t
  misc_feature (899)..(899): n is a, c, g, or t
ggaaccttctggtgacttcttttgaaaaaccgagattcctctgtcatgtcccataatgtctctactttttttagtgcaaactttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgatggcatttccatttattttccattgttccctgtttctcctggacttcctctcgtttctcttttcgaggatgcttagaggcttctcaccagagatggtgaggtttcccccatcatctagatgggagattgacaaattctgtnaaggtaagacagtactatnttaggcttgtgggctanatgtggtctctgtagcacattcttcttgtgtgctgtgtcatcgttgttgcactggttatgtaacactctcttttttgcagagtctctctcgtgccagtggggcattgtcaattcgggtccataaactcactatggagggggggaaaggctcccgggggttacgaaccctttccgtggaagaccttaaaaaaaaaggggatcggcgacctaactgtaaacgcaaggtttccacatattattaatactgn

SEQ ID NO: 614442 - DNA, 625 bp, Homo sapiens
  misc_feature (473)..(473): n is a, c, g, or t
ccctacattggaatattaatcggtggagactcattttctcttttgttaactttggaggggttaaatatttgcatggcaggggccttaaaatattcctttttaccctgaccggccagttaaaccctaaccctgtgggtgaagaaaacatctgtttggatttgaagagctaaagagtctccagcaggattggagactaacttgtgactgcgggctgggggggcattcccagtaggaatgtgaagccagaggtttgggatttgtgacatccaccccctgggcaagtgagagcatttgcaaaatgcaaagagaactccctcatatgcaggatgagccaatggcagtttcaaaaaatgtactcgggcgaccccttacctgtggaaagcaaattttttcaaaataagcccctgggactcggtaggtggagccccagctgtttttttagggacctatgggcccttcgtggcatttttgtnctgtgtgctggggaggaggttaatgtaatggggacttttttttgatcagccccttgcccgtgattcccaaggtcccagccaaagcaaagggccagttgtttcagtttaaacaaacatgtttttagtttaataaaattagttaactcccagta

SEQ ID NO: 614443 - DNA, 505 bp, Homo sapiens
  misc_feature (505)..(505): n is a, c, g, or t
ggcggggcgcggggtcacgcctgtaatcccagctctcagggaggctaagaggcgggaggatagcttgagcccaggagttcgagacctgcctgggaatatagcgagaccccgttctccagaaaacggaaaaaacaacaacaacccaaaaaatacaaaaacaaacaacaaaaaaaaaaacatgggtggggggaggcgcgcctggacccaggaaaaaggtttttcacacacccactgccggtggggggcgggcgggacccccaggtggagttatagtggaaacaacggggccccagagcggcgctgccagaagaaacactcggcgccacgaacacaaggcgggcgggttttctccaccaacaatataaaaaaagcccgcgccgggggacacccgcggagcggtttgcgaaacaaacccgaggagcgctctcggggaggccacaaacgggcctctcacacaggggggccacagcggagccaaataaaatacgccgcgggggggagggan

SEQ ID NO: 614444 - DNA, 831 bp, Homo sapiens
  misc_feature (615)..(615): n is a, c, g, or t
  misc_feature (634)..(634): n is a, c, g, or t
  misc_feature (651)..(651): n is a, c, g, or t
ggaaccttctggtgacttcttttgaaaaaccgagattcctctgtcatgtcccataatgtctctactttttttagtgcaaactttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgatggcatttccatttattttccattgttccctgtttctcctggacttcctctcgtttctcttttcgaggatgcttagaggcttctcaccagagatggtgaggtttcccccatcatctagatgggagattgacaaattctgtnaaggtaagacagtactatnttaggcttgtgggctanatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccaccttccgggttcaggcaa

SEQ ID NO: 614445 - DNA, 126 bp, Homo sapiens
atcgccgaccaggtgaggtccagcttgaagagaaagaaacaagaagttcctgtgtttaaggccgtgtattcaagagccaggtggtcgcggggcaaactacttcatcaaggtgcacgtcggcgcgag

SEQ ID NO: 614446 - DNA, 726 bp, Homo sapiens
  misc_feature (325)..(325): n is a, c, g, or t
  misc_feature (329)..(329): n is a, c, g, or t
  misc_feature (332)..(332): n is a, c, g, or t
  misc_feature (337)..(337): n is a, c, g, or t
  misc_feature (340)..(340): n is a, c, g, or t
  misc_feature (354)..(354): n is a, c, g, or t
  misc_feature (360)..(360): n is a, c, g, or t
  misc_feature (368)..(368): n is a, c, g, or t
  misc_feature (375)..(375): n is a, c, g, or t
  misc_feature (428)..(428): n is a, c, g, or t
  misc_feature (432)..(432): n is a, c, g, or t
  misc_feature (508)..(508): n is a, c, g, or t
gtgatgagccgagatcgcaccattgcactccagcatgggtgacagggcgggactctgtctcaaaaaaaaaaaaatagtaaaatgtttatggtcatcaatatagctgtgactagaaaagatacttgatacagaggcacatgctttaaaaagcttccttatggaaaatgttaaatacaaggtgaacattccttatccgaaattctggggaccagaaaccacgtgtttctgatctcagaatttggggggttgggaatatttgcattggtacccagttgagcattctaaatccagaaatccaaaatccgatatactccaggagtttttncttngtnatgtnggngctcgggaagtttnggattnggattttnggattanggaaactcaatctgtacacctacaaatagaatagcataataaactcacatgtntgtnttatgcagcttcagttactaggatataagcagtgctgtgttgttcatactcatctctaatgtgctctaccctctanacagtttgagaccagtctgggaaacacagtgagacctcatctttacaaaaaaatttaaaaagtagctgagtgtggtgtacaccagtagtccaagctacttgggaggatgagttaggaggatcacttgagtccagatggtcgaggccgcagtgagctatgattacaccactgcactccagcctgggcaacagagttagaccctgtctcaaaaaaaaaaa

SEQ ID NO: 614447 - DNA, 145 bp, Homo sapiens
acggcgcccttttccctccttccgctcagcggggctcttcgtgaaccttctctttccgtggtgtgtccctttttaggtcctgcaaatttagcatcaaactgggccatcttctcacacagtttcacttcccccaagacagcccgga

SEQ ID NO: 614448 - DNA, 907 bp, Homo sapiens
gattgacagaagcgtcaattcctgggagtagtacgttggttttcttgcccctcatccttttgcctgctcccggcgaggggtggctttgatttcggcgatgagctcccagaaaggctacgtggctcgttccagacctcagaagcaccagaatacgtttagcttcaaaaatgacaagttcgataaaagtgtgcagaccaagaaaattaatgcaaaacttcatgatggacgtatgtcagcgctgtacacgaagttcttgagtggcgtgtccacatacagcacatacaaaccattatcaaaacctaacacagtgtcgtcgcctgtattacacaaagcaccagtgaaggattcttatcacactactgtgcacggccatgtgcctgtgaacttgaagttctgcgcacaaatgtggcaacgaaagaagacattgtattccatggagtctccctctgtagcccaggcctggagtgcaatggcaggatcttgagatcacacaagctcgactcccttgtacaagtgattctcctgcctcagactctcgaagtagctgggaactacaggcggcacacaacaatggccccagttaatcctgagataataagtaccaatggggtatacactaatgttggccaggccggcttggaactcctaggacctcattgatccgcctgactcaagcgtcccaaagtctgccatccaggtgtgaaccatcatgccttgaccctaaattgggacaacatgcctacatgactacatgcacggtttgacactgagcactacagacgacagcgtcatgagacgtagtaaataaatacctctagttcaaatcgacacatggacatcttgacgaaattagccggaactgatctaccagtggagccaactaaggcaaacgcacaccgttggaccg

SEQ ID NO: 614449 - DNA, 181 bp, Homo sapiens
cctcaggatatagggagttattgtttaatgggtacgagtatcaattttggcaagatggaaacagctgcacacagtgtgaatatcttgatgccaccgaactgtatgcttaaacagtggttaaaatgggctggtgtgcagctgtctcactgcctagttataaccaacacttctgggacggtca

SEQ ID NO: 614450 - DNA, 146 bp, Homo sapiens
cttaagcgggctcatctacttaatgtatatctcgaaggctttgcatagctctggaatacagctggcatcattaaatatcaaataatgaatagctagattagacctttctcatccttttcctatgtctttctaccttctctctcagt

SEQ ID NO: 614451 - DNA, 644 bp, Homo sapiens
cagtcttctttctgcgtcgccaggccgagcccacatctgctcagacaccatggcgcgcataggtgaaggtcggagtcgacggatttggtcgtgttgggcgcctggtcaccagtgcctgcttttaagctctggttaagagtggatattagttgccatcagatgaccccttcattgacctcaactacagtggctttacatgttccaatactgattccacccatggccacattccatggcaccgtcaaggctgagcaacgggaagcttgtcatcaactggaaatcccactcaccatcttccagtgatgcgatgatccctccagagagactcaacgtgtggcgcgatgtctggcagctgagctacgtccgctcggagtccacttgggcgtcttcaccatccagtggtagaaggctggggcgtcattttgcagtggcgggagccccctacgggtcatcatctctgcgcccctcttgctgattgcccccgagtgttctcgtcatgggttgttgaccatgtagaagttttgacaacatgcctcgagatcgtcagcgatggctcctgtgtcagcgactgcttatggatcccctgtggccaggtgcctccatgaccaactttggcatcggggaaggagtccttttgcccctgt

SEQ ID NO: 614452 - DNA, 85 bp, Homo sapiens
ggcaagagatgttcacttgccatcacctagctgcctgcacctgcccttcagggagatgggggtcattaaaggaaactgaacattg

SEQ ID NO: 614453 - DNA, 425 bp, Homo sapiens
acccctcacggatactcacgatacagtatagcaactatacatagcactgtattgggtattataaatacagatgatttaaagaatacagaagatatgcataggttatatgcaaattctatacaccattttatataagaaacttaagctgggcacagtggctcatgcctgtaataccagcactttgggagcccgcggcaggcggctcacctgaagtcaggagttcgagaccagcctggccaatatggtgaaacctcacctctactaaaaatacaaaaatcagccaggcgtggtggtgcacacctgtaatcccagctactcgggaggccgaggcaggagaatcacctgaacccgggaggtggagattgcagtgagccgaaatcgtaccactgcactccagcctgggtgacagtgcaagactccgtctc

SEQ ID NO: 614454 - DNA, 449 bp, Homo sapiens
gcactgagttctggattccacatacataggctcttgcatcattacttgtgacatagaatagagtgagggtcctgtagacattggacagctagcagcctgggactgactgggaggctctgaccattagcccaccacaggtaagttgtgtgcgtgagcctcaggtacacaggtgaaggccacagaatccttgtcctccacgggattagaaatagttgctgaagatggagggcttgggcagctccgtcaagactgtgattgtcttgactgtagtcctgctgatggccactggctgagttattggcctggcaggtatagagtccgctgttcttctcagtgatgtaggagataaagagctcttgtgtgtgtagctggatgtccccatcaatcagccaagaatactgtgccggtgggttcgaggctgcatggcaggagaggctgaggttcaccca

SEQ ID NO: 614455 - DNA, 781 bp, Homo sapiens
tcaaactaggcagagtgaccgtcatgaatcaatgttgcgagcacaactggggagaggcgagacttatagacgttcatgccggcctgtgaaagtatgaagatgtggagcacaacggtgactacacgtatttggacaacctcttgatctacattacgtgaacaatgagctctccatcctgcgtgagaagacaccaagatgagtctctgcactgtaaagcaagtatgacgacttatctcatgaataagacagctcaagcgaatgcaacaagccgttatgagtatattcgctgttagtcgccaggactagaaaaccataacagttcctctccccagtctggggtgatccaggatcgaggttgccggattcataggctctctccaggtcacgcaggggagatatagaactacataatctacctagtaccctccgagtctgctagaatgcaaggtgccttctctgtcaggagtcccagaacctcttgtgccgaaacttcaccttcccctcgttgctagtgtgctctgagcggtaagcagcaaattggaccggtagagggtcctaacaccagcatcaaacggggacgggggacgttcatccccatgagatccagagatgccagtgcatgctgggatccccttgtgacagtggcagaagattccttgtatggacgtttgccaatgccttggtcgggtcatgcagacagtcgatccttccggatatgagaattgtccgcgtgccatgaattcctgtacagcgaggaagtctcagattgggaacacagtat

SEQ ID NO: 614456 - DNA, 378 bp, Homo sapiens
tagaatgtcaagtgctggggaatgatgccaggtgttccgctccccacctatcagaggttccaatgccccccagggcaacacagcccaacatctacgttcctgaagagaagtgtggtgactctcagtgtcacacttctgccatcgaaaaaagtgccagaagccatcagctccaggaaagttgtatctcagttccccccaagtccaggtggtgatgagagaggggccctggagctccctgggagcaggaggccccagttctcgatatttcagtgaaatacttccctctccccgtgcatgcggcctggccttgcgcatctttggaggcatgccacaggcctggaaggtgtgtaggcctgccggagagccagggtgcggaca

SEQ ID NO: 614457 - DNA, 546 bp, Homo sapiens
atcatttttagcattgcagaatatttgcaagctttatgtaagcatgtatgtatgtgtgtatgtatttttatttagtgttattttttctccttttttggcatttttttttttgtgatgtctttttacatgtctttaaaaaatttgttttacattgttaagaatcccactgtgcccggccaatgtttccattttcaaataagaaagtagatacaggtgagcattagattatgacagcgatctgatggctatgttcaggatggatttaactttgaagagagttttggatgtcataagtttgggtatatgtcatttgctttatagatgagcagatggagtttgtccttaactggcttttcttccatttttgtttgttgtctgtttctacagctcagggtcttcaagttagccaaagcctggccaactttgaacacactaattaagataatcggcgactctgtcggagcccttggaagcctgactgtggtcctggtcattgtgatctttattttctcagtagttggcatgcagcattttggccgcagcttc

SEQ ID NO: 614458 - DNA, 157 bp, Homo sapiens
aggtaatgatgttgactagtagtgagagctgcagaatgaagagaacatagatctgattcagctagaaattgggtgccattcatccacttcagttcatactttcttagtccaacatccctatggtcttgtcaggacagaccatgaccatcatcagtct

SEQ ID NO: 614459 - DNA, 321 bp, Homo sapiens
ctcaatttagtacggctgacgtttcactttcatcattagctcaaactcgaccacactattgcacctacctgattgtttcatatatctatcaaaaaattgctcatatcttttctacaattgtcctctatgacatatcgaactgctaaaatcaaatccgagtgtcagtcattcgacttgccctctagaatcttttaataactgatatgatcctttcttagtttcactttaccagcaatctggttgttggcattgtgtgacagtctgggtcagggtggctatgaatttacgattggtccaactggattgcgttgacatgggcgc

SEQ ID NO: 614460 - DNA, 488 bp, Homo sapiens
ttattcttaatctcttactatgcctagtttataaattaaaatttataaggggtatgtattattggaaaaaacatatatagggtaggtaccgtccgcagttttaggcatccacttacataatgggggaccttggaatgtatcccctgtgaataatgggggctactgtacatctaccatatattacaaaacaccccccgtggagactggggctgtactatgtaacagtgatatttttgtagtgaaatatatgacagctgtgctgtgtagctgtgtacactaaatgggtcaagttttgctgccatctgagtttttagagctttttgggtttcagatttgcaaacaagggagtgtgaattgatggctgtagaaaaaggacctgtgatatagaacaaaatgtaaaaactattgccaagttgttttggatcaaatagggaatttacttttcctgatttaaatcactttttatgcagcagacactgtgatggtaa

SEQ ID NO: 614461 - DNA, 467 bp, Homo sapiens
ttattcttaatctcttactatgcctagtttataaattaaaatttataaggggtatgtattattggaaaaaacatatatagggtaggtaccgtccgcagttttaggcatccacttacataatgggggaccttggaatgtatcccctgtgaataatgggggctactgtacatctaccatatattacaaaacaccccccgtggagactggggctgtactatgtaacagtgatatttttgtagtgaaatatatgacagctgtgctgtgtagctgtgtacactaaatgggtcaagtctgctctactaaaaatacaaaaattagccttagccgggcatgaagccggcgcctgtgatcccagctacttaggaggctgaggcagaagaactcagaaggcggaggttgcagtgaccgagttttctccatcaaatagggaccttgcctttccgtaagtgaaactccttctcaaaaaa

SEQ ID NO: 614462 - DNA, 415 bp, Homo sapiens
ttgtgctacaggccaagccccatatgctgcatgagtgctccacagatgagacttcctgggtggcctctcctcagcatagcctagcaccatgtacactagagagaggtctagtctaatgtgtgtcccatgggcacaatgtaggcctctgcgtgagcctggtgtcctggtagctgggaacaaggtagatatgtgctgctcacaggtccagcttaaggacaagtgggacagttagggcaggtatccttgcctgtgtatgacaagtcagccaagtttcaagcagatagcagacctagagactgctcaggtcctgtgggagcgtacagtcttcccagtcagtcatatgcaagtgtgactctctcctcagtacgtctcaagagtgtgtggacgcacatgaggctagcatcgcctatttccc

SEQ ID NO: 614463 - DNA, 325 bp, Homo sapiens
tgcgagttgtcagtacaatgaaatcaaactgtgtgagatggcagcagattcatctctgggaggtggtccagtgtctatgagttagcacgtcggatctgtggctgatcaccccagacttgttgagcctggctgtgaggttcacaaaaagattcccagcgtctggtggtcctcaatgatttcacattcggcaatgtaaccagtgcttcatcatcgggggtgagaacacggacgatgactttggagcacgggctaataagcacctggcgtttggctctcttttcggcattgttgatactcttgagagcatctgccacgacattcatgc

SEQ ID NO: 614464 - DNA, 550 bp, Homo sapiens
agctgctgacagtggtggtaataggatagtatccctatatccatagacccgacctgtgtctatagaggggtccgaggaataccagcgtaagcctctagcagcccatggttaaacggatgctgtatgagcacttggccacaattaacaggcttgatttaacggcattgtgtggtttttcacatcacttgggaagtggatgtcccccttcaggagagattataataccctacgggaagccctagttattagggatgataatgacaaaccctgcttggggtctgcataagtgggggttggcaatatcgtccagcaagaatgggttggtgcaatcccttgccaggtggccctgttgacagacggctgtctgggcatgggtagagggcacactgcgacattccctagccattcaaattcacggaagggggagcaacaggttcccactaccttttcctttcccatctaagtgatatatcaggtgcatgcggaatttggaggagctcagagaaccgataccttgaatgcctttacggtctcatagattaaacaatgg

SEQ ID NO: 614465 - DNA, 275 bp, Homo sapiens
tgtccaggtggtactttggctctttggctaaactaaccttctctgtccaactgtgccacactagaacctgaaggggaacgaaatagcttggcttgcgcactcttcatggggacactcgaggtcgggcatcacaagtgtaatgaataccttactgcatttatttgctttctgttccagttcttacactgtcgctatcttttcgagaaagtcagattcttgcatccctgactgggatccaccacgtcttaaatacaattttttgattggacaaaatg

SEQ ID NO: 614466 - DNA, 376 bp, Homo sapiens
ctagaggatccccccgcagctgggctctggcccggcagctgggcttggccatagtagctattgaaggatttgagtgtttatcctaatgattgcagctaatactcacatgcgcaacagctgctctaacatgccttccagtgatgttatcgcatgtaatccttccagcatcactaaggtagggacgatttttatccccattttacagatgagaaaactgaggcacaggaagtcttagaaatataccaagatcatattattaataagctatagaagccgaatttagacctgggcggtctagttccattatccacactcatccatcacaccacactggctttcagagcactcatgtgcccttgaagtgctgcgatggaaa

SEQ ID NO: 614467 - DNA, 274 bp, Homo sapiens
atgcccttccctgccctgtctccgccgttcttcccccacccctgccccatggaccaagttcgtgcagtgcccacatggggagctccagaaacgcaaggaggtggtgcacaccgcgtccctgcacaagatcggcgacatcagctcttgcgcccatggcttactggcgctcttctcatgtgacacaggggagatcaagtgagaagtccgtgagcatatcaatgcctaggtggctgactggctgcgaggagggcacggcggagaccatccctggagt

SEQ ID NO: 614468 - DNA, 472 bp, Homo sapiens
gtctggagccagaatgttatcaattttgataacataatgtcatatgagatcctggaacagtaaaatacattaggcaaaactaaggcaatctgaataaactatagactttagttaatactaatggatcgatattatttcattaattgtgacaaacgtaccaccccaatgtcagatgtcattaatattaggagtaactgagcgtggggtatacagcagctctctgcactatcttctcaattttttctgcaactctaaaactattctaaggccaggtgtggtggctcatgcctgcaatcccaacattttgggaggctgaggtgagtacatcgcttgagctcaggaatctgagaccagctagggcaatatagcgagacctcgtctctacaagaaaaaaaacaactggccgggcatggtggctcacgcctgcaatcccagcatagggcacatagtgagacctcgtctccataaaata

SEQ ID NO: 614469 - DNA, 991 bp, Homo sapiens
  misc_feature (425)..(425): n is a, c, g, or t
ggctccgatgtacctggtatcctgactgcttctggcgttgaaacccgtggcgccgctcagatgccgtgctaaccactcttctctcatggatcctgatagactaaaactacatatgtgaaacatgtggaactgatttgcctgatgcaagcaagtcaatgcaagggacctgcccccagagagacaaagtgatacagatattgtggatgaagccatctataacgtatcaaggaccgaagtagtcttcattcaaggaactatgaaattcaagaatgagagctagatcgtgaccttgtctatatataactctctacatttctgattgtctgagtgaaactgctaaaagtgcaatgccgaaaagccacaggtgagaatagaccatgtatcacgctgtgaatcactaattttcccattcctggagagcctgngttttccacttaagcgcaatttatgccaatggctgcaatcgaacaggaagatgaagtgatgagagcctatttacaacagctaatggcaagagactgggactgagagctttgtgatgaaagttttcgaccctcaaggaatgatgaatctcgcatcaagtggtggacttgcttgtgaagagacagttccatgaacaagagtctttcaggacctggacatgtgaagggagccgggggaccgaacgtctccggagccgtggtgtcagccagttttcccagcatgatgtacacctagtcttcggccttgatgtcgtagagttaattccgcacatagaagagctgtttttacttgcacactctgaacagaattggtcggggacacgaacgtggtttcagggtggtgaatttcggaaatataggcgggctatccaaacgtggctaccacttctctcccgaaaaaaaaagccgcgcgccttttcggcggcaacggtcaagcctggatcacgctgccccctcgcaagggatccgcccagcgcaacgacgccgtagaaacacccactgtcgtctga

SEQ ID NO: 614470 - DNA, 366 bp, Homo sapiens
agagtcaaggctagcagctgcgctatgatcttaaaagaaaaaaaaaaaagaaagaaaaaaaaacaaagccgagaagtagtcaaacaaaagttaagaaaatcctggtaaaataaagttaccatttatgatttgccaaactttccagcaaataatggatggtcaaatcctaaaggggggatatagtcataaaattatccaaccttgtcggggagaatcctttattcacaagagcagcctgaggaacttcactcggggacagctcgcactaacggtgtcatttgtagggctgggataacccacgatggctacgctcttacgcagtttgtccaagttcttgtacccccacgctccgacttacccatgtat

SEQ ID NO: 614471 - DNA, 552 bp, Homo sapiens
  misc_feature (36)..(36): n is a, c, g, or t
  misc_feature (190)..(190): n is a, c, g, or t
  misc_feature (220)..(220): n is a, c, g, or t
  misc_feature (254)..(254): n is a, c, g, or t
  misc_feature (258)..(258): n is a, c, g, or t
  misc_feature (269)..(269): n is a, c, g, or t
  misc_feature (277)..(277): n is a, c, g, or t
  misc_feature (282)..(282): n is a, c, g, or t
  misc_feature (294)..(295): n is a, c, g, or t
  misc_feature (297)..(297): n is a, c, g, or t
  misc_feature (303)..(303): n is a, c, g, or t
  misc_feature (309)..(309): n is a, c, g, or t
  misc_feature (313)..(313): n is a, c, g, or t
  misc_feature (316)..(317): n is a, c, g, or t
  misc_feature (323)..(323): n is a, c, g, or t
  misc_feature (326)..(327): n is a, c, g, or t
  misc_feature (330)..(330): n is a, c, g, or t
  misc_feature (338)..(338): n is a, c, g, or t
  misc_feature (341)..(342): n is a, c, g, or t
  misc_feature (344)..(344): n is a, c, g, or t
  misc_feature (346)..(348): n is a, c, g, or t
  misc_feature (354)..(354): n is a, c, g, or t
  misc_feature (356)..(358): n is a, c, g, or t
  misc_feature (362)..(363): n is a, c, g, or t
  misc_feature (369)..(369): n is a, c, g, or t
  misc_feature (373)..(373): n is a, c, g, or t
  misc_feature (375)..(379): n is a, c, g, or t
  misc_feature (382)..(382): n is a, c, g, or t
  misc_feature (385)..(385): n is a, c, g, or t
  misc_feature (398)..(398): n is a, c, g, or t
  misc_feature (403)..(403): n is a, c, g, or t
  misc_feature (406)..(406): n is a, c, g, or t
  misc_feature (426)..(426): n is a, c, g, or t
  misc_feature (430)..(430): n is a, c, g, or t
  misc_feature (434)..(434): n is a, c, g, or t
  misc_feature (436)..(436): n is a, c, g, or t
  misc_feature (441)..(441): n is a, c, g, or t
  misc_feature (459)..(461): n is a, c, g, or t
  misc_feature (467)..(467): n is a, c, g, or t
  misc_feature (486)..(486): n is a, c, g, or t
  misc_feature (488)..(488): n is a, c, g, or t
  misc_feature (494)..(495): n is a, c, g, or t
  misc_feature (497)..(497): n is a, c, g, or t
  misc_feature (503)..(504): n is a, c, g, or t
  misc_feature (508)..(508): n is a, c, g, or t
  misc_feature (530)..(531): n is a, c, g, or t
  misc_feature (545)..(545): n is a, c, g, or t
  misc_feature (549)..(549): n is a, c, g, or t
acaccatggctctgttacaatagggaaatctaagcnctacataccattgcttttctacctggacagggccccataaaagcctccaagccacgtgtagatgtgagagacatttgactatgtaacatttctatactcatagcttataatgatgccattgctccagctgtgctagggctttacaaaaactgtnccaggacttcccatgaggctggattgcttnatttatgttttatgagccccacaatactgaagcncctnttccagggacntggcatangcagngaattccacatnngngagagntcctcnctgntanntaatgntanncantgacatcnaanngncnnnatgcangnnngtannacccancggnannnnntanatnagggaaaaactanagtgngantaagaagaaaaaatatatcnaatncgcntnaaagngcatgaggcgcgccgccnnntgcgtntggtaagcgtgcagaaggncngggctnntntggatnnatcnagagcgtccccgagccctcctnngccaccccccagcnacgncgc

SEQ ID NO: 614472 - DNA, 375 bp, Homo sapiens
ctgcaggaatcggcacgagctctctctctctctctctctctctctctctctctctctctctctctctctatatctatctcactctaccactagacatctctagctatatcattcacccaaataaagtatacgcgatagacattgagacctgacgcaatagatatagcaccgcacgggaaagatgaataagcataaccaagcataatatagcaaggactaacccctataccttcggcatagagaattaactagaaataactatgcaaggagagccacagctaagacccccgaaaccagacgagctacctaagaacagctcgacccgaccgagcctggcgatagctggatgtccaagatagaatcttagatcactct

SEQ ID NO: 614473 - DNA, 131 bp, Homo sapiens
tgtgcatgcatgatacatagcaacagttcaagccaacaatccagcacacttcaccttttcttccccggtatctctttgtaaactatatcttttttgcatggaaaccgggaggctacatcgtctcaaggatt

SEQ ID NO: 614474 - DNA, 684 bp, Homo sapiens
ctttacgagaatttttatcgatcactcctgtttttacttgtcacccttttaaatttaaactagacctgcctagaagtagtcctatcgtcctcattggcaagggtccacagactcctgttggacttttttgtgggggttccccaggcagaaggctcacagcttttgtgcagcataaatctactgcagcactaccagctgtggcaggggacagacattgtacaggggtgagggaatggcctgatctggaaatgccccagtttggaatgggtcccaggacgggcccctcatggcgtttcccgaaatgaggttcccatctttatcagacttagagtgacactgattagcccagtgttttccttttttacattttggacatatttcaggcttagcagttttcttttttcccctacctggtggcctgactcgctgattttttctacattcttttttagtatgaccatgcttcccatagttcaagctccaggaaaccgagtatttcctttactcactttcagtcctgctatagcctgtgccaacaaagtagctttatgcagattgcctctgatactgtcacaggccttgatataatcaactaaatgtgcttttcttttaataggtcgcaaagcagcccttgcaattgggattagccatgttgggttattatgggcacgatttctgagcgtt

SEQ ID NO: 614475 - DNA, 605 bp, Homo sapiens
gggtgttctagaggatcccgtctgccagttatgccaagatactttccagatattaacaggacgtcagtaactgtgtaaaagttaaccaccaaaaccgatgtgttaaagaaaataatgtgtagatgtaagactaatgtcttggggacattactaaatgtatttctaaaaaaacccttctcaaatgtagaagtattggcaattctaatttaaaaattttaaatttttaattataggaaatttaagtagcaatagtttcaagagctaagaatcagatgcttttaaaacagaattttttttttttcccgtgagggaccatactgacaactccagtaaacataatacccacccaaatcccgaataaaatgctttatgtaacccgggaatagtaaaattataaaagggtattcctaaattataatatatatacataaggcaccattttaacggtcacatttaccagcagaataatgaaatcaaaaacaaatcctacatccaggggacaaacgataaaggctctttcatggtgtaaagagtccataccattcttggtggtgttctactcccatattttaaatttatgaccaagggagcctgagggccaagtc

SEQ ID NO: 614476 - DNA, 343 bp, Homo sapiens
  misc_feature (70)..(70): n is a, c, g, or t
  misc_feature (103)..(103): n is a, c, g, or t
  misc_feature (114)..(114): n is a, c, g, or t
  misc_feature (228)..(228): n is a, c, g, or t
aaaaaccccaatggaaaggtccccaaaaccttccctaaggcggtaaatagatatcctgacttgtgtccanaggttatagtagccccccttttatctgcagggnaatacattccnaagaaccccaagtggacgcttgaaacccatggatagtactgaaccctatggatactgttttttttccctatcccatacctacgataaaggtatgataaataatacactttaagncctggcacggtgctcatgcctgtaatcctagcactttgggaggccgaggcaggcggatcatgaggtaggagtttgagaccaccctggccaacatggtgaaaccccatctctacta

SEQ ID NO: 614477 - DNA, 315 bp, Homo sapiens
gcgtcgacccagtgtctatagtaggtctcctaatgtttctaagggccagacatggtggctcatgcctgtaatcccagcactttgggaggctgaggcaagccaatcgcttgagcccaggagtttgagacctgactgggcaacatggcgaaatcccacctctaccaaaaatacaaaaatcagctgggcatgatggggctgcatctgtagtcccagctgttcagaggctgaggtaggaggatcctgtgggtccagacattgaggcttcagtgagccatgattgcgcctctgcgctccagcccaggtgacagagcgaga

SEQ ID NO: 614478 - DNA, 438 bp, Homo sapiens
ctctttcccttcggcgtgccactgaagatcctggtgtcgccatggtccgccgcgctgcccgttgttaccggaattgtaagaacaagccgtacccaaagtctcacttatgccgaggagtccctgatgccaagattcacatttttgacctggagcggaaaaaggcataagtggatgactatccgctttgtggccacatggtgtcagatgaatataagcagctgtcctctgaagccctggaggatgcccgaatatgtgccaataagtacatggtagctgtggcaaagatggctatcatatccggtggcggctccaccccttgcacgtgatgcgcattaacaagatgttgaactgtgctggcgctgacaggcgtcagacaggcatgcgaggtgcctatgtgtcccagggcactagtgacagggttcacattggacgatatct

SEQ ID NO: 614479 - DNA, 296 bp, Homo sapiens
tcccctcccccctccaatttagccccccccctttcttttttgggtgggtgggtttgggaattcccccccctcccccccaagccccccctttttggggggggcctgtggctttttcctgttgggggttccccaaaggggggggggccccccccccgggcccttttttggcccatggggccgggtgaaccctttttggccccttcccccttgggtttttttcccttcccaaggggcggcccccctttccccccccccccccccccttttttcaataaaatttggggggtggggggcca

SEQ ID NO: 614480 - DNA, 115 bp, Homo sapiens
cgctgactctagaggatacacggcagcccacgcaaagacggttttattgaattagttgcatgcaggagcaattctgatcttcccatgagcagcagagtcgagtgttagagtgcag

SEQ ID NO: 614481 - DNA, 228 bp, Homo sapiens
tggtacctgtttgcagcctgtgaggcgggtggttcacaatggtcaagatcgagactgagggctgggcacgatggctcatgcctgaatcccagcactttgggagtccgaggtgggcagatcatgaggtcaggagttcgagaccagcctgaccaacatgatgaaaccccatctctactaaaaatacaaaaattagccgggcgtggtggcaggcgcctgtaatcccagcta

SEQ ID NO: 614482 - DNA, 398 bp, Homo sapiens
gagaaggagcacacgacctcgtatgtttgacacgtgcgaggagatacgcttccgggtggtggacgagagctttgttgaactgtccccacaggtccatgctcatgagatgccaccacttcagtgaggagctgcaaagaaggaggctccgtacacgcttgtgggatccatcagtgagccagtgctgggccttctctcctggtggaccagcaactagccctggtggctggacagttggaacctaaccagcctgcgggaaaggtggtatggcctgcctgtgacagcacaaacagcagctgacggcgatgctaaggagatacgtgtctcgagcttgacagtgaggcaaggccaggaggtgcccaccagattgcccctggtcctccaccatctaggccctgctc

SEQ ID NO: 614483 - DNA, 271 bp, Homo sapiens
  misc_feature (98)..(98): n is a, c, g, or t
gggcccagtcttttcccaagtccacacaggggaggggaaagcattgcttttgggtaaattatgtaaagcaaaatttttttaatcttgccccaaaaaanttttttattttgttttaatttagaaagaagagccttggggcccccccttcccccttttttgtcccccaacttaaaaggtaaaaagggttttggtttccctgggaggggggggaggaaaccagggtttccttgtaccttgatttgagaccagttgaaaaaaagggcccccctta

SEQ ID NO: 614484 - DNA, 127 bp, Homo sapiens
gcatagcataaacttaaaatttacagtcagaggttcaatacctcttcttaacaacatacccatggccaacctcctactacctcattgtacccattctaatcgcaatggaattcctaatgcttaccag

SEQ ID NO: 614485 - DNA, 104 bp, Homo sapiens
gcacagagcgagctcttgcagcctccccgcccctccggcacgcgctgcgaccccagagattcccccgcttgcgctctgccccgcacatggccgcacagggagga

SEQ ID NO: 614486 - DNA, 284 bp, Homo sapiens
  misc_feature (98)..(98): n is a, c, g, or t
  misc_feature (134)..(134): n is a, c, g, or t
tttttaacctttttttaaccccctaaaattaagctctttctacttgggcacctatcccccgcgggtttgggacccaatgggcgggagggcccagattncgggtttaaaaaattcccccttgggctccaaaattnccccttggggggaattttttaccttaagggggtcccccaaaaatttgcggttctttaacccagccctttgttaatccggtaaaaccagaaaacttgggggccttttttaaaaggttccaattgaatagtttaaaaggttttttaatgcta

SEQ ID NO: 614487 - DNA, 688 bp, Homo sapiens
ggacggagtgtatggatgagcatgattgtatgtactgtccgtctggcttcgtagaattgatattacatctgtccaggaggtactagggctctgaagtataactcagtactgtcttgagctgtacatgctcgaatcggcagcgattttacaagcaatattacaaggatggtcatgagctagcccaataatgagttacgatggtggattacttatgacgttgatgcagtgcaagggaatgtatatcgcagctcaacacttcgagacgctgtctttgatgctactgtatcagcactatgctatgtacgaatttatacgaccgcatgagctactgtgtaactaccatgatgaggcctagatgtaacctgtgcaatgatcagattctcaaagacctgctcgagacagattatcctaatatttccaagatacagagatgagagaaccttatagagcctgacttgtgatactgatgatcactacacgcacatcacgttgatgctacctcaatgagtagaataatatcagtacgacgtcaatacttctcggagacattgctcccgtacagcacattgctgtattgaatgacaatggactcttttaggaagtcactgaaagtgcctgattctttgctagtcttaatatgatcatacatgtgaacctactgcaagtcaggtctggtatagctatggct

SEQ ID NO: 614488 - DNA, 940 bp, Homo sapiens
  misc_feature (869)..(869): n is a, c, g, or t
  misc_feature (940)..(940): n is a, c, g, or t
accacccgtccgaagtaaacacacaacaaacaaaaccctataggggacttccctgtaatgctgcgctgaggaacgtggcacaagtgccatcgtaggggtacctcctgtttcccaaaacctctcaatgaaccctatgctgctactgactggacgcacctggaagggagctattcttggtggctataaaagtaaagaatgtgacccaaaacttgcggctgattttatggctaagaagttttcattggatgcattaataacccatgttttattttttgaaaaaaaaatgaaggatttgacctgcttcactctgggcaatagatccgcaccattctgatgttttgcgacaatacaaacgtcttcccttgcagctaacttaagactcctataccctacatagatatggaagaaaaactggcaactaacattaatccacgtcaccacaatcgtattcaatatattacattcggcggacttccaaagaactgcacaaaacgtacatctatttctaacggaattgtccaaatatcaatagaaatataaataatgtactcacactccacacaagtaaccacaagattctcgtggtctcaaactcggccactctcgcccgaccacgttattccagattcaccacagaaccgattgttatataatatcatgatacctcacgcgctcgtcgacttgtcttgctgtctcctgctctggtccgtcgatgcctgtgctcgtttgcccttgccgcactccgccctgtatccccttccgcaatgttcagcgcatagacatcatcctcgtatgtgattctatctctgacatatgcccggattccaccccgcttacacgatacacatttctccggctcctccatcctncacattgtctgtttatctcactgtcaccctatcttccttctctcctcgcgcaacatgctacttactcatan

SEQ ID NO: 614489 - DNA, 1836 bp, Homo sapiens
  misc_feature (1527)..(1527): n is a, c, g, or t
  misc_feature (1807)..(1807): n is a, c, g, or t
ggccctgtcgcggcccacaaaggtaagatcgcttaagaacatccggaaggactgcaatgccacatcattatgatccggagggaagtcgggtctggtccaaaggaacacgggcgagatcgtacggtgccgcctaagaatggcgcgaggactggtaggccagaagaatatgacgccacctttaatggtctggatatactgatgcatacctctgcaggaatcgctgagagcatgggctgatggagacacgactaatgacatggatcgcatgtgtatgtccataggtgtagtcgccgtatctcccagttagggagtcctagtaacatgattcttatccgcgatggaatttgacacgtttcactgtgagctccgcggtcgcatttgatagactcgtgggtaccgcctcttgatgggtccagacaacgcaacgataccagaggaagtcatttgagagaaggccctgtacgcgaagcatacatccggagactagcccagtgcagtatgccattcgacaccacatgcgagcaacaagtcgatgataaccaagggtagatagggtagatgcgcggcatagagttaccactcaatctaggaatctgcgacggaaccgttgtgatgagactcttctccattagagggtgtcccctggagttaggaatgtaccccgtggccacggtatcaggctccttgcagtgggcaattgacagaattgcacaaggcgaggaaactccgggaaattttagcacagagacattgattacccaaggtgcgcccgcgtgacctaatttggggcgcggtccggaaaaagcgatagcaagggtttgggggattaccaaccggaaccccaattcgctttcccacacaattgacaaaactaactcttgggtgcgatgggagccgttgccacctattctccttttcccttggggcagaatctccttgggaacaccttaacaccaaacgctaattcacctcatcctgttgcctgaggccaaagaagaggccttatctcaatccggattccaccataggtcatttggcactaccccccccgggcaccacaataattcgagaatccctgccaagggtacgcttccacaaacgcgggttatcagtatcggttcaaagtttgggttcattaacacaaaccgcacgaacggaaaagacacctagatagctccaagcgcaccggtgtgtgtagtttgcacactttttccgttgtgtggcacgcccttatatcgaagggaacaggcaaagcgatccggtggtaccccctttagtcgccacacgtggagtggtacattgtgctcactttgatgtcactcgtcgtgtcaggggtatccctctatggctgcattggggggtgccacccggggggaaagtggtgatagagaccaccaccccacaaccgaaagaaaatttatcgccgcaaaggaagcgccactgtttagccccagtccttgaacaacccgagtggtgtgtgtggaccacccataggggtggggggaacacattcctccccaggtcgangtggagacaaaaaccccgccaatgatgtggaggaaacccccgaacagcagcccgcggtgtgggatattgggtggaggcaacgaccacacgccgcccagggacaggagaacacacgagaagcgacggtcagcaatcgacacgacagctagcgatcacgaacgtgcgaacgcgtccagctcgaccatagggagaagacagtcgcagaccaggggtgacgaagacagatccgcgattggagatgtcgatgcggaaacatcgacagaaggtagaacgcagcganaacacggagaacaggccggaagacagaac

SEQ ID NO: 614490 - DNA, 867 bp, Homo sapiens
  misc_feature (38)..(38): n is a, c, g, or t
  misc_feature (68)..(68): n is a, c, g, or t
  misc_feature (353)..(353): n is a, c, g, or t
  misc_feature (360)..(360): n is a, c, g, or t
  misc_feature (373)..(373): n is a, c, g, or t
  misc_feature (378)..(379): n is a, c, g, or t
  misc_feature (400)..(400): n is a, c, g, or t
  misc_feature (421)..(422): n is a, c, g, or t
  misc_feature (433)..(433): n is a, c, g, or t
  misc_feature (440)..(440): n is a, c, g, or t
  misc_feature (448)..(448): n is a, c, g, or t
  misc_feature (459)..(460): n is a, c, g, or t
  misc_feature (467)..(467): n is a, c, g, or t
  misc_feature (767)..(767): n is a, c, g, or t
  misc_feature (829)..(829): n is a, c, g, or t
tctggcaccatttttacaacttcctcatcacccaacgntgaggcatacgctgaggagtttgcaacganacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaanaatgtcnctgtgaaaataanaactnncatttttttccaggctggttnggatttggggtggagtgtttnntttttttcccnttttttntttttttnttttttttttnnttttttnttttttttttttttttaaagtggtattttatctttgattctccttcagccctcacccctggttctcatctttcttgatcaacatcttttcttgcctctgtccccttctttcattttttagctcccctccaacctggggggcagtggtgtggaaaagccacaggcctgagatttcatttgctctccttcctggagcccagaggagggcagcagaagggggtggtgtttccaaccccccagcactgaggaagaacggggcttttttcatttcacccctccctttttcccctgcccccaggantgggccacttttgggtggggcagtgggtcccagattggctccccctgagaatgtaagaactncaaacaaaatttttattaaattaaattttgtgtcccca

SEQ ID NO: 614491 - DNA, 304 bp, Homo sapiens
agagttcgagaccagcctgaacaacataggaaaaccgtgtctctaaaaaaacaaattttaaatcagctgggtgtggtggtgcatgcctgtggtcccaggagaggctgaggtgtgagatgggaagattacttgagcccaggaactcaaagctgcagtgagccatgattgtactactacactccagcctgagcgacaaagcaagaccctgaaaaaaaggaaggaagttagaaaggaagccagcttggaaggaaggaaggaaggaattctaagcatctattgaccttttttgggaggggagtatgtg

SEQ ID NO: 614492 - DNA, 194 bp, Homo sapiens
acagaggtatccaggctgaccccagtgaaaagcgagatctcgtaggccttctcgatgcagccagagatctcatccctgatagtgtcgagcaggatgtcaatgaagaaggtgtaactactcggcggggatgttacccttgcgccaggaacacttatgttgtagctgccctccatacaggtatttgctacagcgct

SEQ ID NO: 614493 - DNA, 870 bp, Homo sapiens
  misc_feature (38)..(38): n is a, c, g, or t
  misc_feature (68)..(68): n is a, c, g, or t
  misc_feature (312)..(312): n is a, c, g, or t
  misc_feature (319)..(319): n is a, c, g, or t
  misc_feature (414)..(414): n is a, c, g, or t
  misc_feature (418)..(426): n is a, c, g, or t
  misc_feature (443)..(443): n is a, c, g, or t
  misc_feature (451)..(451): n is a, c, g, or t
  misc_feature (462)..(463): n is a, c, g, or t
  misc_feature (470)..(470): n is a, c, g, or t
  misc_feature (770)..(770): n is a, c, g, or t
  misc_feature (832)..(832): n is a, c, g, or t
tctggcaccatttttacaacttcctcatcacccaacgntgaggcatacgctgaggagtttgcaacganacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctaaaanaaagccnaagagaatcataaaaaaaaaaaaaaaaaaaaaaaaaaaaaaaaaaaaaaaaaaaaaaaaaaaaaaaaaaaaaaaaaaaaaaaaaaaaaaaaaaanaaannnnnnnnnttttttttttttttttntttttttnttttttttttnnttttttnttttttttttttttttaaagtggtattttatctttgattctccttcagccctcacccctggttctcatctttcttgatcaacatcttttcttgcctctgtccccttctttcattttttagctcccctccaacctggggggcagtggtgtggaaaagccacaggcctgagatttcatttgctctccttcctggagcccagaggagggcagcagaagggggtggtgtttccaaccccccagcactgaggaagaacggggcttttttcatttcacccctccctttttcccctgcccccaggantgggccacttttgggtggggcagtgggtcccagattggctccccctgagaatgtaagaactncaaacaaaatttttattaaattaaattttgtgtcccca

SEQ ID NO: 614494 - DNA, 757 bp, Homo sapiens
cgctgtggctcactcctgtaatcccagcactttgggaggccgaggcgggtggatcacgaggtcagcagttcaagaccagtctgaccaacatggtgaaaccccgtctctactaaaaatacaaaaattagctgggtatggtggcaggtgcctgtaatcccagctactcaggaggctgaggcagagaactgcttgaacctgggaggcggaggttgcagtgagccgagattgcgccactgcactccagcctgggcgacagagcgagactccatctcaaataaataaataaataaataaataactaataaataagtaaaatggctaaaatggaccgggcatggtgactcatacttgtaatcccagcactatgagaggccgaggtgggcagatcacctgaggtcaggagtttgagaccagcctggcaacatggtgaaaccccgtctctactaaagatctacccacttagctgggagtggtggtgggtgcctgtaaacccagctactcaagaggctgaggcaggagaattgcttgaacccaggaggccagaggttgcagtgaggccgagactgcaccattgcactccagcattgagttggcaagggcgaaaaaagtcctgtcccaaagaatatatccacataataagtcaatagctttttgcggccaatgtttccacccatttataaaaccctccttttcctttatttccagacaaactctccgcctttaccaccactttttgagatgacatcctgctcccatg

SEQ ID NO: 614495 - DNA, 202 bp, Homo sapiens
caacggatgtgccgctccgagcacaacgagttcgttctagtccacgacggccgccaggtgcagctactgaggtgcgagcgaagcgagccgcgaaggactccatacgtgtctcacccggcccttcgtggctcgtcgctaacgctcctcgcacctcagggaccagttgggtctgtattcggatcagggagcggcacatgcgttg

SEQ ID NO: 614496 - DNA, 862 bp, Homo sapiens
  misc_feature (38)..(38): n is a, c, g, or t
  misc_feature (68)..(68): n is a, c, g, or t
  misc_feature (353)..(353): n is a, c, g, or t
  misc_feature (360)..(360): n is a, c, g, or t
  misc_feature (373)..(373): n is a, c, g, or t
  misc_feature (378)..(379): n is a, c, g, or t
  misc_feature (389)..(390): n is a, c, g, or t
  misc_feature (394)..(394): n is a, c, g, or t
  misc_feature (397)..(397): n is a, c, g, or t
  misc_feature (402)..(402): n is a, c, g, or t
  misc_feature (419)..(419): n is a, c, g, or t
  misc_feature (432)..(432): n is a, c, g, or t
  misc_feature (436)..(437): n is a, c, g, or t
  misc_feature (762)..(762): n is a, c, g, or t
  misc_feature (824)..(824): n is a, c, g, or t
tctggcaccatttttacaacttcctcatcacccaacgntgaggcatacgctgaggagtttgcaacganacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaanaatgtcnctgtgaaaataanaactnncattttttannaaanaanccccnaattgggaaaaaaaaangttttcccccccncctnnactctcccccaccccccccccgcccttttttttttttttttaaagtggtattttatctttgattctccttcagccctcacccctggttctcatctttcttgatcaacatcttttcttgcctctgtccccttctttcattttttagctcccctccaacctggggggcagtggtgtggaaaagccacaggcctgagatttcatttgctctccttcctggagcccagaggagggcagcagaagggggtggtgtttccaaccccccagcactgaggaagaacggggcttttttcatttcacccctccctttttcccctgcccccaggantgggccacttttgggtggggcagtgggtcccagattggctccccctgagaatgtaagaactncaaacaaaatttttattaaattaaattttgtgtcccca

SEQ ID NO: 614497 - DNA, 1324 bp, Homo sapiens
  misc_feature (38)..(38): n is a, c, g, or t
  misc_feature (68)..(68): n is a, c, g, or t
  misc_feature (353)..(353): n is a, c, g, or t
  misc_feature (360)..(360): n is a, c, g, or t
  misc_feature (373)..(373): n is a, c, g, or t
  misc_feature (378)..(379): n is a, c, g, or t
  misc_feature (400)..(400): n is a, c, g, or t
  misc_feature (421)..(422): n is a, c, g, or t
  misc_feature (433)..(433): n is a, c, g, or t
  misc_feature (440)..(440): n is a, c, g, or t
  misc_feature (448)..(448): n is a, c, g, or t
  misc_feature (459)..(460): n is a, c, g, or t
  misc_feature (467)..(467): n is a, c, g, or t
  misc_feature (767)..(767): n is a, c, g, or t
  misc_feature (829)..(829): n is a, c, g, or t
  misc_feature (1324)..(1324): n is a, c, g, or t
tctggcaccatttttacaacttcctcatcacccaacgntgaggcatacgctgaggagtttgcaacganacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaanaatgtcnctgtgaaaataanaactnncatttttttccaggctggttnggatttggggtggagtgtttnntttttttcccnttttttntttttttnttttttttttnnttttttnttttttttttttttttaaagtggtattttatctttgattctccttcagccctcacccctggttctcatctttcttgatcaacatcttttcttgcctctgtccccttctttcattttttagctcccctccaacctggggggcagtggtgtggaaaagccacaggcctgagatttcatttgctctccttcctggagcccagaggagggcagcagaagggggtggtgtttccaaccccccagcactgaggaagaacggggcttttttcatttcacccctccctttttcccctgcccccaggantgggccacttttgggtggggcagtgggtcccagattggctccccctgagaatgtaagaactncaaacaaaatttttattaaattaaattttgtgtccccaaaaaaaaaaaaaaaaaaaaaaaaaaaaaaaaaaaaaaaaaaaaaacaaaaaaaaaaaaaaaaaaaaaacacacaaaacacaacaaaaaaaaacaaaaacaacaaaaaaaaaaaaaaatatatgggcgaccccccccaatgccatttttataaacaaagatggggagggggcggggacgaacgcaagagaagaggacgcggagaaagaagaagaataagaacgaaggcgcagggagagagaaaatgggggggggagcaacactaaaaaaaaaaaagcacagagggggggaacaaaaaaagaaagagaagagataaaaaaaaaaaaccaaataaagcgataagaagtaaaacgaaccaacacaacagatgagaggaattaccaacacaagagacaagcaacacaacaggcacaccacacataaaaataacaaacacccccccgaggagacggggagaan

SEQ ID NO: 614498 - DNA, 158 bp, Homo sapiens
gtctgtttgacactaatacttaccgagtcagactttgtgttcatttcatttcagggttttggctgcctgtggcttcccaggtggcctggaggtgggcaagggaagtaacagcacagtgttgtccaaggatggttttgggacttagaggtccatggtgg

SEQ ID NO: 614499 - DNA, 106 bp, Homo sapiens
attttaaagcctccctgtgctcctctgtgctgtccacctcctctgtgctgtccacctcctctgtgctggccactcctctgtgctgtccactcctctgtgctgtcca

SEQ ID NO: 614500 - DNA, 109 bp, Homo sapiens
ctttttaaaattttttttaaatttttttccccccgggggccaaaattggggggggggggttttaaggggtcccggcctttgttttttttaaaaaaaaagaaattaccca

SEQ ID NO: 614501 - DNA, 551 bp, Homo sapiens
  misc_feature (26)..(26): n is a, c, g, or t
tctgctcatatttgaagcccattgtntttttaagcttgctggatgaataaaggaaagaaggtttatatacactaataatagaaatgttttgggatggttcatgatttcgaaaagcttcagagaaaataaagatgcttaatgttagagtacaaaacatgttttccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaatcatcaccaaaccagactcactgaaatgccaacactggcatgtgcgcagacattttctattctggacttacttctaaacagcaatgccaacaagcatgagaggtgaaaaaatgtggataaatacatgtttggtttattgaactaggtcttatcatatccaaattaaaaacaaaaggcacatctcaatttcaaa

SEQ ID NO: 614502 - DNA, 3173 bp, Homo sapiens
  misc_feature (26)..(26): n is a, c, g, or t
tctgctcatatttgaagcccattgtntttttaagcttgctggatgaataaaggaaagaaggtttatatacactaataatagaaatgttttgggatggttcatgatttcgaaaagcttcagagaaaataaagatgcttaatgttagagtacaaaacatgttttccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagctctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacaccttcccagagtcatcctcaggtgatgccttcccagagtcaacctcctgtgacgccctcccagagtcatcctcagttgacgccttcccagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccagcctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaatatatcttataaatgttaaaa

SEQ ID NO: 614503 - DNA, 3183 bp, Homo sapiens
agcggaataaaagctctcctgatggcctgttcctgcacatttcctgaggacgccctcgatcacaagcaggttagagtacaaaacatgttttccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagctctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacaccttcccagagtcatcctcaggtgatgccttcccagagtcaacctcctgtgacgccctcccagagtcatcctcagttgacgccttcccagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccagcctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaatatatcttataaatgttaaaa

SEQ ID NO: 614504 - DNA, 191 bp, Homo sapiens
gtaccacccaagtattgactcacccatcaacaacccgcctaatgtaatttccgtacattaactgccaagccaaccatgaaatattgtacagtacccataaataacttgaaccacctcgtaagtaacataaaaaacccccaattccacatcaaaaacccccctcccccatagcttaccagagcagagtacca

SEQ ID NO: 614505 - DNA, 2814 bp, Homo sapiens
  misc_feature (2756)..(2756): n is a, c, g, or t
agcggaataaaagctctcctgatggcctgttcctgcacatttcctgaggacgccctcgatcacaagcaggttagagtacaaaacatgttttccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagctctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtngaccttcgaatatgtgaggatggtggagaggagacggtgtacaccctcccaaatcaac

SEQ ID NO: 614506 - DNA, 848 bp, Homo sapiens
gccccgggcacatgtgcccaggcctgggtggaggactggtccagcctccctgagctgcaggatgactccagctccttggggtcctgactcagagctcagctgggcctggcccatatctgccagtgccgacctgctatggattcattcggtgtggcatgctcagcagagccagtgccgggccacccacctgcagacctacatccgccaacgggagatgaagtggtgtggagatgacctcgcactgggagaaaaccatgtcccggctggtacaagaatggtaaagatgcatgtgcctggaaaggcatcccgtctgccctgacgcgccctgatgctggaccctgttgtgtggggcccatgtgtgccagaagaacagacctggcacctatcagtgagctggcagagtgcccctggagacccacagtggatggagaccattgggcagtggacctgcacctgtcaattccctctgcactgagatgttatgtgtcgcctcagtggccacagggcagcacgggcgctcctgcaggtgctcaatggcctacaccctgtatcgacctggacgcagggctactgccaggcccagtgtgccccgtggactgcttgtgctgctccatgcacacttgcccccaagaggacggccttcatgcgatgccatgggtgcagaagtcttgatgaatgactacactacccctattgggtaacttaacgtgtgcacccccagcaattgagaaatgccatgtggcaaaggcatgggacacgcccgaagggcctgcttccaaagaggacccatggcgatgagagaggacgtgaattggcattcctagcaccagtagggacaagaggcgact

SEQ ID NO: 614507 - DNA, 530 bp, Homo sapiens
ggctaacgatgcagtctcgagcacgtatcccgtctcattacagcaaagaagtcacgtatacatacccagctacgttattaaattatctcattaattctaataatttttaaaaagacttttaggttaggccaggcatggtggctcactcctctgtaatctcagcagtttaggaggccgaggcaggtggatcacctgaggtcaggagtttgagacgagtctggccaacatggtgaaaccctgtctctactaaaaatacaaaaaaattagctgggtgtagcagcgtgcacctgtaatcccggctacttggaaggctaaggcaggagaatcgcttgagcccaggaggcagaggtgaaaccccatctctactaaaatacaaaaaaattagctgggtgtagcagcgtgcacctgtaatcccggctacttggaaggctaaggcaggagaatcgcttgagcccaggaggcggaggttgccgtgagccgagattgctccattgcactctagcctgggcaacagagcaagactccgtctc

SEQ ID NO: 614508 - DNA, 168 bp, Homo sapiens
ccccccttttgggggtgtggggggggggggggggggccccgggggtttttttttcccccccccccttttttttcccggggggggggggtttgggggcaaaatcccccccctggttccccccgggggggggggccccccccgccccttttttttccccccccccttaga

SEQ ID NO: 614509 - DNA, 221 bp, Homo sapiens
ggcgcgagctgactcttgaggatcccataaatctggaaatcgcagttgtcccgtgtcatcgaagagagtgcgtccgtatagggcctggaccctgattcttacttgtgtgacttggctagagttgggagttcccccaaagataaacgtgtcccctattttaccaggaaccaaatcctcgaacacaggcgaaagctgacgctggtcttatgtgctggcaaaag

SEQ ID NO: 614510 - DNA, 286 bp, Homo sapiens
taaggcagggtttcactcctttctcccaaactggagtccaggggtatgaggagggctaattgcaccctaaacttcctggactcaggcgattttcccactgcagcctcccaaatagctgggactataggtgtatggcccaccatgctggggaaaactttttctttttggtattttaagaaaaaacagggtttcaccatgttgcccaagctggtcttaactccggggttcaagggttctgcccaccttgaccccccaaagtgctaggctcacactgcacccggcctga

SEQ ID NO: 614511 - DNA, 561 bp, Homo sapiens
  misc_feature (55)..(55): n is a, c, g, or t
  misc_feature (153)..(153): n is a, c, g, or t
  misc_feature (532)..(532): n is a, c, g, or t
atagatcttagaaattaaatttttaagagagctaatggtaagtgaagaattttanatttaattttccatgatatagcacagcatactttttttttgcagaatcttctattttaaagggtgaatattcaaggttgcaaagtaatatgacctctnttgattcaatatttggaatactatgtcttttctatattgataggtacaattcagaaaaatttctcactctttatataattattttaataactgaagtttagtctacagtttttattcttagtcacctaactagccaacttcttattttctatggaaaacttttggagataatggcagcttttggattaaaacgttttctgttattttgcatgcaaacttatttactgtgttaacagagtagttagtcatgagaccataagaaacacctctttttcagtgtctttcattccattactgtctgcaataaataaatgtgtatttgctctgtaaaacattatgtttggaagtatatatacattgtcaaatgcttaattttagntcattaaagttttacctcacagagttaaa

SEQ ID NO: 614512 - DNA, 962 bp, Homo sapiens
ggtgtgtgtgtgagtgtgtgtgtgtgtgtgtgtgtgtgtgtgtctaaacacattatgtctgtgtcctgaaagaaaacacctttctttattaaattctctcataatacaaatttctgcttatatgttgactatcaagtctatataagcaaatttcccttatataattacacttcacatttataaactatttcccaacattttatacccattcctgaagacagctttgtgtgaaacttgtcgatactaagggtttaactcaagggcaaagccttgacgccttattacgtataagggcttataaagagaacgcatactagaagcgagggacttggaagcggtgcttgttgaagacagtaaaacacctaaaatgggagagacatgtgatagacttacaagtgtacacactgtgagagagacagtggacgttattaaacgtacggtgcagcaactgtgctgtattactatacgcacatgtagaaccagatgttctgacttcctcaagaacctcgatctcaattacattctgcattcctctttccaggaggacagggtaatgctctacacacacgatccccagacaggagtctcttaacaagcggctcataacatctatctttaccacgggactacacctgaatctacgtctaaccctggaacaaccgcatggaactacctgtgttgctccccaaaagtggccacgccaaaaatgacgtcacgtacaatctacgtccaacgttgctacgtcggaccgaaggttcttgacttaaccgagctacacttaccaccaagaaacagtcgtattacttgtgtaaaagaacctcctacattctttacaggtctctcggacaattgtactccccagcatctgtggcggaaaggcactctggttgacgccccagagagaccaaagcaccgggctggcgcaaccatcggaaaccccgcggtcctgctacaaaaaaaaa

SEQ ID NO: 614513 - DNA, 242 bp, Homo sapiens
tttttttgggggaccccccccccttttttcccctttccggggataaagggggccggcccttttttttttggggggggggtgtttttttttaggggggcgcgggccccccccctttggggggtcccccccccgtttttccctttttgttttggggggggccttttttttttttttgggccctttttttggggggggggcccccctttggggccccctttgggggggtggccccccccccccca

SEQ ID NO: 614514 - DNA, 1522 bp, Homo sapiens
gcgtgagaatcgggactgagccgggtagtacctcaaggttgagaacaacaaagcatgccacctggagatttccccgcgcaggccctctgtcgctggttgagcttcggtggaagttactggggcgtcttgtgctgccaggccgctgcatgcctggtagcaaccagaaagcaggtcctgctcgcctccgtggacatttcattagccattccatgaacgtgtactcccatttgaagggcatccgtggttgtccttgaagaccacaatacaatgccagcaacccaatgatcactctgacacccaccactgatcaaagatgtccatagactagctgagtgccctgacggggagggtgaacgtgctctttgtgagtcaaggctccgatggacctgtccctaggtcctgactctggatcgacggagcgtggcacgaacgttcctcgtctgaaactggcaacggacttcacgttgacttgcgggggccagcctagcggatagttcccactatcttcatacgtaacagcgtaatgatgaagcgggcaccgtgccacgaggtagggctgacggcgctcctgttgtcttgacaccttgtgggtactacaacgaaaacgatttgagtcggtaagagaatacttgcgacctcttgtactcccaccaacgaccgacgcgtgactcatcttccacttggggggagcaaccccgtgattaaactactgttgggcaagaggttcgcttcatccagaaggtttgcctcccacccatgaaaacacccagagttaattgggaattcggcgggcttggtcgggacactgcactacccaggcctgggttcaccccaacccaacgattgtccctgtaaccagagcggccacgcgtgagcgtaacttgtgggccttttctgctgagcgcggtgcctttcgatcacctggaatcgtcccttccaatttaagtgcgaccatttggcctaccaatagaacggtggcagacggagagtacttatgtctgcacatggccatctgtcatcattacaaccgcgtactacgtggtcacacatgtgtgtgcggtgccacaaatggtgcagaacctccaggagctacggaacccttttgtggcaaaccccggcaagcagtctataagtcattttacgcaagttggtgccaacaggaccgcgacaccttgctcgcgacgtttattctgttgccattcgcgcgcaggacatccttacaagggtagacagtaaacaagcgcattgctaactgtgccaccaaaggtgaactctgtcaccttaagtgtacaatagagcggctcgaccagtgggtacccaatgcgcacggggcgtatcaaaaccacaacacagccctaagtactcttccagtgtgttaccgtgctctagcataactcatacaggcattccctccccattttcttggaatatcacatctctactgcgggtgatcacgagttcaatggtcacccattttataaacctgaaccccagtgcctgtgtccccaagcgacgagtacaa

SEQ ID NO: 614515 - DNA, 103 bp, Homo sapiens
  misc_feature (7)..(7): n is a, c, g, or t
ctctggnatgcaagtgtctgcatgaaggtgctcagactttatgaggcactccttctacttgcgattattgatctgtctttctgtggagttcggtttcgaaaac

SEQ ID NO: 614516 - DNA, 633 bp, Homo sapiens
ggggaaagcaaaactgggctaaacttagccaatgaccactcatggagggagcatttaggccagccatagtcagaggggaatctcccagcccagttgttggaacttgaatttcagcacgccttgccactgcaggctaaattgctgtaggccctacataaacttgaaaggcagtctaagacactaggactccaattcttaggcaagtctttgtgctgagctgggctcagagccagtgaacatggtggggcacatgacctagtgagacaccagccatggcgtccgagggagtacttgtgccacccctccctcagttttgggcgcacagcttgtagcttcaaaaaagaccccctccttccgcttgagaagaggagaggtaagagtaaggaggacttttatcttacatcttggataccagctcaaccactggaggatagggcactgggcggagtcatcaggccctagcttctggatgacatatgtagacacaccctgggccagaagggaaactcctgccttgaagagaaggatccagtcctggtggcattctttacctgctgactaaagtgcccttgggccctgaggaaccagcagcaatacctagttagtacgctgtgggtcttgggtgagcttctg

SEQ ID NO: 614517 - DNA, 328 bp, Homo sapiens
  misc_feature (48)..(48): n is a, c, g, or t
gggtggagtacagtggcatgatctcggctgactgcaatctccgcctcncaggttgaagcaattctcctgcctcagcctcccgaatagatgggattacacgtgtgcacctccacaccggctaatttttgtatgtttagtagagacggggtttcactgtgttggccagactggtgtcgaaatcctgacctcaagtgatcccctgcctcagactcccaaagtgctggaattacagttgtgagccactgtgcctggccattttgtttcctttttttgtcttcttccttccctccctcccttctctccccctttccccttctgtcgtcttctc

SEQ ID NO: 614518 - DNA, 390 bp, Homo sapiens
  misc_feature (348)..(348): n is a, c, g, or t
gaagaagacaggtgtaaaggtgagaaagaggccgggcatggtggctcgcgctgtaatcccagcactgtgggaggccaaggcagatggatcatctgaagtcaagagttcgagaccagcctggccaacatggcaaaaccccgtctctactaaaaatacaaaattagccgggcgtggtggcacatgcctgtaatcccaggtactcgggaggctgatgcagcagaattgcttgaacccaagaggcggaggttgcagtgagctgagaacgtgccattgcactccagcctgggcaagagagcgagactccatctcaaaaaaaaggtgagaaagataggtgtgaacatgaggtgncaggtgtgaagataggaaaggcaggctcatgtgggggaaggg

SEQ ID NO: 614519 - DNA, 129 bp, Homo sapiens
aggctagtaacccatcccgtggcataaacccagataaagctgtagcgcatggtgctgctgtccaggctggtgtgctctctggtgctcaagatacaggtacctggtagtgcttgatgtattgtcccctta

SEQ ID NO: 614520 - DNA, 154 bp, Homo sapiens
cgggccgctgtgcaaaagttcttttgctcttccttttctctgagacgtttttcttcctgttctttaagaagtttctgccttaacagctccttttcttgcttcttgctttgagccgcagctcccgctcttcttcatcttgtatgcgtgcccgtct

SEQ ID NO: 614521 - DNA, 185 bp, Homo sapiens
ggaatcttatacttgagaaaaattgtataaatgaatatggaaaatgccatttatatcttgctcacatgtaaaaacatcatgttcataccttaataaaactgcaacttacctgtcaacatctattcagaacaatataatgcctttaaatgtgaagaatgatgtatttatctttgaatgacaatgca

SEQ ID NO: 614522 - DNA, 252 bp, Homo sapiens
  misc_feature (95)..(95): n is a, c, g, or t
  misc_feature (164)..(164): n is a, c, g, or t
  misc_feature (182)..(182): n is a, c, g, or t
  misc_feature (195)..(195): n is a, c, g, or t
  misc_feature (209)..(209): n is a, c, g, or t
  misc_feature (228)..(228): n is a, c, g, or t
gctttccgcttggacagatatcagcaggcccaagataagacatagctccagataaaagaagagacagacttggactcgcagaggctcttacttanggctgagagtctagaatggtcttactggctgaatgcagcattattagaataagatagaatgaagacatnagatcagagcagtgaacnaattcaggattangattataaatattngtgaaagcaatgcctttanaagacaatgctgtgttaaactttt

SEQ ID NO: 614523 - DNA, 533 bp, Homo sapiens
cttatggcactgtgcttgcctcggtgtccgccctagtaatatatttgttaaacgggctttgttaaaaatagctactatttctcattgtcagcccatggtaaatgatggaaatatcttccttgatgaattcattatttaacagtactcacaccatattaattttaataattaatataggtatatgaattatggactatgacttctaatatctagcatacatttttagataaaaatataatatctagataaattggaatgacctctttatagtattaattttactatttccacgtattctatagataattttttaaagtgagagcttggaaagaagacaaaatgattcatattaatctttcttagagagtgaatcagcctcctccttgtgcatatttaaagaaaacttactaaatgtggaaattgatgtgttgtcaggactaggtatgcatcaaaccctatgtatgcatcagaaacagtggcatctagcatcgtctttgagatctatgcatggaactgcctcgtaagggcatatt

SEQ ID NO: 614524 - DNA, 134 bp, Homo sapiens
  misc_feature (20)..(20): n is a, c, g, or t
cacggcctataccactcgtnaattctcatggaggtagtgcttttcttatacttggtgaaggtggtatcagcctcaggctataccacccaaacccacaggtcctaaactaccaaacctgcattaaaaatttcggt

SEQ ID NO: 614525 - DNA, 855 bp, Homo sapiens
ggacttgtatcacctgctggaatgtttcaagtggcctgattgacaaggcagagaatggaacagtgatatgtttggtctgtccccacccaaatctcatcttgaattcccatgtgttgcgagaggaacccaaagggaggtaattgaatcatgagggcaggtcttgcccctgctgtctcataacagtgaataagtctcacgagatctgatggtttgaaaaaggagagtttccctgcactagttctcttctcttgcctgcctcgacgatgagatgtgcctttcatgtgccgtgactgtgaggcctccccagccatgtgaaaccgtaagtccatcaaacctctttctttggtaaattgcccagtcttgggtatgactttatcagcagtgtgaaaatggactaatacagaacaattggtaacagtaaagtggggtgttgatgaaaagacagctgaaatgtggaagacaagtttggaactgggtacaggcagaatttggaacagttttggagggtcagaagaagaaaggaaatgtgggaaatttgaaaattcctatagagttgttgactagctagcaccaaaaatgtgtccaggctgagggtgtctcaggatggaactgagggaattgggtggtaacttggcgccaaagatgcgtccattatgtttaaaagcaagaagactggtggaatactgcgcgtgccatatgagaatgtgtggaaattgaccttggaggagatgataaggggcactgacagcagaaatataaaagaaaaaattaaaaggggcttggttctctggaggcacacagatagaagagaagaagaaacaataaaacatgatatggaattgttgataaaaccat

SEQ ID NO: 614526 - DNA, 108 bp, Homo sapiens
gtctcaagcaagaggaaagttgacgacgccccacctcgatgaggcggcgcccctgagtaggccaggagcctctcttgcaacttataccaccgcgggccactgcggccg

SEQ ID NO: 614527 - DNA, 1012 bp, Homo sapiens
gacacatgtgcaggcgcccaaggtccggcgcgtcagatcggtgccgatttcctgccctgcccctgatcgacagactgcgaccatgtcccatcatcgtggcggtgtacggcaaacacaagggacctgagacactgtgcataatggacttccccattgccaagggagagcgccagtcccctgttgacatcgacactcatacagccaagtatgacccttccctgaagcccctgtctgtgtccctatgatcaatgcaagcttccctgaggatcctcaagcaatggtcatgctttcaacgtggcagttggatgactctcaggacaaagcagtgctcaagggagtgacccctggatggcacttacagatctgattcacgtttcactttcactgggggttcactttgatggactacggttcacgagcatactcgtgcgctacacacacggacacatactcgctgcacagaaacttcaccttggttcacttggaacaccccaaagtcatgggcgcgattatgggcgacaggctgtgcatgcaacctgatgagactaggcgcgccctacgcgctactccactctgaacggctggcagtcgcctaaaactcggcgccttcacacacagttgctcgactgtgctggcatttccattaacaccacactgcgcgcccacaagtgctgactttcacctaacttcgatcctccgtggcctccttcctgaatccttttcattactggatctaccaaggctcaatgaccaccctcctcttctggcatgtgtgacctggatggtgctcaagggcacccatcccgcgttcgcactcgcacccggtgctgcacaacctccggtaaacttaagttcaattgcggcacgggtgtacccccaatgacttcgatgctgaccactgtgcgcacccgtctcttcccttgtcacaccacgggcacactaagcttcgctcgaattaccatggttccactagtatcgcattccgcacaacgatctctaggtgttaccctta

SEQ ID NO: 614528 - DNA, 780 bp, Homo sapiens
  misc_feature (45)..(45): n is a, c, g, or t
  misc_feature (111)..(111): n is a, c, g, or t
gggttaaacgccttcttcacttaaaacacttgtgtcgtctagcancctctgtgtgtacgatgtcagctgcatcgcaatgggtcttgaccatgaccgcgatcagcgcatagncagctctcctgcataggggcagatttcagccactctggtcggtactcgtttgagacacagtgtcggtgcaattgttcagacagcagcactcgtggatggtgaaaatatcatgttgagcagctaccggtgatcatacgcaggagtacagggtccggagtggccgtaagctaactcagacagacttgcagatgagggtcctgtctgttagatgtatgcctgtcctgcagatctccatccgctccaggcacccatctgtgcatctccatcatcagagtcctgaagtagatccaccacaaagagtgcaattcacagagcagattaactgcatactctaaggagcagagcgcctctcctcctccaaaggaacgtagttcctcaccagctggggaacatagctggatggagtatgactcttctgagtcgatagaaggcttgagatgatcctatgatcaaaatttagatgtatgtatagctagcatagccgatacagagtagtgcttaaatgagttgatggagctgacagcccaggctcgagaactatgttaagaatgcagtcagcctcagcagccgatgcgatcagctggaaggaagggcatcagtcatggcagatgtgatgcatgtgatgtagtgagcaggggagtttcagaaaaaagaacagcccaactggag

SEQ ID NO: 614529 - DNA, 107 bp, Homo sapiens
acgaaaaaaaaagcataaaaaaagccgccaccaagttgaaatagccacccgccacccccaaaaaagagagggaataacccccccaagaaaaaactcttccccccccc

SEQ ID NO: 614530 - DNA, 117 bp, Homo sapiens
actccgaggtattcccagatgagggatatagctgatgagggatattggctgattgaagagtatgcaatgagcgattttaggtctgttagtcgtaagcagatggagcttgttataatt

SEQ ID NO: 614531 - DNA, 162 bp, Homo sapiens
  misc_feature (90)..(90): n is a, c, g, or t
ttatctgctgctgctatgccctggatgtaacttgtgtgtcatagttacctttaactcagtggttatctaatagctctaaactcattaaanaaactccaagccttccaccaaaacggtgcccagtctgtatacatttttactaaaaaatactaggcttatgta

SEQ ID NO: 614532 - DNA, 347 bp, Homo sapiens
tcatcgagctcggcccaatgtttgacatgagacgggggaagccacagtaaccatctcaggcacagcagacaaacgcgtgctgtggaatctgacacaaagtctgttggattccaagggttcaacgatctttatgtgattgatgaacgacgacgcctgcccaagagcagtcagagctgtaagaagagtagcaggagggcctgtgaatgcccccaaccccctaaaacctgcagctccaggtccgacactcccaggtttgcgttttgaatttacactacctatggggtccaggccatcacctaagtgagaaatttcacacgctcacccggggtgctcaaagccatctctct

SEQ ID NO: 614533 - DNA, 527 bp, Homo sapiens
  misc_feature (294)..(294): n is a, c, g, or t
  misc_feature (300)..(300): n is a, c, g, or t
  misc_feature (315)..(315): n is a, c, g, or t
  misc_feature (374)..(374): n is a, c, g, or t
  misc_feature (396)..(396): n is a, c, g, or t
tttgggctcagtcaggggaaggggtctcagaggcaggagtggcagcaaacataaagaagtggggtaaatgccaatgttttaaacagaaggcaatgggagttggtatgaaatattttagggttcatctctgggggagttagcaaaggaggaaggaaatgtactagctcaggagtagatgaacgggaagtcctttttttggagacaggttctggctcagtggcccaggcgggagtgcaggggcgtaatctcagctcacggcagcctcaacctcttcggctcaagcaatcctcctanctcagnctcccgaatagctgngaccaggcgtgcatgacatcacaccgggttaattttcctatggcgggcagagagggggntccgccatgttgcccaggtggntcttgaactcccgagctcaagcaatcgagccagatgggcctcccaaagttcggggattacaagcatgagccaccaggccgggccaaaaaatcatttctggcagtagctatgctagctatgggggagtgaag

SEQ ID NO: 614534 - DNA, 227 bp, Homo sapiens
  misc_feature (71)..(71): n is a, c, g, or t
cccggcctagtgtccagggtggtgacattcatctgaacaaagaccagtctccaccaccaaagtcatggttntgctgttgcttccagaaccaaagaaaggctggcttctgggctgcgcgcggtgattcacgcctgtaatcccagcactttgggaggccgagacgggcagatcacgaggccaggagttcgagaccatcttggctaacatggtgaaaccctatctctact

SEQ ID NO: 614535 - DNA, 278 bp, Homo sapiens
atgtagatactgtgttattctacacaaaaggaaacaaatagacaaaaatatttaaccacagaaattaggaatatttatatactttataacactgtagaaatctttggtggtgacatatagaatcctatcgctgaaaactagttaaagtcattttgtcccatcaaagtcagagatagtcgagtattacataatcagtaatcgtggcaatagtacttatcttagccaaatacacacatacacacacacacacacacacacacacacacacacacacacac

SEQ ID NO: 614536 - DNA, 348 bp, Homo sapiens
aacttaaatgagctatacagcgtgcaagaaactatcaaaggctggagacaatatccctgaggcgcatgctgtgtatttcaaccccaccacagtgtcagatggggccaacaagaaggataaataagatcctcactttggcagtgcttcctctcctgtcaattccaggctctttccataaccacaagcctgaggatgcagccttttatttatgttttccctttggatgtgactgggtggggcagcatgcaagcttctgatattaaagaggcatcaagggaatagtcaggcaccctacagggaaggctgccatgctgtgcgcaactgtttcacctggagcgatcagagaaa

SEQ ID NO: 614537 - DNA, 107 bp, Homo sapiens
  misc_feature (72)..(72): n is a, c, g, or t
gctttgagggttctcctgttttagtctcctccatttagcgcgtcgattctgaaaccaggttttgacctgtcnctcgctgagctgttttatcttggccagacgcttcc

SEQ ID NO: 614538 - DNA, 256 bp, Homo sapiens
gcaacgggaggaaggggaggcttctgcattgtgggtgataacgtaggacatgtgcttggtacaaaaagggcctgagacattccccctagcttgactggctgcaaaattaaaactggggggggtgcaggtggtggggaaacaaatggaaaaactggcaaattaagggtgggggctgcggatcccagggactgccccaaaacccaaacccaagtcctgtgcctgtccccagggtcctgaataaataaaagcctccttg

SEQ ID NO: 614539 - DNA, 139 bp, Homo sapiens
  misc_feature (78)..(78): n is a, c, g, or t
  misc_feature (105)..(106): n is a, c, g, or t
agagtggtgccctccgtgtactctcttggaggatgaacttggactgctgctccatcacactgtacttcctaacatggnccaagatcttccttgggagggttcagnncttctcaagtgagggttctgactcttttgtacc

SEQ ID NO: 614540 - DNA, 194 bp, Homo sapiens
gtactggcattcgcttcttgaacgtggttgagtagtggccccctttgatggccaaaactcagtgatggcacaagggtaggttacagtctgtttacacttccatttaggttatagttcaactattttcagagaaacttaaaatatgtaaggaggcaactttagagtaaacttgatttaacatcatgtaggtcaca

SEQ ID NO: 614541 - DNA, 397 bp, Homo sapiens
  misc_feature (111)..(111): n is a, c, g, or t
  misc_feature (207)..(207): n is a, c, g, or t
  misc_feature (228)..(228): n is a, c, g, or t
  misc_feature (257)..(257): n is a, c, g, or t
  misc_feature (394)..(394): n is a, c, g, or t
ccccagcatgcagaaggacgcctctttgagcggcttcctgcctagtttccagcatttcgccactcaggccatccacgtgggacaagagcctgagcaatggaattctcgtgncgtggtgctgcccatttcgttggccaccacatttaagcaggacttcccgggccagtcctcgggttttgaatacagccgctctggaaatccaacaanggaattgcttggaaaaagcangtggctgcgttggatggggcaaagcacangtttggcctttgcatcgggtcttgctgccaccattacgattacccatcttttaaaagcaggagatgaaatcatttgcatggatgaagtgtattggaggcaccaacaggtacttcaggagggtggcatctgaatttgngac

SEQ ID NO: 614542 - DNA, 308 bp, Homo sapiens
cccttgcctttttaaggtttttttttccctttttttttcccctttttgggtccccccccctgggtttcttatgggaaaaccttttgtttggcccattttatggcccaatttttttttcccccgggccccgttttttgggggggcttccgggggttttggattttttttggtggtggttcccctccctgcccaagggcttgggggggggtttcccttggggttgtttttttggggttcccccttttggtttccttcttttttttttggggtttttatttcccctggtttttggggggcccgggtcccga

SEQ ID NO: 614543 - DNA, 172 bp, Homo sapiens
tatgccaccgtattcaactccaagggtatatggtcaagcttacaggtggtaaggaactcggctcgcagcacatcggaataggctcacttcgctagcgctgtgctgtggaattatctgtatttctagctatgatcttagcttcctcaagtccatttcatttggacttacaccc

SEQ ID NO: 614544 - DNA, 302 bp, Homo sapiens
gtgactccgaggatttcgttgggcactcgtcacaactgggacgttcatggagaagatctggcacacaccttctacaacgagctgcgcgtggcccgagaaggagcacccagatgctgctgaccgaggccccctgaaccccaaggccaacagagagaagatgactcacgacttaatgttttgagaccttcaacaccccagccatgtacgttgctatccatggctgtgctatccctgtacgcctctggccgtaccactggcatcgtgataggaactccggtgacggggtcacccaacaactgtgc

SEQ ID NO: 614545 - DNA, 315 bp, Homo sapiens
tacagcccatagcccaccccaacggggggcaagggtgattttctctcagaggaaccggaccggggcttggggttttcaaacaataaaaaaagagagagaaagagagaggcacagggactcaagaaggggccaggaacgggagacccaggaggaggagaaaggcacagaaagacaagccagaggggccaaggcacaccctggaggggagctgggcgggctaaacctcccctccctcccaggggggcttttgaaaaccctttggacaggcccccaaaccctcccttgagggaggaggggcctgggggggagagcaac

SEQ ID NO: 614546 - DNA, 460 bp, Homo sapiens
tgtattcaaaacgtcaaacatgacttcacaacagtgcaattgagcaatattttgagataacacctgctattcttactccattactttccttgtagtagttctttcctgctagctgagttagtcttagcctttgactaggcacttgaatgtgtcatccatccgtttggcaggtgtttgaggctcatttgctcagctaaaaccagatacacttctgagtgctaaaaccccaacatcaaaccaactgcccttacaactcgagtaaattgtgttaatatcaaatcctagaatcatatctgcaataaaatgtggaaaaacatcaggtaaactgctgaatgcccccttccatatttttagttgctcacaccaaaaggaagaagctaattataagatatgaaccacaccattgcagtcagcacccaatcaccaagacacaaatgtcacgagaaaggaaaataggatg

SEQ ID NO: 614547 - DNA, 1198 bp, Homo sapiens
ggaggccggaggccaagccagcgagccaccatggagacccggtacaacctgaagagtccggcatgtcaaacgtgtaagtagaaagaagcggcagaattgaaagatccaacagatcattaccatgcgcagcctttagaggataaccttatttgaatggtcactatcacgggttagagggcgccccagacatccgatgttgatggaggagtgtagtcacgggcggatagtactgccaacagagtatcccatgaaagcagcaagcattattctcctaagcggctaatggtcgatttgaagtgggcaagaagaatctgttatgagcatctcaggaccatcgatcctgaaacttggtcagacgttcgctggagtataaggacgagcattattgagccatcatggggttatatgccaactaaaaggagagggagccataggttctctaggattacacgtcctgaggaaccgaagagcacttgccaaaaaatcacaagatttctgtctgtgaaggatgtaggctctgccatgacaggatgtccgtgttgcctttaaaatctggaaagcgatttccaagccaagctgaccaagaagccaaagaactggataagggcgaaataagcttaagggcaagaaagtccaattcattcgtgggaaagactatctttgagtcagaatttaaaaccggtctttttacacttaagtggagttaccaggaatggtttacgtacataattcagggggtaaggcaaagtaattcggtagcgggtcccagaactccccccagaagggcactctttgactgaaggttcacacagactggtcacaaaagaaccccaaggagaccctgaaaggcgtggccaagacgagaagcggaacaagggcgacatagcaccgaaaggacacggacacaacgcagagagaccccgaatggtgtcgtcgctcgttgtggatagagacagccgattgcgacgggagaggctaacatgaccagatatatggacgcacgcaaaagatgatgcgagacagtaccgtgagcagatcagagaacgcacacacaaaaacaggagagggatgacacgataataacagcattgagccactacacagcgcgaacatcaaacacagtaggaagacaaacaagaagacgaatatcgtgtcttatcttctcgcttcttctcctgtcgttcatgagagaggagtt

SEQ ID NO: 614548 - DNA, 648 bp, Homo sapiens
agcgggggagctgcggcggggtctggggcgcagagcagcggcgggaggaggcggacacgtggcaacagcggtagcagcccgggcggcggcagcaacagcggcggcggcatcggcccgagccgccggccgccctcccagccgtcccgacccgcggcagccctagctccctccacttggctcccctggtcccgctcgctcggccgggagctgctctgtgctttatctctctgattctccagcgacaggacccggcgccgggcactgagcaccgacaccatggggaagggggttggacgtgataagtatgagcctgcagctgttcacagaacaaggtgataaaaagggcaaaaagggcaaaaaagacagggacatggatgaactgaagaaagaagtttctatggatgatcataaacttagccttgatgaacttcatcgtaactatggaacagacttgagccggggattaacatctgctcgtgcagctgagatcctggcgcgagatggtccgcaaacgaccctcaactccaccctccacatactcctgaaatggatcacagtttgtcggcagctctttggggggtctccaatgttactgtggattggagcgaatcttgtatcttggcttatagcatccaagctgctacacga

SEQ ID NO: 614549 - DNA, 1395 bp, Homo sapiens
ccgtgcagaaaaaaaaagaaaagagaacaaacaagagacgaaagacgcacacacgaagaaagcagcaaacacgaggagagacgaggaaacaacacagagacaacaacagaaacaacaagacacaccaacacaacgcgaagagaaaaaaacgagaacgaacaacacaacacacaacaaactataataacatatacatatacaataccaactaactaaactaacacaaacaaacaaaaaacaaaatatacaacaaaaaagacataacaatacaatacacacgacacaccagtaaagaaacaaaaggcacaaaagagaagagaaacaacagacacaagcaaacaagagacagaagcagagaaaccgcacaacgagagaaacagcagagagacgcaagagacaacagagcaaaccaaagagacgaagaccgcacacacagaacgagatcaacaaacaaagaagacacaaacaccaagacacagagacaaaacaccacaagcacaaataaacagcgaacgcaaagacgcaaacaaaccccgacaagacagacaaagcagacacgcacacaacacaaaaaccacacgaccacacacaagcacaaaaagcacccgacgcagacccaccacgagacacggcccaagagaaacgcagcaggagaagggagagggcgcaagccgaggagccggagacgatgagaagagacagcagagagcggacaacaggacacgaacgagcgcgcgtacaagaggagaagcgaggaaacgagcgatggagacagccggaaggacagagagacaaaacacaacccggaacacgaagaaacaaaacaggcaaagaaaaaaagaagcaagagaacaagcaacgaaggcaacaagacacgagcccacagacaacacgcgcagaccaaccagacagcagacgagaccaaggaacgaagaaaagcaagaagacgaagagaacacgagagagcgagacagaagaagcgaaggaacaggagccagaaaagaagcgaaggagaaacacaacgcaccccagcgagaacacgcaagcgcgaacaacgagagcgcgagcccagcgcaccagcagcgagccgaaccacagaaagcaggacagcaaagaccgagcacagaggacaggggcagcacgagcacagacagaacaggacgaggacaggagccgagcgcagacaggacggcagaccgagcacaagaagagagcgcgagaaggacgacgagaaacagcacgcgcagaccgagagccgagagagagcagacagagcacgaagcaaaccgagccagaacaaggaaagacaagcagagaagaacaagcagagagcagaagcaaacagcagagagagcaggaagggacagcaggcaagagcgcagccagcaggagcag

SEQ ID NO: 614550 - DNA, 614 bp, Homo sapiens
agcgggggagctgcggcggggtctggggcgcagagcagcggcgggaggaggcggacacgtggcaacagcggtagcagcccgggcggcggcagcaacagcggcggcggcatcggcccgagccgccggccgccctcccacctcgccgactacccctcatgcccctgccgtcgccgacgctctgtgctttatctctctgattctccagcgacaggacccggcgccgggcactgagcaccgacaccatggggaagggggttggacgtgataagtatgagcctgcagctgttcacagaacaaggtgataaaaagggcaaaaagggcaaaaaagacagggacatggatgaactgaagaaagaagtttctatggatgatcataaacttagccttgatgaacttcatcgtaactatggaacagacttgagccggggattaacatctgctcgtgcagctgagatcctggcgcgagatggtccgcaaacgaccctcaactccaccctccacatactcctgaaatggatcacagtttgtcggcagctctttggggggtctccaatgttactgtggattggagcgaatcttgtatcttggcttatagcatccaagctgctacacga

SEQ ID NO: 614551 - DNA, 1343 bp, Homo sapiens
gccgcgggtgatcagctggtctgcgctcccctgacgtgggctggtggcaccgtcaccgccgaactggcagcctccagacaagccaccgcgagtaacggtgtgaatcaccaggacttttcaactgacgaaatttacagaataatgcaccctaacgaggtgacacactcaggcagacacaggtgtggcaaccagacggccagaatgcctccaaagggtgacttcacgagcctgctatcggccagccttgcataacaagcccacttgacggcaacctctgaactacttgtgaacccggaaacctgactccaaggccctaacattcaatccccatacgggccacgacattggctccactcaagaaggttgacgtagtatttggctaccacatgctggaaccatggatccgcgcacagtgcgactattctcgcgggctacctcatgtgcaacttcatcggaactatggacatcctggcgggggccacaccaagatagcccaatcacatacacacagtaactgcaaagcccattgcccatgtcgcaattggcatgcgacacctatgccctggtggcccggcctatacccgtttccaccttctccaatgtggtccttgcccccatcacttcccagaccaactggggaacccagggccaaccagcattgggcacaccagccgtgcaacggtgggcaaacggcaactaggggtcctccccggcacacgcggcaccccaccgacacgccacacaccccataccacaggggccccggcacccccaagggcccaccgtgctccttgaaacgatatgtgttaggcgcgtaagacacccattggacaaacacacgcaaagtctccaccactacggacaccttactgatgaaaatggcatttgccgaacacccaccccctctacatggcacacttgtcccaattagtgccgctttaaaccactgcgcacccttcacactacgggctgcaaccacgtcacctaccacgacacatggcgggcccccacaagctcaagcggaatatcacaacttgacacccaccacatgcgtctttgtcgcccagtgcgtgctctcccctgttcacaaacgcccattccactccagttatctcccctccttgggactccccacacgaggggccacaatcacaaatcgactgcctatcacgctaacctcgccacactcgcacgtcgacacactctacctttgtggtcgcactactacctgcaaaactccctcgggctaaccgcccccctgtgtacaatccccaggttctcccacccttatagtgtcctcacattactcccctcttaatcatatacctccctattcacaccca

SEQ ID NO: 614552 - DNA, 264 bp, Homo sapiens
catgtatacagctacttgggagggcgaggcaggagaatcgcttgaacctgggaggcagaggttgcagtgagctgagatagcaccgactgcgctccagcctgggggacagagcgagaccccgtctcaaaaaaaaaaaaaaaaaaaaacaaaaaaacccaaccaaacaaaaaacctcccgggccagccatgttgacgtcagaagggacaaaattccacattattccacattccaagagtgctgtgcagaggtctctcaacgcactt

SEQ ID NO: 614553 - DNA, 322 bp, Homo sapiens
ctcctgcttcagcctccaagtagctgggactacaggcacatgctaccactgccggctaattttttgtattttagtagagagggggctttaccatgttgcccaggctgatttcgaactcctgatctcaggcaatccgcctgcctctgcctgccaaagtgctgggattacaggcgtgagcgaccgtgcctggtccatattttcttttattgaagtatactatcctgtttctttgtgtaccttcttgtgatttttttttgttgttgcatttgaaaactggactttgaatagtatattgtggcaactctgaaaataagattcttct

SEQ ID NO: 614554 - DNA, 268 bp, Homo sapiens
  misc_feature (148)..(148): n is a, c, g, or t
  misc_feature (159)..(159): n is a, c, g, or t
gtcgcccgtgttttcgttggcgggtgcctgggctggtgggacagccgcccgaagaagcaccatgatttcggccgcgagttgttggatgagttaatgggccgtggaccgaaacctagccccggacgagaagcgcacgaaccgtgcggtnggaccacgagngcgtttgtaaatattatctctgtggtttttgtcctgcggaattgttcacaaatacacgttctgatcttgatgtatttggaagaggagataacattagagagttcagcaa

SEQ ID NO: 614555 - DNA, 390 bp, Homo sapiens
acttcctctcctcccacctctacaaaaaatacaaaattagccagggatggtggcatgtgcctgtagtcccagctactcggaaggctgagataggaggatcacctgagtccagggaggtcaaggctgcagtgagccatgaattgtgccactgtactccagcctggcaacagagactgtgcctcaaaaaaaagaacatttgtgattcatagaagaaggctaaaatattaacaggaacatgagtttggaataagttgattccaactctcatgaatgattttgaggggattcaagacttcagtggaggaagtaactgcagatgtggtacaaatagcaagagacctagaattaggctaggcacggtggcttatgcctgtaattccagtactttgg

SEQ ID NO: 614556 - DNA, 1384 bp, Homo sapiens
aaacaggggtcgaggccggtcctgaccttgttaccatgacacgacttgacttgctatgtgggattacaccagacgcttgcagttggacgtacactggtaacggaacctcaagcaaggccttacacatatgtcggctgtaatagtgacgcatactcctaacttgcagacacgacccttcctactgaccggactcatgggcatcaagcctacggggacccactgtgccagctacagtacttgtggaccttgcgcactcgtgacacttgactatataagacacatatttccctcgtgacaagctggcacacggttcaattccaccaccgcttaacaaggctactctcttaagttggccaacaactggtgatcaccaacacaggacaagtcactttcaataccgttacgctaacgccaatggggcagttccttaaacttacacgcgaccttacacacggtaatcatttttcaaacagacagtcctgggctactaaacgataaagactgcttgcatctccccactttgagattcaaacactttacccgggacttcccccagacgacagggtttgggcgctacttttcgcctggaccaacactaaagtttatcatccctttttggccactactcatagtgcttgtaccatcttatatatcacgatatctctgcgataacttttgggcacaaagtagtgggacttacttaccgagcacttggcatagctggccccaactgatagaccaattgcggaaaactacgcgtgtacacacaaattctaatccagttaacacatggcgtgctaaaccccaacagtgtatcaactatccatttggcagtttggtcacacttagttcatacccacatcatcctactaaacttacgttgtgattccccaaccctttactgcgacaactatgcgtgcgtatcccaccgaacatctattcgcacatggcatcaccccacggcgtcttggcaacccctacctcccaccgaaccctcgggatatccggctcgcacgtcgccactatccccacagaacattagcactggactccctctctatccataagtaatcacatgatttattacagtacagcggccacttatggcgttaacactaatacgcccctcccccactatgccacacgaaagacacttcggatatcctcatatcccccgtgtgttccgcgcataaccttgcaaacagtattcacaaacactttctcgcgtagcgcctatcataagtcaaaccgtcacgtgtggcacaacccatatcgtaacatatgtcacagtgcactacgtcactccaacactaatcgcacccaatagtttacactccaccttgcatcagtagccaagttagcacaccaccatagtctctgtcgc

SEQ ID NO: 614557 - DNA, 222 bp, Homo sapiens
gagggccagcggccgattagtcttgaaaagtaggtattgcctagtagagcgtccatgtcaagatttgcatacgcatcactgtggtatcatttaacacatagctctgtttatcttgttctttatataggttagatctagaagcttgaagatctagatctagttctggttagatctataagctagaagagattcggtttaaaatctttttttttttggcaagaa

SEQ ID NO: 614558 - DNA, 583 bp, Homo sapiens
ctagaggaccccgagtgcagtgtcgaccatgaatatagtatatatagtggcacaagggactatgcagtatataataacatagatgtatctagaggagcatatcctggcttgtctgactgggctgaggcaggaggcgcatgaatcagagaaggagatgtgatgatggaagcagaggtcagacagagatttggagatgctcaactagttggctttgatgatggacccaagaaaggacggcaccatatgtagatgcgggccaaggcaaggaaatggattctactctagcagcctaagaacacatgcctctgccaacaccgatgagtatcaggactcctgacgctctagaactgccggtatacgcacacttggatgtctttaaggtatcccagtttgtgcttctttgtgacaacaaggcaatcaggagactgatacagtcggtgatagacgatacatagttggtttcctgcggctgtactccattacctggcaaagcaagggtaccgtacagtcggtccccttcagagactatagcccttatgactgtgacctgatgaacctccacacttagagaaacctgtccatc

SEQ ID NO: 614559 - DNA, 3970 bp, Homo sapiens
gttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcccctggcaaccaccattctactttctgattctgaaaatgactgctctagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcccctggcaaccaccattctactttctgattctgaaaatgactgctctagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgc

SEQ ID NO: 614560 - DNA, 281 bp, Homo sapiens
tgacagtaacacatagagtagatcattatccagcaacatatctgctaccttagaacaagaatttaaaacttgggacgaagaagtaaaagagcattatgcaataagtatgtcgtcatgctagatgaggtctctagtaagtcccagagataggaatgacagtctcactctctgaaacaatcccatgtttctcacattcttcgcagatcaaattcattcatcaagtggcaactatgtcgaccaatagaacattttcgattaaggacatactacacaatgtctag

SEQ ID NO: 614561 - DNA, 1214 bp, Homo sapiens
gcctccggaagcgtatccgaactttccagaagtttctcgggacgggcaggagggggtggaggacgtgccatatatagatcccgggagcgaggggcagctgggctaacgagtagagagtcgtgtcagctggactcgaggagcgagagtcacgtcccggcgcgtagcccagaccagacccaggccgcaccgatgggtgcgacgcaaaccacttcctggaccatgcgctccctccgtgcttactcatggcgcctatctagcgctcctggaaggctggtcctggccgccgaggtgagagaaacctgccagacctgcgagactaggtcctgtgcactgcgagagaagattgcagccccaaggctggccacgactagcccagagcgcagacggcaggccatggacgttcaggcatgagtaccaggccatggaccaaggcaccaggcagtggagaacatcactaggatgtcacgccgatgagtgagatggcctcgatcagcatgggagctcagtgtcgcatggagcggacaagggcagacacaacggactgtcgcagggccacaggccagatagaatgagacgccgaagcagcatgacagcgaccgaagagagtgtgccacatcccgagacctggagcagatgcatggctgccggctacaagtcaagcaacactcagacagggagcgcaaagtagaccttggcaagcctgggcaagccgaacttgtacggaacccagactcagtgagcatcggctgcatgacttcgctgcgcaagcaagcaaagcagcagtacaactggcagtgacactacaaaggatcacagtaaccaggaacacgcagcaagagcagcacgaaagacaccaacgacgctgggcccgcgcaagaccaccgacggccaacggccgaggaaacaaagaagggcagccacacggaacgtccaacaagcaaaaaaaacagagatcataacgaacacagagcagacaaaaactccccccaaaacatacgcaccgcgacacacgacaacaggaacaaacaggaagacaaaaaaacaagacaagacaacaacaaaaacaaaaggaaagagacagtaacatagaacaagcacagcacacacgacacggaaacacgaaccaagacacacacaacgagaaaaaaaaaaaacaaagacaaacaaagtaaagaaaaaaagcacgagaacaccacaaccaacagcaaaacgaa

SEQ ID NO: 614562 - DNA, 107 bp, Homo sapiens
acctcaacttacgtactctcgacttccgtgtgtgtgtgtgtgtgtgtataaggtaatgagtgcattttagatttgtatctgaaatggggatgaaaatgtgtttcttg

SEQ ID NO: 614563 - DNA, 510 bp, Homo sapiens
atcagattcttataggggcacaaaccctattgtgaactgtgcatgtgagggatctaggttgggtgctccttatgagaatctgatgcctgatgatctgtcactgtctcccatcaccctcagatgggaccatctagttgcgggaaaacaagctcaggacccccacagattctaccttatagtgagttgtgtaattatctcattatatattacaatgtagtaatagaagtaaagtacacaataaatgtaatatgcttgaatcatcctgaaaccatctccaaagtacacaataaatgtaatatgcttgaatcatcctgaaaccatctccaccaccaccgtctgtggaaaaattgctttccatgaaactggtgccatggtgcaaaaaggtcaaggacacaaaaaaggttgaggaccacaaaaaagaagtgctcagaggcaggcacgtggctccgctgtaatccagcctttcggaggctaggcggcagatggctgagtcaggagttcaaaccagct

SEQ ID NO: 614564 - DNA, 1286 bp, Homo sapiens
ggaccagcaacgtgtcggatccgcaggcgcacgccgtgcgatgttgtcctctacagccatgtattctggctcctggcagcagacttggggcatggaacccgacagagccgcgggccctttgcacgctgcagattttcagccctacgtttaccaacggaggtactatactgggcaatggcttcgcacacgactttggcaaatggtccgcctccgtagaatacctcgcattggagctgaccgaggtatcacaatccatacgcggggattagcccccaaattgttacaaaattaagcagaccacaaaccagccatcgggcattgcaggcgcgtttcccattgggagaacatggtcttaccgccctgcacccaacagaactttattgggagagccaaacgacccttacaacgccacttgcttcatataagcccaattgtcccaaactacacctcaacgggccccctcgatcacccttatcgaggtcgcgaccacaatttgagccttgccacaatatgcatgtgctgcctacccaaattccgcttggtaatccacaacacggctgcccgccactctccttttatccccacagctaacgcctacacttggtttacaacaccacaacataaatttccaatatgccgcggctggggacacgatctgtggcagttgcaataacgacaacacgcgcgacacaagagacagcagcctctcgtaaattccccaacgaccatctctggtacattgccccaaacgctataggagcgctccgtttcaaccccaaagaaatgcacagaaaaccaatcccccattttcacaaacagtgtcacatcgcgcaaagctagcaacctcatacagtccaataacagtgttgcggcccccactgagtgtgtaacaacgacgtggcacgacaccagtgttgacctgttgagcacataaacagccgccaaggcggtcatgcgagcatttactcacaacaaaagcaacaccccactgttgccccagcgacaccacatgtgattgccgaacccgcccatagttgtttcactacacgcgcgctgtgctctgccccacttgtcggcgaagccaatgcaaagaccccacaaattggcccggcagcagctgaggctaatagaacaacgcagtaactagtggtcttcacctgtatacacaacatgtcattgacgatcgggacctagggatacgtgccaacataacatagaagagcatattgattggtataaaccacaccctggttgatcggatcataataccgacaaacactcgcccg

SEQ ID NO: 614565 - DNA, 326 bp, Homo sapiens
atgccgattcgtagcacggttgctcgattctagtacgtgtacgcacctacctcgaggacatccttttacctagactctcaccaccaaatctttaacgctccttccttcttcctaccttccttcaccaaatcgcactggctcctgaactcttatcctatcttcaccacgaacagctgcttgctcacttgctcctcaatcctagcttcatcaaacactggttcctggaatcctgtctgcatctgtcttcctagattcactgaatccaatatctgtgtagcacctggatcagcattcgattaatgctagtcctcaggattagtcgagct

SEQ ID NO: 614566 - DNA, 732 bp, Homo sapiens
gtcacgttcactgtcatccccccagtggcccaggccacagtcaacttccggattcaccctggacagcacagtccaagaggtcctagaaactcacgaagaacactgtggctgataacagagtccagttccatgtgttgagtgcctgtatgaccccctccccgtcagcccttctgatgacgaggacttggtgctaccagacatgctccgcccaggaccgatacatgtccggtcattccacggaatgtcacattattacatggacccgcagtgtaatacatatcttagtgttggacaaaaacaccaggaactaaggcaccgacttccttctatcataagccctctatcgcagcattggcactcttacagagattcataccgctcatcttactagtatcgagtcctgatacaacttcaaagcggcaatccagtggatgtgcatccgagatacaatctctggtccacgcctatgagacccacgtgaacatttcatctttggagttggagttgcaagaattgctgatcatcatgacgcatgagagcctagtatttctcactctgcacaaactgttgagagtcaacggtggcctgctcgggttaagtgccatgcccgaccccagtggacagtgactatacccaagggggacaagctacgttgttcgatgacactttttgatcatgaccacattgtatatcattgcccattctgtcttgctcactcttaaatctctccca

SEQ ID NO: 614567 - DNA, 1054 bp, Homo sapiens
atgatctgtgcctgtgccagctgtgacgtgcatgagctgtgtgcggacgtggtagtgccctggcctgctcttcgcgaggagtgaagaaggtggccactctcccgtgtccccagaacctccccagccccctgcagtcctgtgcgctgttccctgcaatgactgagctgtgtgtgtgtgatgtgtgctccctgtgcctgccgtgccccgggctgcgaggaaagatggctgtgacctggcctgaggtgcaacatcaaagtgatagttgtctgcttcagacctctcaactgagtcttgaatgtgaacctgctgtgctgacaatgtacatcgccagagtttacagggatgaatgacactggtctgtgatcgctgtccaatgcctatatgcattttgatctgtggtgttcccagtcaagcacatctcaatgagcaagtgtataatgactgtgcaaagaagattgttaaagatgtacttgacaggatataatggaacaatatttgcatatggacaaacatcctctgggaagacacacacaatggcagtggtaaacttcatgatccagaaggcatgggaattattccacgaatagtgcaagatatttataattatatttactccatggatgaaaatttggaatttcatattaacggtttcatattttgaaatatattttggataagatacgggacctgttagatgtatcaatgaccaaactttcagtttcatgaagcacaaaaacctgagttccctatgtcaatggggtgcacaagagcgtagtgtatgtagtccagatgagggtatggataccatagattgatggaaaatccaacagaccatgtagcagttaccactattgaattgacattgctctaggagtcaccggactattcctaattactggtcaaccagagaaccacccaaccggaacccagagccgcgagtggaaacttcatttggatggataaccttgcacgacacgggtttcacaccgtaacctgcacgtgacttactctgcactacagcaacacgtaacaaaacttgtgctctaggcctgat

SEQ ID NO: 614568 - DNA, 556 bp, Homo sapiens
acgattcaccaaaccgcgcgaaaaaaaaggcctcaggtctcctgggatttgcctgaggtccactccagaccctgtttgcctgggtgtcaccagcagaggctgtacaacagcgaggagggggtcctgctccttcctctggaagcttcatcccagaggagcacctgccaaatgccagctgaacctctcctgtatgaggcgtctgtcaacccctgctggtgagaggtgaagccagctggacttcctgggtcgagtggggacttggaaaacgtgggcgggtagctaaaggattgtaaatgcactctgtaaaaacacaccaatcagcactctatgtctaactaaaggattataaatgcgcccatcaccactctgaaaaaagccaccaatcagagctctgtgtctagctaaaggattgtaatcgcccaaccagcattctgtataatggaccaatcaccaagacatgggcagggacaaatacaggaataaaagctggccaccccagccagcagggggaaaaaaaaaaaacaaagtggcctccttcgcctcaccggggaaactc

SEQ ID NO: 614569 - DNA, 144 bp, Homo sapiens
ctctagaggatcctctgatatgctgttcaacaatgcacccggtgaaattgaaggtaccatgtgaagatgctggttacccgcgccaggacggaaatgaccccatggagctttactccagtttggtactgggattcggtaatactc

SEQ ID NO: 614570 - DNA, 625 bp, Homo sapiens
taggggcctgggcttaattgtaaatttactggcccgtcgtcttaccaattatacatcataatgctactcccacgtagtcaccccctattatgcagtcaaatagtaatgatagcaaagccatcgtgaagacccttgctagtaccgggatcaggatatagactgtgctagcaagactagaaatacagtatggtgcagagtctagggggtagcctccatgagtaggatatatactatgcaaatacctatgtaaacaagtatctcaaattaagtatgctgcataactaattgtgagtaccagactgtatgactatttagatagtgaagttgagttgatgaaagttgccagaagcacaaatcccaacagtcataaagggttgcggtctatttgccgggagtattgcccacctgtattgaattccaaagcagatctgtcgtcgtcagtagtgaaatatctggtagccacgctcagaactcatgcagggctcgctattatgtgagagcggtgcgaagacagaaatgcttaaagacagttaaatttccgcgcaaatttgggtttaggggtctacgagggttggggttaccaacaggcccaatatatcccccaagttggtttaggggggaaagg

SEQ ID NO: 614571 - DNA, 242 bp, Homo sapiens
aactgaggctccggggattcaatcacttgccaaggtaccacgcaccgagccgcaggaaacgcgcgaaagccccagcacccgccacccagttcctcccggactcggcccccgccaccaacttcgcccgcacctgcccgagccggcgcgcccccgctccccggcgcgctcaccttgctgcgagacgggcggcgctggcggccggcgcgcggtccgggcctgctcccgcctggcgcggaagcgct

SEQ ID NO: 614572 - DNA, 1165 bp, Homo sapiens
ggggggctgcagagcagcggcgggaggaggctggacactgtggcaacagcggtagcagcccgggcggctggcatgcaacatgctggctggctggcatcgtgcccgatgcctgcctggcctgccctcgcgcagcccgtcccggcgccctgctggcaggcccttatgctccctccagcttgtggtcccgctggtcccgctcgctctggcctgggatgctgctctgtgcttttcatctctgattctccagtcgagcatgtgaccctgggcgcctgtgtgcacctgacggcaccctgacagcgcattggtgcgaatgagtggcgtttgagacgcgtgactatatgtactagacgacactagcaggacttgttatcaagaaccagatcggctgattaccacccatgtgggccacagcaacggctgcaaacatacataagcaactgtcgtaaccagtgtcaatggcacaacattgtaagagccctcccccaatgattctcctatcgtcgactgtactccattatttacatctacgccccgtatggactagcacaccttatcgactccacatacaacactatctgcgtacatctaaggaatctctgtgtaatacaccgcgctacgcaattttacacgcaacttcctttaggcacttcagatctagcccaacgcctcttagacaaggcaacttcctttatatgtcatgccagctatcaactaggaggttaccaccacaaatccatggcatcaccattccacacctatcacctccgctaccacttcctcgccaccctgtcatatcttcctttttgcacatcattcgagacactacacagacgtgctttacttaggtctatcactgacgcaagatacgtaccattctacagtactgccgcacagcatgacacgtccacaatacactcgcctaacaccacccctcgccttaccagcaactcattgcgcccacatcctttcaactactactctttacaccgtcacatctcttctaatgcctcgtagcatcccacattaacggtcaatagctatcacgaccacctactcctggacctctatctcactctacttacctagtagcgcaacaaccatctctatcaatacaatagagatcatccaccttcctgctacatcacattagtacgtctgcttgacc

SEQ ID NO: 614573 - DNA, 216 bp, Homo sapiens
tctagcctcgccaggggtcagcaggggtatgatcttgaagttatcaggaactggtattcaagagtccttttcatagtcttttccataaatctccggccagtcttcctgaaatacaaaaatgacatcacggcggcaacgtgggattatggaaagcaaaagttcctaatccgggaggagcaatgactctgatggtcaaggatgtggagctttcctcgc

SEQ ID NO: 614574 - DNA, 424 bp, Homo sapiens
aactcgtatatgcggtgggtgggaatggaaagtagtacagtcactatggtggaggttcctcaaaaaactacaaatagaatggccatatgatccagcagtcccacgactgggcatttatccaaaggaaagggaatcagtgcatcagagagacacctgcacccccatggtcctggcagcactgttcacaatagccaagatatggaatcaacctcagtgtccaacaacagatgaatggctaaagaatgaaatagtatttcattgtggatgttggtacatctacacaatgaaatactactcagccataaaacagaatgaaatcttgtcatttgcagcaacatgaatggaactggaagacgttaagtgaaataagccaggaacagaaagttaaacatggcatgttctcactcatatgggaaagctaaaa

SEQ ID NO: 614575 - DNA, 468 bp, Homo sapiens
gtcggtaccaattcattccagcgtagctggactttcacacatggaaccctaagcacatgtttgaagtccggctaccctgggccaccatgctggagtggtgatatggtttggctgtgtccccactcaagtctcatcttgaattcccacatattgtgggagggaccggtaggaggtaattgaatcatggggacaggtctttcccatgctgttctcctgatagtgcataagtctcacaagatctgatggttttaaaaaagggagtttccctgcacaagctctcttctcttgtctgccaccatatgagatgtgcctttcaccctctgccatgattgtgaggcctcctcagtcatgtggaactgtgagtccgttaaaactctttcttttgtaaatttcccagtctcagatatgtctttatcagcagcatgaaaatgaactaatacagtaaattggtacgctggaatggaattg

SEQ ID NO: 614576 - DNA, 401 bp, Homo sapiens
cggcacgaggcttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcatggcccatcagctgaagcttttcaggaagagatgaaggtcagaggtaaagttggggctcagtgctgaggttgttaaacaggccccatgtagctgtccccacattggggtttgctttctacttcccaggtgtttctcagcgtgagagtttagtttgctttgtgctgctggacaggttcctgcagaatggcctgttgtacga

SEQ ID NO: 614577 - DNA, 321 bp, Homo sapiens
atagagtgagcatacacacccagccagtcttttgtctatagtagataaatgttacccagcctgctcttgcactcctgcgctcaagctatcctcctgcctcggcactcctaccgtcttgagattataggcgtgagtcactgggctggccaaggcatacaaatttatcacagagtgattgccctatcccccccaggtggttcagcaggttatcataccattctgtgcacaacaggttccatggcaaacctggcagcaagcaggcaattccgctgcaggggcattcctcacggaggcacatgcatggctcagggcaacagcagc

SEQ ID NO: 614578 - DNA, 1127 bp, Homo sapiens
  misc_feature (493)..(493): n is a, c, g, or t
  misc_feature (758)..(758): n is a, c, g, or t
  misc_feature (795)..(795): n is a, c, g, or t
  misc_feature (837)..(837): n is a, c, g, or t
  misc_feature (851)..(851): n is a, c, g, or t
  misc_feature (943)..(943): n is a, c, g, or t
  misc_feature (955)..(955): n is a, c, g, or t
  misc_feature (958)..(958): n is a, c, g, or t
  misc_feature (987)..(987): n is a, c, g, or t
gcgtcccgcgaagcctgggcgtgtcaggcggttccgtccgggtctcggcacgtcgagttccgtcgagttccgtcccggccctgctcacagcagcgccctcggagcgcccagcacctgcggcggcaggcagcgcgatcctgcggcgtctggccatcccgaatgctatggccgccgtcgcctgtcttgctgggccttctggggcaagttgggcccatgtgtctcctggctgcggccccttgtggcccagcttcccctgccctgctttcttgcagcctggtgaacctgtgccggggggccgggcgctggctcggggagtcgggagccctgcggccaccagctgcggcggcacgctggacggcataaggaacatcgtcttgagcaatcccaagaagaggaacacggttgtcacttgcaatgctgaacatctctccaaagtgacattcttcatgacgctgacagcaacgatctgaaagtcattatcatctcggctgangggcctggttttcttctgggcatgacttaaaggagctgacagaggagcaaggccgtgattaccatgccgaagtatctcagaactgtacttcaaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaagggtgcctttgagatgctctntactggtgagcccatttctgcccagggagccctgctncacgggctgcttagcaaggtggtgccaagagcggagctgcangaggagaccatgcngatcgctaggaagatcgcatcgcttgagccgtccgtggtgtccctgggcaaagcaccttctacaagcagctgtcccaagacctggggacggnttactacctcanctnccaagccattgtggcaaccttggcctgcngaccggcaggagggaataacgtcttcttcaaagagccggctggtacaccagccatgtgagtggaggagaagagtgaggcccacggcagtgccaggccaccttccctcttggccaggcacactgctttttttagcactttt

SEQ ID NO: 614579 - DNA, 2154 bp, Homo sapiens
  misc_feature (1317)..(1317): n is a, c, g, or t
caacatagtgagacctacatctctataaagaattagccggcgtggtggtgcacctgtagtccttccagctactcaagaggctgaggtgggaggatcactagagcccaggaggttgaggccgcaggtgagccagatcatgccactgcaccccagcctggatggcagagtgagaccctgtctcaaaaatcggccgggcgcggtggctcacgcctgtaatcccagcattttgggaggccaaggcaggcggatcacctgaggtcaggagttggagaccagtctggccaacatggtgaaaccctgtttctactaaaaatacaaaaaattagccaggcgtggtggtggttgcctgtaatcccagctactcgggaggctgaagcaggagaatcgcttgaacccgggaggcagaggttgcagtgagccgagatcgcgcagctgcactccagcctgggcaacagagcaagactccatctcagaaaagaagcagaaagcctccaagagccaatggctctcaagcatcttggtctctgctaagaagaggctcagaggcttagaagccctgcctcgccggggctttgaggtgtgtgagcaatggctggggactgcaggcccgggaatctgagggcctcaccccacttcctttccagagccgtgacctcaggctcacctcctgccctcctctcaggcaagctgcagatgccctttagggcccaggccatgccccggatgtgaggggctgagtcactggtttggcagtgcccctcagagcccaggcctgggctgccacccacctgaggacgagggctgggccagctgtcgtgctccagttgctggggcctcttgggatcttgggaaccccatctctgagccccgccccatggccccgcccctcccaaggagggaaaaggcggctgccagtcgctcaactcaggcactgggacctagagctcagaagaccgagaggacagactgccgtgttgccaccacaggctggaccatggacccccaagagatggtcgtcaagaacccatatgcccacatcagcatcccccgggctcacctgcggcctgacctggggcagcagttagaggtggcttccacctgttcctcatcctcggagatgcagcccctgccagtggggccctgtgccccagagccaacccacctcttgcagccgaccgaggtcccagggcccaagggcgccaagggtaaccagggggctgcccccatccagaaccagcaggcctggcagcagcctggcaacccctacagcagcagtcagcgccaggccggactgacctacgctggccctccgcccgnggggcgcggggatgacatcgcccaccactgctgctgctgcccctgctgccactgctgccactgcccccccttctgccgctgccacagctgctgctgctgtgtcatctcctagcccagcccaccctgccagggccaggacccagacttcagcaaatgtggctcacacagtgccgggacatgccgggacatgcggggtggctgttgtcatgggcgtctgccccttcacaccaggcactggggctcagacccaccaggaaggtggccgttcagcccgagctcctgaaacggaatcccaggtcctggctggagagggacacccctgattaccttaaggcccaggcaataaagcagggtgatcttcctcccagcattcttctttgctgcaggctcctttgggagggggttgtagctggacacagggcatctgcccctttatgtggacccgagaacacacacacacagtcactgtggacactgcaaggacagggatgccactgcctcatgacgtccacactttcccctggcctgcaagtcccgggtctgcccagagactgcacgagggcttgcagcgtgtccacagccctagctgagccaggtctggatttgagctgacctgcgctccctggggccgagactgagactgtgagctggggtcagtccatgggtcggacagcaggaggatacagcgcatggaactggggggaccccaggaaaggcctccaagagaaggagcgtgtcgacaagagggtggtgggtgcagcaggtgctgcaggtttcagggagtggaaggttgggacaggagagcccagacagccaggaccacgcactgcccactgg

SEQ ID NO: 614580 - DNA, 123 bp, Homo sapiens
tcactggcagtctataaagcaggcaggaagaacacgaaagggccaaaggacttgccatcttatttatgaagaggtgctctcgctcaggagctcctgcctcttgttcataggccagagctgtgt

SEQ ID NO: 614581 - DNA, 124 bp, Homo sapiens
cacgagggagcaaaggactctctattttttttattttgtggccaagggtgcccgtcctcagttgctcatcctggcttagactcgcgcagtcttgggacaatgtgcattccgcctcacaggctat

SEQ ID NO: 614582 - DNA, 181 bp, Homo sapiens
  misc_feature (171)..(171): n is a, c, g, or t
gtgggttgaccgtgcttgagaaagccttaactctatcatcgacgtctaccacaagctactccctgatcaaggggaatttccattgccgtctaccggggatacctgaatgaaattgctagaagaccgagttgtcctcagttatatcagggcggatccctctagagctcgacnctgcagcgca

SEQ ID NO: 614583 - DNA, 136 bp, Homo sapiens
  misc_feature (49)..(49): n is a, c, g, or t
  misc_feature (82)..(82): n is a, c, g, or t
tcccgttggaacaaggacataacaagtctggtctgccagataaactaantagtaagagggtctgtgtagaggcatttctgtncaatctaaggctatgacatcatcaagctcttccttctgttcatacgaacctcgt

SEQ ID NO: 614584 - DNA, 187 bp, Homo sapiens
agaggctgactgtgatcttatgctcaagcagagggaggctgatgtggctgctgcttcccgcagcttgagaggcgagtggcttgaagttgccttgcgcttgggacccgggctctcctggctcagctggcacatgagcaggtgcagctcccgttccacgatgtccatctcacgttctgccagctcctgc

SEQ ID NO: 614585 - DNA, 289 bp, Homo sapiens
  misc_feature (66)..(66): n is a, c, g, or t
aaaaaaaaattttaggtccccttttaatttgcccccaaaacccctttaatccccttgttaattttnctgttggtccaaaaaggaacccctctttggcccctaggaaaaacccctgttaaagaaggtaaaaatttttcccccccaagtgggccttaaaacccccccccattaaaaaaggggttagggccccccccccccccctaaaaaatccccaaaaaaaaattggacccccccccccccattgggcccatttttccccccaaaaaaaaactaatgtttggtttaggta

SEQ ID NO: 614586 - DNA, 429 bp, Homo sapiens
ggcacgagctttgactcaactgaggctcctcgggcaaaatctgtacgggcaaagaaacctataaagtacctggaagagtcagatgaagaagatctgtttaaaaatgtgaggcgattatttaaagtaattatcttaccaagcccaagactggttttaaagttacctgaagctcttaactgcctcccctctgaatttagtttggggaaggggtttatagtacaagacatcaaagtgaagtaaagcccaagtggtcttaagctatgtataaaactggctaaaaagtgaccatctcaagggcattgatatcatctctgatatgccagagatagaagacagaaaacttttgacattaaaaccagaatattaaggactatctggaactggaaaaaaaagtatactgaacacttcaacgtaaagcagtggggttaa

SEQ ID NO: 614587 - DNA, 124 bp, Homo sapiens
ctgtgtcatgcagtggtactctggaacagtacagagttctgatagctctctgtcagagctcttcatgtactctttacagtcctacggagccccacggggaaccacggaggagctgacaccccag

SEQ ID NO: 614588 - DNA, 948 bp, Homo sapiens
tatgatgtctgtgtggaaagcggctgtgcagacattcaatgttaagaaaaaaaaaaaaaaaaaaaaaaaaaaaaattttggggcgtcccgcccccgaaaagtttttaaaccactggggggcgccggccccaggaaggaagagcaaaacgtggggcgaaagtgggtcccacaagggaaaccggggaccaatcacatatggggtgtggtttcctcgccaaataaaagaaaccgccgggggggcacccgggacgcgtgctccagaaacaatccgcatggggcaggttcggaaggagccagcacgggggtcctgcactacacagggcgttcgaaggcacagcccgcaatgttcaaatttacccccgccctggggatgaaaatgtctgtacagcacaacggttgcaccttgggggctttgacaaataacaacaaccagtgggtcttaaggttgaagtgtggttcagggaccagtgcatattagtggacagcacttagtagctgttggaggaagatgcagagtcgagaagatgaagaggaagaggatgtgaaaatcttaagtatatctggaaagcggttctgacccttggaaggtggtaagcaaggttccaagaaaaaagtaaaactaggtgtgatgaaatgaagagacgcaggattgcacaggacgacgatgccaccatgacgtcagaccaaaccttagaagcctgaggaagctacaaaaacagccagcaagaaagacacagaaaaataccagacacaaagaaaaaagaaaacacaaagaagaccaaaaccaacacaaaaacaagcacaacaacaaaagacacaacccaacaacagacaagacagcgacaaaaacggcaaaacgagacagagaaaaaaggaaaaagcacaaaagcaccacaaaaaaaagaaaccaaacacgaaagcaagacagagacaacacaaaacaaaccg

SEQ ID NO: 614589 - DNA, 308 bp, Homo sapiens
agagatcacccagtcgccagacccttcatcctaccgatcaggaaggcttaacacccattggggcgacagccactggcaggaggccacattgcacgacagtgcaaggccgatactgaacagtgctctctagattgctctgtcacagttctcctgactgcgctccgccaggcacagcttcaccgttcattttagcctgtagcctcactaaggtgacggtcgtcgcaagcctcgccacactgtgccccggcctacgtccctcatatgtgctctatgtcttagtccccactactgccccggaaggtggtacc

SEQ ID NO: 614590 - DNA, 408 bp, Homo sapiens
  misc_feature (3)..(3): n is a, c, g, or t
tcnacgaacaaaccccccaaaaacttttaggacaaaaactttcccataaacatgcccaccccatcctttcatgttagaacagctgccctctgtggtcctgcctgggtggaagtttcaccttactgatagtccctagagtaagaaagagggctgggtgcggtggatcataactgtaatcccagaactttgggaggctgaggtgggtggatcagctgaagctaggagtttgagaccagcctggccaacatggcgaaaccccatctctactaaaaacataaaaattagctgggcgtggtggcgcatgcctgtaatcccagctgttcaggaggctgagacacgagaatcacttgaacctgggaggtggaggttgaagtgagctgagattgtgcactccagcgtgggtgacag

SEQ ID NO: 614591 - DNA, 108 bp, Homo sapiens
agaacggtcagtttagggctggtgcaaaggatgcagttgcacattgttgcaagcagaggcaatgaattacgaaggcagtccaattaaagtaagggtgccgagctcgaa

SEQ ID NO: 614592 - DNA, 254 bp, Homo sapiens
cgatggactgtgagtctgcctgctcggaagagagagagcccgccacggctagcggcagagttgtgcgcgatgtctctgctgtctcgtcgctgcggcgacacgctgtttcaccagaggctgcctggtctgccagcagggatcagtcctttccagccttgagtttgactggcagggagtcagggggtcgctggcttgggcgggaaaggtggtgtggaggagagcgggactgagcagcataggtgggtgggatctag

SEQ ID NO: 614593 - DNA, 397 bp, Homo sapiens
agggtcagattgacattggggtgtgtgtggtctccccacctcctacacattatgcctacacgaacacagacacatgcaggtgcctttagcagacacaaagtcagtgattcttcaagtcacacagggaagggcaggaacaactcttgcctctcagtcccacacaaggcagctgtctcacactttacaagctgtgagagacacatcagagccctgggcactgtcactgcttgcagactgagagtagctccctcctttactatctgagctacttcctacctccacatcacagcagcgaacacagctccagtgatcacagatccaaagagaaccaggccagcaatgatgcccacgatggggaatggttgggctgagaagacgtgctcccatcccagggtga

SEQ ID NO: 614594 - DNA, 493 bp, Homo sapiens
agtatatacactaagatcgtacacctaccgttatcatgaccactgctcatgtctacttttatacatctaccgtatcttaaatgatcgaaaatttataagtcgctgaatatataataacctttgcttgtatgtaaccgaaaatggatataagagccaacatttagagtatgacaatggagctgaacagttttaaatgcgcaagcaagatctgtcctagtgaatgacttgtacccttaatttactgtgtaacgatggtcacataatttccttagctaggtaagtgggagacaaatagagaatgctttgtatcagtctgtcaaaacaaatcttatcttgtagaattagcgtaactgtattatacgagctatattttacatttgccagaaaagaacagcttgtataacgcttggggaagtctctgctctgtaatgtcttaagcgctgacagtcttgtaaggtatgtttatctcttcatgctacagtctcagttggtg

SEQ ID NO: 614595 - DNA, 658 bp, Homo sapiens
cacaccacagtggtctacgacggagggtatcataataatctcttatatatggattcatgggacgcgcacggccgaccaggaggcattctgtcaaaaccacctcttccccgcatgggaaatcccactgggcgtccgcgacggtcatcaaacatcattgtaaaaccaccataatcataggtttcatcgtaaaaattgggatcataaggctgtgcacgtcctttgatgggagactcaaatataagatcaaggatgatctttatgcactctactaccctatcgggttttcctccaataagaacaactctgtcagtggaatgaggacagcattcctggaaaagcttgatggtggtttgagtgttctctcgaagttctttgattttagcacctttgaccccaataattcctcctgctagactctgatgaatcaacagcctcaactcgcagtcaaagtcacttcctttatagtgttggtaatttaagcattccacagcatcagattcgagcgggagctggctggttgcagtgggtgatggcaactgcaagccctcttccaaggtagggatgattttcttcagaatttctccaattgtttcaatatcagcactgatactcaatatgcgctcggggccactgctgtctgggactgaaacactggcat

SEQ ID NO: 614596 - DNA, 382 bp, Homo sapiens
  misc_feature (382)..(382): n is a, c, g, or t
gagagagagatttagggaggaaggaaggaaaagagaaagaagacaaagaagaaaagaaagacaggaaggaaagaaagaaaagaaaaggaaggaaggaaagaaaggaacgagggaaagaaaaagatgaaagaagaagatgaaagaaaaaataaagagcctttaattggtgattggatcataaaggctccaccgtcatgaatggattaacccattcatggattaatgagttaatgaattagtggtttatcacaggaatgggactggtggttttatacctgtgctggctcgtgccgaattaggcacgaggaactagtctcgagttctttttttttaatatatgtccattcatctttattcctttatttaatcctgcccatgtatn

SEQ ID NO: 614597 - DNA, 540 bp, Homo sapiens
ctcttgtcgttcaccgtgcccccgcggcccttctttttgggttttccgccctttagacgggttttttgcgcccccgccccttctcgctgtacggggtctcccaccccgctgccgttctgttgtctctctcagtggtgatgttctctctctaatatacgctcccccgaggtggcgctcgtctcctctccccatcggcgttctccggtgctttggcgctctccgcctcgtcttgactaatttttctgtcctgtgcccacctggttcggtgttgttcccaggtgtgtctgcccccccagtgtactctctttccgccgggcgagtcggtctcctcgccggtcatggcgccacactccagtgtcacagcccctcgatgactacgtccgattgtgtgcggagacacctatttaggcgcggggctcatttttttgtcgcgccgttgatctgccctctctcgccttcttacgtgtctgtgggtcgaaacacgccgccttctgggagccaaaagagcaggtacccccctgtcccaacaatagacagaca

SEQ ID NO: 614598 - DNA, 432 bp, Homo sapiens
ctggcgaggcagtctcacaggaagacgggaatagggaaacatttttcagactgatggaacagttcaagagtgctgcagccttgttaaaaaaaaaaaaaaccccccaaaggcttttcattggggggccaaaggcccaggggaggttaaaagggttttttcacagaaaacacaaaattcccctggggggaagccaaaatttggaacacactttcttttggccaagggttttagcctttaaaagtcccagttaagggcctcctgtctccctgggttttggcggggggaaatttgccggcccccgggttttccgggcaaccctttttttttttggctttaaaaagccccaaattttccttgctttttttaaaaattccaaccatcccggccgtgggaaaggtacttttaaagaatttttttttttgggcccctgag

SEQ ID NO: 614599 - DNA, 349 bp, Homo sapiens
ttccagaggatccctgaatatccttcttaatagttatttccttttattttttggagagagtctcgctctgtcgcccaggctggagtgcaagggcaccatctcagctcactgcaatctccgcctcccgagtacaagcgatatctacggcttcagcagcctcttgaatagctgggattacagtcgtgacccaccgcacctggctatcatttggtattggtaaatccatggataagggctttctcagatactaaaaccttagaggaggattcattctatcccataaggtcgaaagagtgtctttcctcttccaggaggtggcaattggaatcagcagccaaaatttaaacct

SEQ ID NO: 614600 - DNA, 298 bp, Homo sapiens
gctcgacgatggggggagggggaaaaggttggggagtagctaaataggttgttgttgatttggattaaaaaatacgtagagcggattggattgggagccttgatattgacagtatgaaagggggcctgggctcggcggaggttggggattctcgggtccgggttttcgggaattgttcggcaataaaaagtttgtttgaaatttggggcttaggggttttgtttggttggttgaattggttttgggtgggggaaaagtaaaaagggttttgtcccaaagtttgggttttttccaaaag

SEQ ID NO: 614601 - DNA, 146 bp, Homo sapiens
tggttggttttgacttcggattgaacttactgtagcctccggtggtttcccccccccgcctccagggaggaagaattttactcccttaataaaaaatgaaaaggggatgatggtcaaaatctttccaaataaaattttccctgtta

SEQ ID NO: 614602 - DNA, 769 bp, Homo sapiens
caagaaacagaggccctgagaaacagtgactagcaaggtttcattttattattaataatagagattatagaattgaattgcaaaatgagtaaaaacaaacactataatcccaccttggtaaagttcatgtttactgggttttctacatcagcttttaaataattcagtgtgctttggtttttttgtttggttttgttttgtgtttatttgtaacaaagaacacctaaccagtgtgtcttagaaaagaattgaacccttgataacactgaaaaataatgaaacttttaaatcctccagaatgtgaaagactgctcagggattataactaatgcattttattcttatgacttgctgattccaccgacagctgccttaggggtgcagttctaatcaatgactgtatccacttggcaatccatacctcagaaacacaaatcggagaaaaccatcaatgtgtaaaagagacctataaatcagaatgtcaggtgggcacagtttcattttagtaactagtatttagagattattggataaaatattccatggacacaagatttatggtcttcatatccctccaggattctactgcatcccagtgggaatatgacatcctttgtgattttcttctgccaacaggaatgatgagttagtgacaggaaagcaaaactgttgtaagttctctcgcttattcaagcttttaaatgacttaccatgatttcctttctaaggagagtcatagagtcttctttgctgtaaaggtgtgcctatc

SEQ ID NO: 614603 - DNA, 829 bp, Homo sapiens
  misc_feature (44)..(44): n is a, c, g, or t
ttatttattacttcagattgatgattcagcgtttgagaaagttngggaaacttcaggttaactccattcacaacctatgcagtccaacggaggttatggaggtggaatgcctgccaatgttttaatgcagctcgaggatacgaaggcggggtagccctggtcctttctctaaagtgtgatggcaccttgttcaccctagtcgagattattccagtgatgaagctactgttctgctctgaaaaaaatactgtcagacgaatcctgcatttgcttgagctggcatgcatgccttaggactcatggaccagatccttcggatcgacactgaattttcaatgttaatcagtttggatcctgatcctcggctgaccctttttgtgaatagctaacaccattatggcacttatttttcttctatactaaacactcttgtattttactaccaaccccactggtctacaaccacattgctaaccatagcacggctattatgtcgtcagtaagccatgatctcatgctatttacggaggtacgcgacccccaagtacacttgacattcaatttttgctagccgccccgcaacttgaagacaataatcgtgctgccatcgtaagtgaagccgccgctcagcgccaatacccccggctctccccaattgctatgctaggagttctgtccataacacccagcacttaactaactttaactgcggaaacactcctttttacttcccaccacaacccccgcgaatctacttcaccacagcccacttcggtgccattaccgccattccataccccctcacccctccctcgacactccataaaag

SEQ ID NO: 614604 - DNA, 169 bp, Homo sapiens
gcagtgagcttcaaacggagatagcagacaaatgctctggggaaacacccaggcaaagaatagggcacaggtatattgagatcttcagaagtagcaggagtgaaatcaaaggatactatgatccaccaagaaagactcgctgggacagcgacacgggaccactactgag

SEQ ID NO: 614605 - DNA, 317 bp, Homo sapiens
  misc_feature (23)..(23): n is a, c, g, or t
ctgaggggacctgggggctttantaaggtttctcccctgggggctttactcatagtggcacacccttttaaaggggggtcagcctcccctcccccccttccttccctgtccttggatttcagggacttggtgggcctcccgttgaccctatgtagctgctataaagttaagtgtccctcaggcagggagagggctcccagagtttcctctgtacgtggccatggccagaccccccagtcccttcacccccccctgctccccacgccccccccatttggggggctgtttttaaaaagtaaagtttttagaggttcata

SEQ ID NO: 614606 - DNA, 420 bp, Homo sapiens
  misc_feature (79)..(79): n is a, c, g, or t
  misc_feature (123)..(123): n is a, c, g, or t
gagaaaaagagggtattggacttactgaagaaggtgtgtattgacacctttataactgaaatgaactatggaatgtctntgtttttaatatcttaaaagactaaaagattaagagtaaggtgntgctgggcacgctttataggtgtggtggctcacacctataatcccagcactttgggaggctcaagcgggcagatcatgaggtcaggagttggagaccagcttgaccaacatggtgaaaccccgtctttactaaaaatacaaaaattagctgggcatggtggcgcacacctgtaatcccagctactcaggaggatgaggcagcagaatcacttgaacccgggaggtggaggttgcagtgagctgagatcgcgccactgcactccagcctggacaacaaaccgagactccatctcaaaa

SEQ ID NO: 614607 - DNA, 384 bp, Homo sapiens
caccactcctatagatcagtgtttgaaatattgggagaattaccaaaatgtgacacagagacacaaagtgagcacatgctggaaaaatgatactggtagacttgctccatggatggttacaacaaaccttcaatttgttagcaaagtgcaataaaacaaggtaggccttcagcctgggcaacatggcgagatctcgtctctacaaaaaaaaaaaatacaaattacccaggcatggtgctgcatgcccgcggtcccagctacttggaaggttgaggcacgacaattgcttgaaccaggaggcggaggctgtagtgagccaagactgtgccactgcatgctactgtttttattatggggactgatctataggagtggtgggggatc

SEQ ID NO: 614608 - DNA, 266 bp, Homo sapiens
cgatatgtgaggtgattagaggatcgccggggtgcatgcatgtggacatcgagcatgagaacaacaaccgctttgagcgagtatgagtcggtgtggacagaagcggatacgggccaccactctcctgcgaacgtggccttccgaggctcctggccttcatccatgctgcagcgcgcaacagagcaacccggaccagtgactgctgcacttggactgcgcgactgggcgatgacacctctgcgagctatggcgaacgccaccaacta

SEQ ID NO: 614609 - DNA, 291 bp, Homo sapiens
tgaatggttccaatatcttactatacaaacaagcgtacaatgaagaatatccttttgcatatgtgagtatatcgtgtacctaaattcgaacaaatggaactgctcggacaacatggtatgtgcatgtataacattagacagacaaacgcggctatgcttcttctgttttcgtttttgtaacttaccggtacttgtaacgtaatacgtgtgttatgaaaaatatattgacttgttaactgccctctagcatgtcagctatactctcaccagaataaagtatgatcaacaaaa

SEQ ID NO: 614610 - DNA, 164 bp, Homo sapiens
attggtgttgaggatcctgacaggacgacacccagttacgtgctttacggacacgagcggtcatcggggattcggcagaacaagttggctgaaccggagaaacgtgtgtgacgcgaagcggtgatcgggcgcgagttcgggaaccggttgtggcgtcggacctt

SEQ ID NO: 614611 - DNA, 674 bp, Homo sapiens
cacggtggctcacgcctgtaatcccagcactttgggaggccgaggcgggcggatcacgaggtcaggagatcgagaccattctggctaacgtggtgaaaccccatctctactaaaaaatacaaaaacttagccgggcgtggtggcaggcacctgtagtcccagctactcaggaggctgaggcaggagaatggcgtgaacccgggaggcagaacttgcagtgagtggagaacatgccactgcactccagcctgggtgtcacagcgagactctgtctcaaaaaaaaaaagaagaaagaaagaaaactatacttgtgccccttacattgaatacaaaaaaaaaaaaaaacaaaaaaaaaacgtttttgggccgcgccttgggccccggagaagaaagtttttctgaagaaaccacttgcggtttgggggcgcgcgcgggggccccggtctggtttagcgtgtgcaactgttggctccatggagcgtgctccctcaggagaaaactccgcgggcacgggcacttgggtgctgtggggtttccttccccatagtaaaaaggccccgcgggggggacgacggagggtttcggtataacatcctccagaagtgagtcggggggcccttgggggcttctcacaggatgttccgcgaggcgtattaaatggccgcccgctgtgc

SEQ ID NO: 614612 - DNA, 826 bp, Homo sapiens
  misc_feature (595)..(595): n is a, c, g, or t
  misc_feature (671)..(671): n is a, c, g, or t
  misc_feature (702)..(702): n is a, c, g, or t
  misc_feature (716)..(716): n is a, c, g, or t
  misc_feature (720)..(720): n is a, c, g, or t
aaccagggcccagctcagaaatcagcgctgatcaaataaagcacacattccctttggcactaaatttgactcggcagcgtctgtacagggatcctggcaaaaccagaacattcagcctttagaatcactggggattggctcaccgctgtgtggaagcacaactgttatttctgaatgccatccacgtggctcagccactgagatgaagcaccattcagaagaagcaaatgtgtgctctatgtttcacccagtctgatttcgccaagatcacacagataggttctacaaagaaagcactattgccattatcatcgaaatacaaatctacttttggaagacaagtgccttataaatacaccaattgaaaaacaagcaaagtgaatttaagctacggtctcactctgtcatctagactggagtgcaatggctccatcacagctcactgcagcctcgacctcctgggatcaagtaatcgtcctgcctcagcctcctgagtagctgggactacaggcatgtgccaccacactcagctaattttgtatagatttagacgtggggtctccctatgttgcccaggctagtctcaaacatctangttcaagcaatcctctgcctcaacctcccaaagtgctgggattatgggcaagagacctgcacctgcccttgtctgnttatattagggggttctacacaagattgtgngaaagggtttatancaanaaaaataggtttgacaattagtaaccattgacccagctgctaattgacagtgaatatttcatttcagtgactctactttgttggtgacaaagctctactgaccggg

SEQ ID NO: 614613 - DNA, 777 bp, Homo sapiens
ggtgagagaggtatgaaggttatcgaaaaccgggccttataagatgaagaaaagatggaactccaggtaaatccaactcaatagaagctaagcacgattgcagaagaggcagatagggaagtatgaagaggtggctcgtaagtgggtgatcattgaaggagacttggaacgcacagaggaacgagctgagctggcagatgctcccgtatgccgagagatggatgagcatggattagactgatggactcagacaccctgacagttgtctagaagttgctgctgtacactaaacagtattctcttacagaaacacgaagataagatatgaggagagaaatgcacgagttcttactgattcatactccgatggcggcagagacccgtggctgcgtttgctgagagatcggtaaccaactgctggaaaagacaatagatgagcctggaagatgagctctatgcccaggaaactgaaggtacaaggccattagcgaggagctggaccacgccctcaatgacatgacctctatatacaactgaaatgcaccaaagaggagcacctctgtacacacaaggatgctgtgaccagaccctgcttgaccctgaatgagatgtagacacgccccaagtcccaccctgtctgctggtcctccctctgagccagactccgcctgaggccagactgcgcgaagctgagcttcaaactgaggggctgatctttaactggaaggctgcttgctcctttcacaccccctccttccctgcgtcttcgccgcaaca

SEQ ID NO: 614614 - DNA, 513 bp, Homo sapiens
gcggcagctgatcacatttaacaaatggcagttccaaactcctgaagcaatgggtgaaaaataaaactacagcaaaacaaacaaaaaagaaaaaaaagggggaaaaaagatgcatctgtcttcagtagaaattgtgcagaataccaagcattggtccctttattctccggtaagggttaattaagctcgcctgttttgtgcgcagcctcctcctcatcagggttcatagagtgaaactctgccacatacaggctcttgtcaatgctgctgggtatgggctttatgtcagtcatcagctggtcctcaatgccttttagattgaaacgatcttctgaggtgatcaggttaatggccagacccaggtgaccataccttcctgatcgaccaatgcgatgcaagtacgtctctgcatttttggggaagtcaaagttgatgacaacattgacagcctggatatcaattcctcttgtaaaaaggtctgtgcagaccaggttcctgcacagtccattcgag

SEQ ID NO: 614615 - DNA, 1133 bp, Homo sapiens
  misc_feature (258)..(258): n is a, c, g, or t
tggggcccggttcccccctctgccccccagcccggggtgtcggagtgtgaacactcattctcaaaaaaaaaaaaaaaagagggggggtggggagagagagccttttccagagaaatttttaagaggagggcgcggggcccgcgggaccccgaggcccgtgttttccctaaccccttgtgggggaagacccgacatgtgtgggcgagatctccgcgagaggctccaagagaattgtggagaacaccctctcgctgtggnccccacactgtgtgtgtggaaaaccccctcttctctcttctctcttaaacaattctcccacagacatacttttctctcgtgtgggcacagtgtcgtgtgtgagcggtgtggcgcgcccctgtgtgtgcgctcctctcggacgctatcacctgtgtggggggagaggcgcgtcttgagcgcggccgggcgcgaaaacactcgcgtgtgttgtgccacccccgttgtgtggagaaagagtctgacgagaagatgtgttttgccccaagcgatgaaaacgcccctgtagaaatgtcgtgttgatgtgtggccaataaggtggttgcccactctctacccagaaagccgccctgatggggggcgcacaccaaaacaagcaggaggcgccctcttttataaaaaaacacccccccctcggtgggtgttctctcacaaaaacgaataacaacacacgaagcgggaggggcggcggtgcatcactctccctattaaagaggcggggcgatgggacgactctatctcccccccgaaagaagtgtctctttgaaccccctcgtttatatgaaaacgaccgcaccccgcttaaatcataacacagcgtgctgtcttcgcgacaacattaattatctagtatcgaatcgtaagcgctcgttatgacgccgcgggggcgtgcatgttgccgccgcccacgttgtgtgcgcggctcaattctttcatgtcgggtcgcccccccgccgacgcctcttcttatcgcggggggggggggggccacatcaccccccgcccttcttctcttcgtgtcgtcctggcccaccgcaggcgggaggtgatctctccccccgctgatttggtgtagtcatctctcgttcctttatcaa

SEQ ID NO: 614616 - DNA, 205 bp, Homo sapiens
  misc_feature (35)..(35): n is a, c, g, or t
  misc_feature (71)..(72): n is a, c, g, or t
  misc_feature (154)..(154): n is a, c, g, or t
  misc_feature (167)..(167): n is a, c, g, or t
aaagtggtttggtttagacgtccatctggtttttnataacttctgtaagagcataatcaaacaggaatttnnttttctcagtggataggtcagtgaggagaagtgtggaaaggcctgggaaagacggatatttgaaaatgaagtcatggccctnctgagagactttnctaaaaacaaaaacaaagagcagagactacgtgcccca

SEQ ID NO: 614617 - DNA, 573 bp, Homo sapiens
  misc_feature (568)..(568): n is a, c, g, or t
agacttaatgtcctttagcttgtgtatataattgtgttgtatagtctcagagtacattctaaccctacatttctaatcattgttattggtaatcttttctgtgaatattaggtttcctccagaaatagtctgttatttggtaaagttatctgtgtgctcatgtacatcttcctacgatttacaggcaaatcacagtaatgacaatggtactgggtgaattctgaatatacttgctaaatggcacatgcactacaagaggaaccttttgggttatttaatatgcacagaaaacattagaaaaaatttattacagaattctaattccagtatgaatagtggaaacccatctgtaaattagatggatgttggatggaaaatgacattgctaaatttgaccatttctttttacctactaatgtggaatgctttgtatcataaaccacagggtctgaaaggctccgttacagggagcatggtctgttgaagatttttaaaatgcatttttctagaagaaattctgtgcaggaaatgtctaataaaacggtgacggttttaaagaataagcccntgtgt

SEQ ID NO: 614618 - DNA, 135 bp, Homo sapiens
tgcaacctctgcctaccacgcttcaaatggctctcctgcgtatcagcctcccgagtagctaggattacaggcatatgccaccacgcctggctaatatttgtatttttagtagagacggggtttctccttgttggt

SEQ ID NO: 614619 - DNA, 125 bp, Homo sapiens
aatgtctcactggaagtatatatatatatatatatatatgtatgcgtgtgtgtgtgtatatatatatatatatatgtatatgtttctgagtaatttttaaaaaataaaacaggttaataagaaga

SEQ ID NO: 614620 - DNA, 169 bp, Homo sapiens
agagagcatattatgcgactgtgagtcgtcgtagttagagtttgctaggcgaatagtaatgaggatgtaagtccgtgtgctattatgagaatgactgcgccggtgaagcttcagggggttcggatgagaatggctgttactacgagggctatgtggctgattgaagagt

SEQ ID NO: 614621 - DNA, 954 bp, Homo sapiens
  misc_feature (21)..(21): n is a, c, g, or t
  misc_feature (29)..(29): n is a, c, g, or t
  misc_feature (42)..(42): n is a, c, g, or t
  misc_feature (55)..(55): n is a, c, g, or t
  misc_feature (72)..(72): n is a, c, g, or t
  misc_feature (83)..(83): n is a, c, g, or t
  misc_feature (86)..(86): n is a, c, g, or t
  misc_feature (100)..(101): n is a, c, g, or t
  misc_feature (109)..(110): n is a, c, g, or t
  misc_feature (131)..(131): n is a, c, g, or t
  misc_feature (137)..(137): n is a, c, g, or t
  misc_feature (150)..(150): n is a, c, g, or t
  misc_feature (155)..(155): n is a, c, g, or t
  misc_feature (168)..(168): n is a, c, g, or t
  misc_feature (175)..(175): n is a, c, g, or t
  misc_feature (183)..(183): n is a, c, g, or t
  misc_feature (190)..(190): n is a, c, g, or t
  misc_feature (206)..(206): n is a, c, g, or t
  misc_feature (223)..(223): n is a, c, g, or t
  misc_feature (227)..(227): n is a, c, g, or t
  misc_feature (231)..(231): n is a, c, g, or t
  misc_feature (239)..(239): n is a, c, g, or t
  misc_feature (248)..(248): n is a, c, g, or t
  misc_feature (261)..(261): n is a, c, g, or t
  misc_feature (263)..(263): n is a, c, g, or t
  misc_feature (268)..(268): n is a, c, g, or t
  misc_feature (282)..(282): n is a, c, g, or t
  misc_feature (287)..(287): n is a, c, g, or t
  misc_feature (293)..(293): n is a, c, g, or t
  misc_feature (300)..(300): n is a, c, g, or t
  misc_feature (321)..(321): n is a, c, g, or t
  misc_feature (338)..(338): n is a, c, g, or t
  misc_feature (340)..(343): n is a, c, g, or t
  misc_feature (345)..(345): n is a, c, g, or t
  misc_feature (364)..(365): n is a, c, g, or t
  misc_feature (380)..(380): n is a, c, g, or t
  misc_feature (386)..(387): n is a, c, g, or t
  misc_feature (391)..(391): n is a, c, g, or t
  misc_feature (397)..(397): n is a, c, g, or t
  misc_feature (399)..(399): n is a, c, g, or t
  misc_feature (403)..(403): n is a, c, g, or t
  misc_feature (406)..(406): n is a, c, g, or t
  misc_feature (408)..(411): n is a, c, g, or t
  misc_feature (417)..(417): n is a, c, g, or t
  misc_feature (419)..(419): n is a, c, g, or t
  misc_feature (421)..(422): n is a, c, g, or t
  misc_feature (424)..(424): n is a, c, g, or t
  misc_feature (427)..(427): n is a, c, g, or t
  misc_feature (430)..(433): n is a, c, g, or t
  misc_feature (938)..(938): n is a, c, g, or t
gcttgcgcagaaagttaaaanaatgaaanatctattattgcnaataatgtgggtntttctagtgagaggcgnaaggtgtcaanganaaagaggagggttnnttcagtgnnctgtgtggtcaacgagagccnatgtangagaaagagaganaaaangaggctcccagcnggaggcntgccccancgcccancagtggaggtggctancgtggctcgctccagcnaaanaagntggcactnaaaaaaaanaaaaaaaaaaagnanctgangctggtagggtgtnttcangctganccaaaantgggggtgttgtgtcctaaangatgtcagttgcaaccngnnnngntacaaaaggaaaggccaannaaaaaaagtgttganggaggnnaaanaagaangngggnggngnnnngggagngntnntnttnttnnnntttagtaaatgtatttgctgaaagaactgtggaaaaaaaggcagaagcaagtgaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaacaacacagatgggaanaatactgtggcctaca

SEQ ID NO: 614622 - DNA, 524 bp, Homo sapiens
  misc_feature (14)..(14): n is a, c, g, or t
  misc_feature (17)..(17): n is a, c, g, or t
ttcgtggcccaatnttnaacggggcccggcggggtatcttttgtaaaaccccccacacaccaagcaacggacaccagctggatgtctccaattcaagtctaaaaccatctacctggaaatagtgtcagatcccacaggttggggactcagtccccaagactgccccccagttacagacaccagtcataagttcaggccttcgaaacttctgactgattggctccaagttggagttcccatgtcctcctctttgggttcaaataatttgctggagtggctcaaataactcagggggatacttacttacctttactggtttaatataaagcaggggtccccaacccctgggccgcagaccagtaccggtccatggcctcttaggaacggggccccaccgtaggaggccagcgagcattaccgcttgaactccacctcctgtcagactagcgggcaggagattctctggagggcgaaccctattgtgaactgtgcctgcaaagggatctagattgtatgctcctatg

SEQ ID NO: 614623 - DNA, 386 bp, Homo sapiens
  misc_feature (170)..(170): n is a, c, g, or t
  misc_feature (194)..(194): n is a, c, g, or t
  misc_feature (208)..(208): n is a, c, g, or t
  misc_feature (213)..(213): n is a, c, g, or t
  misc_feature (239)..(239): n is a, c, g, or t
  misc_feature (270)..(270): n is a, c, g, or t
  misc_feature (359)..(359): n is a, c, g, or t
gctccaaggccagggggctttgctcatgttgagatgtcaggcttcctggaggcatcaggctttgagccctgctggggtccaactgactgacaggtgtcgcgcagagatgtcctcattctgtgcctccttctgtgcctcctaccatgttccctttaactgtgcctcagtgngggttagggaacaattttggtatngaatcaagtttatncaggnaattcacttgaggaactaaccagctnttactttctgctagaatgatggacatgaagnagagtaaagccataatgctccaaagggcctggtttctctgatacaaacatatttataaggacatattcctgggggtcttgggaggggtngccacatcaagaattagggaagggggg

SEQ ID NO: 614624 - DNA, 497 bp, Homo sapiens
caacttctgtattttgaattagtttaagaaagatcttctttacctcaggtttataagggaattaatcttgttttattttcatgcttatatgacttcatattttacggtgaaatttttatctatttgaaattttactggtgtatcctgctaagtttcatcaatgtaactcttcagttgttcaaacccaattgttaaaaaacttttaacattttaaacatttaaacttttaacattcccacttcaactttagaagttacatttgtcatatattaaaactccatattgatttcaaaatatttctagattttatgttttgtttttttatcttattatttctagttttaattgttttgaagcattataatataatatgccttatgacctgttcagaatggttttctgctgtagttcttaaacagactttccctgattattatattctgtatttatataaatccaacaacccttgtatgtaaatataaatgtatataaatttc

SEQ ID NO: 614625 - DNA, 817 bp, Homo sapiens
  misc_feature (389)..(389): n is a, c, g, or t
  misc_feature (411)..(411): n is a, c, g, or t
tggggagcctcaggggtctgtgcctggaagaaggaagctgtgataggttatgtgaaagagatgtctcctcatctctaatggcttaccgagacagctctcgattcagagacgagacttaatatggtatttgtagcacaatacatcacacaggtaaatgtgctccaggaagcctcactagtcactcgtcgatcatatacatactagatgtgctcatttaactaaaaacctattggatggggggaaagagagatccgtcatatgtgttccggttcgtcattcagagaaacggacgatgatagagtcgccagcagcacgtggttctcgtaaggatgaatgcttgtagtgctgtctaaacgtaacatcgtattgcgtaattgaatggattcacngctaatctgacatttgtatgtnggcgcacgtggcaccggggtggcgtgaggagaactagggcgatttcgtatacaatggtgcttaactctcgtacgcggtgcaaagggcaaaggggccatagttcaccatacacgcaaccacccgtagggaactttctaacaccgaaaggctttgtaaaacttcaatgcataaatgcaatatgctccgttatgaagagaggtaagctagttatgtaagggcgaaaacagaagtagatagaagagtataccgatgctagtgataggaattcttgatgaatctcaggcaatatatgtaatagacgtgtctgtgattagataccggatgtggtatgaggatccatattcattaactgtatgatttgagccaaaactgtgatgatatccgtatactagtagtagaagtagaa

SEQ ID NO: 614626 - DNA, 526 bp, Homo sapiens
tcgtcaccttcgtgctaactactccataaccgacacccaagctactctactaaccaactacccaaccactctactaacctactctgtaaacgatcacccaaagctactctactaacctactacgcacacctactctactcacctattccactaacctaccacccaaaactactctactaacctactacgcaaacctactctactcacctattccactaacctaccacccaactctactaacctactccactaacctaaaactcaaacctactccactaatctaccacccgaagctgctctattaccctagtctactagcttaccagccaaatctactctactagccaactacccaaccactctactaacctactctgctaaccgatcacccaaagctactctactaacctactacgcaaacctactctactcacctattccactaacctaccacccaaaactactctactaacctactacgcaaagctactctactcatctattccactaacctaccacccaaatc

SEQ ID NO: 614627 - DNA, 995 bp, Homo sapiens
atgcccagcagattcagagtaggatcctaggagctgagtgctgccgaattgtctggacatctgagtatttgaaaaaacaggggttctgcaatctagccctgtacaggtgtaaagatcatagccgtcccagtcgtgtatatggtagctggacgagttgggacttcgggacagaggcacaacgagtaaactgatatctgtcagtgacggtattgacctccagtctggcactgagcctaaataaggttcggacagcttagtaccctacatgaagccagctgccatgtttgaacaggctgcaaagaaactcagggcaaatacatagatgagaagtgaccttctaacacataaactatttaataataggacataacttccccaatttctaattctagcacacaaatttacaatatgtaccgagtcattatccctataaaactacccaacattagggaaccaaaaatacgaaatcagcattggtgtcaatactatggaggaaagtctactgaatctggcttccagatgttaaattgtatcgtcctagaaatattgactcgaaccatatcccttatgatggatgcagactgtccaatggtgagttgcaatctttggttcaatatgtcttgtgctgtgctttgaccagtgtctataccgctttgaagtgagaatagaagcctgtatatctatgacctaggggtgctcgtgcgtataagtcacgctgtctagaactggcgggacgaaccatcactgacgttctgccatattacctgatactaatgccccaaggagaggctcgcttgcactctgtccctctacgaatacaggacgggattcgatttaagaatcggaacagtacacgtgatattggtaacacgcttacatacaagcacgtcttggtcacaacactgatttgcacataaacgcgctcttccacggtcaccaccactcggggtcagatgccccgagctctgactaccagagagaaccaaccgaatagc

SEQ ID NO: 614628 - DNA, 1273 bp, Homo sapiens
gatattctgccataacaggaatgaagtgctgatacatgctacaatgtggacgtaccttgcacaacattatgctaaattaaagaagtcagacactaaaggccgacagtattgtatggttgccttttacatgaaatggttgcagcaacaggcaaagtctagagaagcggaacagtatgattgagtggttcatcatgggctggaggttggaagggatattggggagtgatcggtaactgatatgggagctcgtacggggagatgcactgcatcagatattctcataattggctggtcatattatcggtaactttaatgagatgatgctatgacactacccactgtaattcgtattacagtccaagaggagtgaaataacactgtatactatctctaggtacaagggtgtgtatcagaacatagacatgcttagtagtaaagacccaagaaagtaggagacaagcgcatggtgccaaaccgcaagctggcgtgggtcctagtcaggtgcctgcgtggtagaaaccttcgggcttttcattgttgtgcagcgaaggcacagggataggggtatgtacgcatgctgtgtgaagaaaccaagcgggggacatacgcctgatgatcgaggacgtcggtattagcaatggctcgcacagaagacttacggagttttaacccatgggccttaagtggatagtttgtttaaaaaattccaaagtcggaattggcttttttgggcaacttggttccaacaaggaagcccccacaggcttccccattgggtcagcgaagttccacactccgttggcccaacaagggaaacggggcctcgggatgggcagatatgtgctgtcggactagaaaagcgacaaagcgggaaggcctaggaacacataaccctttggcacaacaagggggccctatggagagaagaggcccccaaagaaaggccaggaaccccctatttcccgtaggaggccacttcccctggtgggtccgtgacagcgactaaaacaggttatggcaagagacccaaagggaataccccaaggctacccatcccaaagtcaacttatttggctgcgagccaacaaaggtcccaagttggaaggcaatcgacatttacttggcgcgggttcgcgaaaattgggcttagttataacacattatcccctttatagggtaggcctcccaacacacagccaaatagggaaaagaattctggcacacatatcactaactaggttaaggaactgcaaacaaagtgagaagcacacag

SEQ ID NO: 614629 - DNA, 343 bp, Homo sapiens
caggaccatgtagggtgcagtttttactccctaacccgtttcccgaaaaaggtgctccctcctttccagacaaatgagaaagggcaggatttcaggctggatccccctatgggttctccctcccccagcctggagcacgggaggggaggtgacggttggtgactaatggatgggtagtgggctgaaaaaaggggattaggaagggctattccaggctcagccctgttcctgcagttttgccgctgagtgtaggaaaaacaggcatgccagaccagggttagggttgtgcccagttgggccccggccatgggtggggtggcccaataaaccccgtggactccca

SEQ ID NO: 614630 - DNA, 118 bp, Homo sapiens
aacaacaagctgatccgtgagctgaatggatgaggtgacccggctgcgggaccttctgtacgcccagggtcatgtcagtgatgtcgccaagaccctgggcgtacagaaggacccgcag

SEQ ID NO: 614631 - DNA, 685 bp, Homo sapiens
  misc_feature (240)..(240): n is a, c, g, or t
  misc_feature (307)..(307): n is a, c, g, or t
  misc_feature (625)..(625): n is a, c, g, or t
  misc_feature (655)..(655): n is a, c, g, or t
aattatgcatcgtaggagctgcggttgtacactctacaagatgaggtttcggagccgcagctctttagactcataattgagctgtgcaccactctgagtgtggtgtaagcaatctgttttaggagatgagagaactcgagaggaggggacagcttgtgaagaaatcggtggatttttgcttcaggtgaaaatggccctgtgggtaagaggcacctgtgtggtggatgtgaagaatggcanaggatcagagcttcctaactcagatatgagagctgactgcacactcacactggctgactcagacttnctggctttaatgactgggaaaatgaatcctcagtcggccttctttcaagcaaattgaaatcactggcacatgtgtctcgctatgaagttacacaatcttcagcttcagccaggcaacgctaagctctgaagaactccctctggctactcttgtcaagatgagatatatagatatatatccatacattttattgtcagaatttagactgagactacacattggcaaatagcgtgggatagatttgtttctaatagggtgtgaccaatcctgtgttttctatgctctgggtgaatagagcctgatggtatactactgctntgcgggattgcatacaactgtgcattacanagtttatggtgattatggcctggggtgctt

SEQ ID NO: 614632 - DNA, 338 bp, Homo sapiens
tctctcttaggctcacagtcagttaccaaagtatcttagattaagatttggaaaccaaagaatgcataattagaagtgtcgcgtatcatgcaaagtctatgaaatcctaaataaggtaacacagttaatcatttaaagcacaatgcattattcttaaaataaaccagttcgtaagtgaatactgcaaattaaaacctgtcaaaccacagcaaatgataaggattaaacatccattatccacaatctcatttgaacctactcccatggatttgagagggaacccaaaagttcgcaaacctctctgagatgtgtgtcagagagagtattctaaagcccta

SEQ ID NO: 614633 - DNA, 209 bp, Homo sapiens
tggggcgcgaggccgggtgttgctgggtggcacagggagaggtgtgtgtgtgtttgtgtgtgtgcgtgagtgtgagcgcgagtccccggacggggctgcttctctcgctctctccctcgctagctctacccctcgctgccgtctctgcccccattaaattattggttgactcatcccggccgctgtcgctgccgccgccgcgcccacaa

SEQ ID NO: 614634 - DNA, 180 bp, Homo sapiens
gatgatctagaggatcccttcaaagttccgctcataaggggatggcatggctaggtttatagatagttggtgtggttggtgtaaatgatgtgaggcagtgagtccgatggaggttatgttgttgtgcaataaaacatgattaagtgatactagatataatgagatcagtgttctgtcctt

SEQ ID NO: 614635 - DNA, 117 bp, Homo sapiens
gactctgtatgcctcagtgcacagaatgagactttgtttaaaaaaaaaataatgattttgtcacctactagtccttcttagaaggatgatgggatccttagaaacttttcttggttt

SEQ ID NO: 614636 - DNA, 313 bp, Homo sapiens
tgagagcacgccacttcactccagcctgggagagagagtgagactctgtaaaacaaacaaacaaaaacaaaaaaaacaaaaactattctctcaccatatataaaaatcaaatcaaaatagattaaagatgaaagacataaatgtaaaacctgaaagtatgaaactactagaagaaaacattggggatatgcttcaggacactggtctgggcaaagattttttgggtaagatctcaaaagcaaaggcaacaaaagctaaaatagataagtgggattatatcactctaaaaacctgcacagccattgcactccgg

SEQ ID NO: 614637 - DNA, 133 bp, Homo sapiens
ttttattacaagttttcacatctgggactagtttctttttttcttttaactggaaatgccaacttcagcccaggttttttcacaaccaaactaaaaatgacttactactctggaaggtgctactctggaaggt

SEQ ID NO: 614638 - DNA, 80 bp, Homo sapiens
ttcggctggagcccaatgcccaggcccagatgtaccggctgaccctgcgcaccagcaaggagcccgtctcccgtcacctg

SEQ ID NO: 614639 - DNA, 124 bp, Homo sapiens
gagattcatgtcaattatcttgcttagatcaaataccacttgtaacagtcctgacctgagatagaaaacacacccacagagcctacaaggttgtaagaacgacgtgtatgactgtaacatagtg

SEQ ID NO: 614640 - DNA, 439 bp, Homo sapiens
  misc_feature (6)..(6): n is a, c, g, or t
  misc_feature (16)..(16): n is a, c, g, or t
  misc_feature (179)..(179): n is a, c, g, or t
gtcagncggatgtggntatccaggcggtgctgtctctctatgcctcgtggacgcacaactggcatcgtgctggactctggagatggtgtcacccagcaaggtccccattctatgagggctatgccttgtccccatgccatcgatgcgtctggatctcggctggtccgacatctcactgnactacctgcatgaaggatcctggactgacgcgtggctattccgttcgtgtactacgtgctgagacgtgaggattgtccggtcacttcacggacgaaactgtgcttgtgtagctctggtactttgcacaatgagatggccactgccgcgtcctcatcctcccttgataagagttacgagttgcctgatgggcacgtgatcaccatcggacatgaacgttgccgctgcccagagaccctgttccagccatccttcatcggga

SEQ ID NO: 614641 - DNA, 913 bp, Homo sapiens
  misc_feature (17)..(17): n is a, c, g, or t
  misc_feature (661)..(661): n is a, c, g, or t
  misc_feature (672)..(672): n is a, c, g, or t
  misc_feature (674)..(674): n is a, c, g, or t
  misc_feature (685)..(685): n is a, c, g, or t
  misc_feature (693)..(693): n is a, c, g, or t
  misc_feature (695)..(695): n is a, c, g, or t
  misc_feature (697)..(697): n is a, c, g, or t
  misc_feature (699)..(700): n is a, c, g, or t
  misc_feature (730)..(731): n is a, c, g, or t
  misc_feature (751)..(751): n is a, c, g, or t
  misc_feature (753)..(754): n is a, c, g, or t
  misc_feature (761)..(761): n is a, c, g, or t
  misc_feature (768)..(768): n is a, c, g, or t
  misc_feature (772)..(773): n is a, c, g, or t
  misc_feature (798)..(799): n is a, c, g, or t
  misc_feature (802)..(802): n is a, c, g, or t
  misc_feature (806)..(806): n is a, c, g, or t
  misc_feature (853)..(853): n is a, c, g, or t
gggactgggggcatttngtgttggctggagctggagtaacaagatggcgtcgtccgcggagtgacaggggtccctctgggccggagccgctggcagtggtggcagcgtgtatcgccgccctagctcaccgcgccccttttccagcccgcgacgtcgccgcgcaagcgaggcagcggcggccgccgagaaacaagtggcccatgctggtaacctgcctgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacgtctatttggcgatcaacatcgcgaacggcgaggaagtgggcagggaagctgggagctgagaaggccaggcatccccagttgctgtacgagagcaagctctataagattcttcaaggggggttggcatnccccacatacngnggtatggtcangaggactncnangnnctagtcatggatcttctgggacctagcctnnaagacctcttcaatttctgngnnagaaggntcacagnggcnngacttatgttagctaccagatgatnngtnggantggatatgtgcatacgaaggggtttgatcacggagacgttgaaccanatgagctgcgtatggggatggggcgggactggagtggggtgcctaggggtgggttggggc

SEQ ID NO: 614642 - DNA, 913 bp, Homo sapiens
  misc_feature (17)..(17): n is a, c, g, or t
  misc_feature (661)..(661): n is a, c, g, or t
  misc_feature (672)..(672): n is a, c, g, or t
  misc_feature (674)..(674): n is a, c, g, or t
  misc_feature (685)..(685): n is a, c, g, or t
  misc_feature (693)..(693): n is a, c, g, or t
  misc_feature (695)..(695): n is a, c, g, or t
  misc_feature (697)..(697): n is a, c, g, or t
  misc_feature (699)..(700): n is a, c, g, or t
  misc_feature (730)..(731): n is a, c, g, or t
  misc_feature (751)..(751): n is a, c, g, or t
  misc_feature (753)..(754): n is a, c, g, or t
  misc_feature (761)..(761): n is a, c, g, or t
  misc_feature (768)..(768): n is a, c, g, or t
  misc_feature (772)..(773): n is a, c, g, or t
  misc_feature (798)..(799): n is a, c, g, or t
  misc_feature (802)..(802): n is a, c, g, or t
  misc_feature (806)..(806): n is a, c, g, or t
gggactgggggcatttngtgttggctggagctggagtaacaagatggcgtcgtccgcggagtgacaggggtccctctgggccggagccgctggcagtggtggcagcgtgtatcgccgccctagctcaccgcgccccttttccagcccgcgacgtcgccgcgcaagcgaggcagcggcggccgccgagaaacaagtggcccatgctggtaacctgcctgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacgtctatttggcgatcaacatcgcgaacggcgaggaagtgggcagggaagctgggagctgagaaggccaggcatccccagttgctgtacgagagcaagctctataagattcttcaaggggggttggcatnccccacatacngnggtatggtcangaggactncnangnnctagtcatggatcttctgggacctagcctnnaagacctcttcaatttctgngnnagaaggntcacagnggcnngacttatgttagctaccagatgatnngtnggantggatatgtgcatacggggattgtatgcgcagagacattagccagagtacttgctgatgggtattgggcgtgcgtgggatagggattgcctgtgtttgggtggggcc

SEQ ID NO: 614643 - DNA, 82 bp, Homo sapiens
  misc_feature (38)..(38): n is a, c, g, or t
tctcatccaaacccccccaacgcttccccggcgcagtnatcctcatcctcccccccgggcttacatcctcaaaaaaataaaa

SEQ ID NO: 614644 - DNA, 1520 bp, Homo sapiens
ctctgcttgtgttggatcctgtcgtactgccctgtttcgtgtggatgcgcttcttcttgtcttctttgttttccctcttgtgtgttcctctctgtcgcttttcacgtttgtctgtcactcgcgctctgtgtgcacgggctctcttgttgcttcgcacacgttttgatactgtctttgtgtggtaacacaatcaccggcctccggtttctgtccgttgcatccttcctgaggtgcgcattttcttgtctccttggcccttcgtggttcgtccgtgtctggacaactggtgtgtctatcactctgtggctggtcttcgcggggccgtgccatggctgggaatgtttagagggccggacatggggggccatctctggtgcctttcctatggccttttgcttgtgtgctttgagtttctagcaccctgtccaagtgtgccccgttctgcccttttatatcgcatctgtctctgttctgccaccggttctcactttttttcgcatcggcttttgctctatgtttattacctcccccatgtgttttcactgttcagtctcttatcttttgactgtgtcacgcctctccacgatactcccctttcgcttgctgagttaatcaggttggtacctattatctagggataagttgaagagccccctgccctctgtagtcaagtatgatctttgccaactctagcggtgcctcgtggacagttcccacttcagtgccctacgctccgcatgccgtggttttccctccacttccgtgggaaagcatcgtatcgtttgtcttggtgtttggtccgcctatgcaacgacttctgcggattcgatactttcttgcctattgctcatccacgtgatgagttttcccccgcagactcgtctttgtgcctgtgggtcatccccctgcactttgctcctgagctcatggtgccttgtccactgctagcgtttcccacgagcttctccaaggcggcacagtgtctgtggagtctccacatgctcatcccacacttagtgtctcgccagtgcctgccactatcgcctacctttcaggtcagccctatggcgtatcgacagtggctcctcatctgtcccctcgtgtcgcccgtgtcggttccaggagctgcgagtcacgttcgtacccccatacatcttcgtgtctcgctcaagacgactcttgtgcaggaatgttgctggggacctcaccagccaggagcgcgtgctaatgccgtagcaagccggtccagcctaagaacccatcagcccctccaggagcatccccaagctctgtgtgtgactgatagctttctcgtccctcaagcctgtcaacagggtccgagatttgccatcgaacaatacgacaaccgtcgtacttttgttcttcttgtagttttgataaacatctgacagctggagctgataaatttatcttggggaaaccttcagaacctggtctattttgatgtcgtggaacctcttactgctttcaatacacgattaaaccgtcacctgttttga

SEQ ID NO: 614645 - DNA, 405 bp, Homo sapiens
tgatccacagttggttgaatcctcagatgcagaatcggtggatacagagggtcaactctataaaacatcttctataactattgagtctatattagccactattagagaataaagtactaatcgttatttttaatcacccaaaggaaaaactattgtttctttaaaaaatgtcttcaattttgcagtatatcaagtgtgttagctatcaagcttctagaccaataaaatatataaattatccagcaaagtagggttaaaaaaaatcatgctgtctaaagagcattatcaaaattttatccagttataaaatgagactgatgtttatgagctacgtctttcattgtcatctgcaatcagctcattcatcttctaggaggtagcttaatcaattgtggtttaattata

SEQ ID NO: 614646 - DNA, 556 bp, Homo sapiens
cccaaaaaaattcccccccgtccctcccaaaaaaaacaaaaacccgggccaaatttaaaaaacggtttcccagaccccaaaaaaaggggcccccccctggggggaagagggggggggtttttttcccccgggggggggttcccccaaaggccccaggggggggggcccctttggggttccccttttaagggcccaaaagggggggggaccggggccccccccccccctggggggaagggggccccccccccccttttccccccggggcctcccccccccccccctccctttttggggggggggggggggtttccccccccaagggaggggcctttttccctttaaaaagaaggggggggttccccttcccggggggggttttccccggggggtttttttaacccttaaggaaaatttttttaaggccccggccccgggcccttttcccggggtttggcccccgttaaaatttggaaaaaaaaaaaaaaaaaagggggcgggaaaaatttgtttttaaaataaaaaaggggggggttccaaaaaacccaagggccca

SEQ ID NO: 614647 - DNA, 148 bp, Homo sapiens
ctggtggtgcccagcgccatgcatgggtcatccccatcggggcccccaccaggcaattctccaacagttcccagcggatgtcgtgcaacttccatgggtaccccagcacagcaggcggtccagcatgtcaccccagtgcagctcctgc

SEQ ID NO: 614648 - DNA, 475 bp, Homo sapiens
  misc_feature (9)..(9): n is a, c, g, or t
  misc_feature (18)..(18): n is a, c, g, or t
  misc_feature (70)..(70): n is a, c, g, or t
aggaataanggggaaaanttaatgtttaaaagggttaacaggtttccaatttggggaaagatgaaaacanttcctagagatggatggtgcccaaaaggttcccccaatagtgtgaaatgtaccctaatgcccactgaaactgtacgttaatccatggcctaaaatggtcaatgttggctgggtgcggtggctcacacctgtaatcccagcactttgggaggcagaggcggggagatcacatgaggtcaggagtttcgaggccagccttgccaacatggcaaaaccccgtctccactaaaaatacaaaaattagcccaggtgtggtggtgcacatttgtgctcctagctatttgggaggctgagacacaagaatcgtgtaaacccgggagccagagtttgcagtgagccgagattgtagcactgcactccagcctgggtaacagagtaagactccatctcaaaaaataaaaaaaaa

SEQ ID NO: 614649 - DNA, 105 bp, Homo sapiens
agacagtgtggaatttgtgaatttgaaaaaaaaaagtgtactttatggattcaggattcaaaaagaatcatttggtatcgagtttaccccagacaaagggaaaca

SEQ ID NO: 614650 - DNA, 370 bp, Homo sapiens
  misc_feature (102)..(102): n is a, c, g, or t
  misc_feature (104)..(104): n is a, c, g, or t
  misc_feature (291)..(291): n is a, c, g, or t
  misc_feature (294)..(294): n is a, c, g, or t
  misc_feature (335)..(335): n is a, c, g, or t
aatacaacgtttaatcatctggttgatcaagaaatgcaatgctcagtttaggaacagcagcagaaccagctgtgtacacgggacttttatacaaaaaaattngntgtttacaatttttattcacaaaaagcttaaaaaaaccagagaccaaaggcagcatccttgctaattttcatctacattaagaaaaaaaaaatcttgtaactaatgtttttattttccttaaaaaaaatatttcgcttaggcacaatttgctggtggctttacaagaataagccaggtttccacagnatnccccttgagtgatatgtttccatttctccgctttttatagntaaggcctttttttcttctctcacaaagcgcacgt

SEQ ID NO: 614651 - DNA, 678 bp, Homo sapiens
  misc_feature (588)..(588): n is a, c, g, or t
tgcccagtgttttgaaaaaatcatttcaatagccagttctagggctcctgaagtgtatttcaattccctttctgcagctacttgtgagactgaggcaggagaatcgcttgaacctgggaggcggaggttgcagggagctaagattgcaccattgtgctccagcctaggcaacaagagagaaactctgtctaaaaaaacaaagacaaaattagccgggcgtggcagtgcatgcctataatcccagctactcagaaagctgaggtgggaggatcacttgagcctgggaggtcgaaactgcagtgaaccttgatcatgccactgcactccagcctgggcaacaaagcaagaccctgtctcaaaaacaaaaacacaaaaaacagttgcccgtggctgggtgcagtggctcatgcctgtaatcccagcactttgggagaccgaggcgggtggatcatttgaaatcaggagttcgagaccagcctgaccaacatggtaaaaccccgtctctactaaaaatacaaaaaaaattagccgggcatcatggtgtgtgtctgtagtcccagatacttgggaggctgaggcaggagaatngcttgaacctgggaggtggagggtgcagtgagctgagatcacaccactgcacttcatccagcctgggtgacagcaagaactcgtcttcaa

SEQ ID NO: 614652 - DNA, 252 bp, Homo sapiens
ggatctactcaacatggtgagatctgtctcgataaaggtataggggcatattcggaccagagtaacaactctctccaatagaatccatcgactctcactgccatatcaccacaatcgctctcgtgccatagagtgcacccattgccacgccgccaagacttcacacgattatcaaattgtacagccagtgtgcgtagaagctagacatgtcaactagtattggttcttaagacaacaggatcacgatgaccc

SEQ ID NO: 614653 - DNA, 582 bp, Homo sapiens
tccatgagattggtacatgtgttgtaaacactattgaggtgagggagaactcagacctatggaagtacacgaggccaacacaattatgccccttgtgaatacatttgtaaatatttactcaactgaagatgttatgaataacccagtgtcagtctcacagacatttcctcatgacaaggggaattcatggatggacaatattatgtgtattgagaaagcagttgtctggaaggaccatactcaagaatcccatctggagctccccactttgtttctctaactgaaaatcctttgcccatagtccttttggctctgtgacctctgcctcaccccgatacggtgactcctcttttctctattcatagtagagcactgttagcccaccatatgactattaactgtcctcacagtggattccacaagatgtgccatcattcttgcaaacaaaacagctccccagatgcaggaaagggtaaggataaagcaatcgaaccctatctgtgatgtggaccaagtcacatcttggacataactgttcacagtacatggattcattccctaagcccctcagtggccatcttt

SEQ ID NO: 614654 - DNA, 108 bp, Homo sapiens
  misc_feature (39)..(39): n is a, c, g, or t
  misc_feature (93)..(93): n is a, c, g, or t
gaccagcgaggcctcaaggaccccgacggatgcacaganctgccagctcaccacatatgccatgggcgcaacatctacaaggaagggcagganggacccctgaaaccg

SEQ ID NO: 614655 - DNA, 158 bp, Homo sapiens
  misc_feature (51)..(51): n is a, c, g, or t
  misc_feature (54)..(54): n is a, c, g, or t
  misc_feature (80)..(80): n is a, c, g, or t
  misc_feature (114)..(114): n is a, c, g, or t
cttgttctttttgctcaaaggtgtgcaccagttcattgccccctctgggtnttncatttctccaggagaaacatcccagnaaccagcactgtttaggcctgatacctttctaangtccatgttcaattttcaataaaattcaaagaaatgctaaaaaa

SEQ ID NO: 614656 - DNA, 126 bp, Homo sapiens
gagttcactgtttcagttcttaccttctcattgagttatattatgctcactgtgtgtaatagttataaaatagattttctttcttttttttatttcctttctttccctccccactccccgtcgacg

SEQ ID NO: 614657 - DNA, 385 bp, Homo sapiens
  misc_feature (80)..(80): n is a, c, g, or t
  misc_feature (112)..(112): n is a, c, g, or t
  misc_feature (121)..(121): n is a, c, g, or t
  misc_feature (241)..(242): n is a, c, g, or t
  misc_feature (251)..(251): n is a, c, g, or t
  misc_feature (281)..(281): n is a, c, g, or t
cgacctaccgtaccccggaaggaaccatcactgcttttatgcatatggtggagtaccggcgtaatcagaagcaactacgngaaacgccggcgttgcccagcaatctgacttncaataccgnagaagcgcatcttctgttgcaacaggcgattgccgaagggctacgtcgctcgatacccatgaagttcagcccatcctgcaagcgtatggcatgaacacgctccctacctggattgccagnnatagcaccnaagcggtgcatattgccgaacagattggtnatccggtggcgctgaaattgcgttcgccggatattccacataaatcggaagttcagggcgtcatgctttacctgcgtacagccaatgaagtccagcaagcggcg

SEQ ID NO: 614658 - DNA, 161 bp, Homo sapiens
  misc_feature (144)..(144): n is a, c, g, or t
ctagtacttaaggatccggccggatcctgccaggatgtctgttctctgtggttgaaggaggaacggggcgagactgtgggaagatcagagtctaatgctcacggcacccggggcagcccctggtgaggtctgtgccaagctggnagctcttccttgcggct

SEQ ID NO: 614659 - DNA, 126 bp, Homo sapiens
  misc_feature (74)..(74): n is a, c, g, or t
  misc_feature (90)..(90): n is a, c, g, or t
agctgtcatatatcttagacggtgcacgcacactgttctgacacgtatgctttgcattcacaggtgaactaagncagacacctgttcctnaaagtaacacgaatctctttaacttcaccaccgcaa

SEQ ID NO: 614660 - DNA, 1209 bp, Homo sapiens
ccagatcatttctgtatttttagtagagacggggattcaccaagttgcccaggtgcttcctggtggtccttggttggagggtactatcagaaatggaggagcaacaaagattcagctgaagccctcactgcctgggactgggacccttgactcgtcattgtatgcacacctgaaactgcttatgtcgctgaggtgccaacctgctgatggttggaagctaattgagttctgatattgtgttgatacccttaagcattgggtttactttttattttaattaattaattaattaatttttgagacagagtttcactcttgttgcccaggctgaagtgcagtggcacgatctcggctcaccgcagcctccgcctcctgggttcaggcggttcttctgcctcagcctcttgagtggctgggattgcaggcatgcaccaccacacctggctaggttttgtatttttggcagagatggggtttctccatgttggtcaggctggtctcgaactcctgaccccatgatctgctcaccttggcctcccaaggttctgggattacaggcatgagccaccacacccaggaatgccggttaagttttatatatatatttttttgtagagatagggtttcactctgttacccaggctggtctcaaactcctgagctcaaagcaatcctcccaccttggcttcccaaagtgctgggattatagatgtgagccaccatgccctgccaagcattgggtttatttggtttttcagtttttttactcctggaataaggcccccacactggatttttggttatctgatcaaatatttattttgtccttggtgcaattgttttctgtccttctacactcattcctatggtgttttcttgtctagtattttgaatattgtttgtctataagaggcaaagtcgatataaaaaggatggatgtaggctgggcgcggtggctcaggcctgtgatcccagcaactttgggaggctgaggtgggtggatcgcctgagatcaggagttcgggaccagcctggccaaaatggtgaaaccccgactactaaaaatgcaaaaaattagctgggtgtggtggcgggtgcctgtaatcccagctacttgggaggccaaggcgggaggatcgcttgagcttgggaggcggaggttgcggtgagccgagttcgtgccatggcactccagcctgggcgacagag

SEQ ID NO: 614661 - DNA, 139 bp, Homo sapiens
gtcacacatccttcacggcatccgattcccaggccacgtcctgtgttcattcaacaacacttttcgggggtctgcagacgcaacacgggcgggggtcacgcagctcgcaatcgtcacatccatggtccatcagctgttt

SEQ ID NO: 614662 - DNA, 518 bp, Homo sapiens
attccttaacagttcattcttcccacagtcctcacattaaaatttagtgcaaactctactattaaagtaatttaagggagtgaacacagaaagctaagaatcattccatgtgtgatctcatttgccactttccgtttcaaaaagcaccagggaactattaatttcattgtgccatgaaatcacacccctcagtatgttcagaggcaaagagtcataggcatgtgcaggttgtacttccttcccagaccatctgctgatgtccaaccccctctattcttttctttgtgaccgaaacctttagcaacatccttaggtttatgctaatttatttctagaaaccaagaggtggaagtctgctaaaccatcagggctttctccatgtctgattattaagagaaatgtggagtgttgtcagctgcttgtgcatttttacctgtttctgatctttccctttcagggacctgatagcagaaaggagagaaattgaagagaatgcctgaggatggagataaaatccc

SEQ ID NO: 614663 - DNA, 290 bp, Homo sapiens
  misc_feature (1)..(1): n is a, c, g, or t
  misc_feature (15)..(15): n is a, c, g, or t
  misc_feature (155)..(155): n is a, c, g, or t
  misc_feature (175)..(175): n is a, c, g, or t
  misc_feature (215)..(215): n is a, c, g, or t
  misc_feature (241)..(241): n is a, c, g, or t
  misc_feature (284)..(284): n is a, c, g, or t
ngagggccacatctntaagagcctgggagtctgcgaaggccgggacccgttccccggcccacagtgggggtgtgcaaacccgagagaactgggaagtgccgtcagaagcgataactgacgacgtctaatgtctatctgaccgcagtcgctgaaanctctacaacttagttgaccntaactgccagagccctgccctgaattcctgttcttaattncctctttaaggattgcgtacccactngcagagtgctttaaggacgggggtaggccacgagggtgcaaanttcgtg

SEQ ID NO: 614664 - DNA, 298 bp, Homo sapiens
tggggaggggtctcgctcagtcccgggagcttttcccggtttcccctccccttcccgggtcattcccggcagggaggtgacgaggtaggggcagagcggatggaagccggagatctcaggttcccggaatactccggctggggccttcgggcttctcctgtcccctccctacccccgtgcctcgggtttctccctccgtccacaccgcccggggctactggactgagcggcgcccaggcagtcccgggggcccttctcctgctccccacccggccacactcccggtggaccggctacg

SEQ ID NO: 614665 - DNA, 176 bp, Homo sapiens
tccctatagtctacgagcatccagcccactagctgggagcagggccctgtcagctccagccccagggtcgccaggagtgacatggctgtacgcacaggtgctggccagtgctggcaacaggagaggctgcaccagcagtttgcacgaggctctggaggatgctcaggtgggcgaag

SEQ ID NO: 614666 - DNA, 81 bp, Homo sapiens
gaggaggaagagggcgaggaggaaggctccgaatccgaatctcggtccgtcaaagtgaagatcaagcttggccggaaggag

SEQ ID NO: 614667 - DNA, 306 bp, Homo sapiens
ctagcagagctacattctcgctcccggctgcagagctgtgatcccactgattctgatcccattactttaacccctggacacagatctctgatgtgcatcccaggactgcttcccctgtgtgatattgttctgcttaaagaaggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcct

SEQ ID NO: 614668 - DNA, 104 bp, Homo sapiens
tcagcatttccagcagcggtagatacatgcttccaggaggttagcatcattgatggcatccaaacccacgcccggcttctgataccagcagatccgctatccgt

SEQ ID NO: 614669 - DNA, 710 bp, Homo sapiens
  misc_feature (709)..(709): n is a, c, g, or t
ggcgccatttgatggcaggaagagtccggttctggagacagctgcagacagtggtggtgactgaaataagcttttacgcaaaatggatagctcatttggcagagctatcttcgtccaagctgtatatgcgccaaaggtgcttggctaactagagccagtatggtttcctatctcgccaggcatttcgcctctgtgagtttagcacgggttgtcaatcccgaaagcctttcccgactgcaggatcatcaggtgcggcatgagtctcaggtggcatgctcgatgcttccagatatatcgctctcggaaactagggtcggcctggatgagtcgtatgggacccttgtgtacgctccacagatcgagacggttccgagctgccgtggcgcaaccatacggtgggggattgtcgaccttcagatgggcactgtcttcacgagacggaataacgcctggttcataagacttttgcctggatgttctgagcgagaatgcctttatcagagtggctagaccatggaagttagtggaatggcgcattatggtggacatcgaatttcagggtaatgatgcacgctgtgtgatcgaacatgttgaccagtgcagataaacttgtttggaaagtgcctgagtagaatgggtgcaatacaagtgttggtccagaaatggttggcgagaagatttggaatcacgtgtttgcaagaaagtaggnt

SEQ ID NO: 614670 - DNA, 1257 bp, Homo sapiens
caaccccgacacagttagcatttgtgccgattttcctggttggaatggtgacaacagtgctggatgccgaaagtgctaaacgatgcactttggcttccaaggggtatgtgtcaagagatccgacccgtaaaggcatggcgaatgctccaagttggacaaccgaggcatgcgttgaaggcttctgtgaactagcaatccattaccgagcaaacatcgttagcaacctgacgtaagcccatgcgccctgccatctcctaggatgtctacgagaatcggatagcgtcatttgcgtgcttgttcgctgtggggacccgaggtgtgaggacttagtggtagtttcatcgaaataccccggtgtgatagggattggtcaaccgattttagcttgcacagtcaaaaccgattaagcaacatctgggcaagggctacaatagtcttcgtgctgatagaatggccagcacattggaagagctttaggagatagagagctgctatcaccttggggggaacaatagtgcgagcttgtacagatatgttctacagaaaatggtagtcgtgtacaaaggggcattgttgttcagtgcggtcggggcaaaggttaatgcattggggttggaaccacggctcatgggaattggatacaccgaacacgaaaagttgggcacacagacaaggggtgtggagtcgattatccaacgttggccgttccacgcggttggacatttactcacctgggaaaagcgccatttcccacaaggggcgcaaacagaatcaaagtctggcccgagagattaatggaccacccctggattattttgggggaatatatggcccaacaaccagagctgtacaccaaattcaggcgatttggccaaaaggatttatgggctttgcaggcctttgacaagggggaaacacgaggacttttagcagtccggccacggattccatgggtaaaaaaaaaaaggccttggggaacacgcaattggggccccccattaaagaaggttttcctttcgagaacagggttcacttaggggtatggatatctggcattgggacccaattttaggctaatgaactacaatcgagggttttccccttgggttgagcaataggcccccaaactggatagttaggtcttagaccagacagcattatttataccaaacggacgcgttatgtaccacagcccatttttgtgggaccatctcgacgtattagtgcatagtacaccggatgaggtctactcaacaa

SEQ ID NO: 614671 - DNA, 134 bp, Homo sapiens
acgattatttagctcccacttataagcgataacatagtgggatgttggatttctagtatcctagcatataatatcagtaaaggattatcctaccaatatgcatatcgtgtaagctagcaacaagaacatagact

SEQ ID NO: 614672 - DNA, 1709 bp, Homo sapiens
  misc_feature (354)..(354): n is a, c, g, or t
  misc_feature (1153)..(1153): n is a, c, g, or t
ggttaaaaaatctttaattggtttctcccaaatacacaatcactaagttccccaaacacaccaactatccaccaccacaggcaaaaatacaacaagttgcaattttcatttataggtgaatggtgatcacagtgttatatattcctctataacaaacagtgttcaaacaccttttaaaagaatccaacaacatgaaattatcctgacaaatatcttgtaaccaagtgcgtgttattattatatttgagagagcactcacaatgacatgaatattttattattcaaatatgtgtctcaaatattattatttctcaaaacacttctcgagagagaccacgagatatcatatgtgtngttcaaatctgtgtgcgttcatctctatattttcacacaacacaccccagagagagacatatacacgttatgtatacttaagtgtgtaacatatatagagcgccaaactcccagagaagatatattataatcctgtttatattgagcgcgccatctctgtctccatctccatatcctctataaaacgtgtgggtatatatttctctacgtgttgtaccccaagaaaatctttatttaggggtccatctccccaatatatatgtgtggagacacaaaaaatatagggacatattaacagagaacaatcttcacaccagggtgtatacacaccgtgcgacggtcattacacatccttccacagttgacacccgactttttgatggatgccccccaataatatactataagacgagaagacaggaacccttcttccaaacacgcggttctcctttaaaaaaacacccccatattaaggggcacacaggcgaggcaagaatctatttaatttatgaagggcccccccttaataaagcgagggaaaaccctcttataaaaacaacttctttttacaagaggaaaaagcatcttctccagttggcaaaaacattacaaccgggggcgaccgactattcatattaattttctgcgtgtgggccaacacgacggagaacatttaacaccggcggggtctaatatatgttgacccaccaaaaaccccccccccgaggttgtagtgctcatcgcttagataaatattacacagatggtgttacagccgaaacaaccagtttctataaanaaacgatatagcagggcacaattcccccatacagggggcgtatgaaaacaagcaccggacgtaaacgcgataatatatatttatccccgccgccgtaaatggatagaaacaaacacagggagagaaacgccgtagctaacagacatactaattttctgcgctcacatatatatgtagttgaagtggtcgcagacaacacaaggcaagacgtgagtgcactactgctacaacacacaccacaccccaccgtagggggaagtaaaccccccctcccctccaaaaacagcggggaccggccaccacttactacttaaatacaagacagacgctacattattatttacccacccaattagagctgaaaaaatatccaccccaacaacagagatattattcacgcgcgcaaagacagacactccttacaaggcggagcaagattaaatatatactatagagaacaaacaaatcagacacaaggagcaagtgaactctatcccaaccgtcacaccaataaatacacttgctgagcgaggacgaacaacatattacaacagcg

SEQ ID NO: 614673 - DNA, 305 bp, Homo sapiens
  misc_feature (78)..(78): n is a, c, g, or t
  misc_feature (191)..(191): n is a, c, g, or t
caaaatattggttgggggaaaaatgaggaagagtgaaaaatcaccctggtgacccactgaacaggtccccagagactnaaactccctaatctgaggaatttagaagggaagaaagaccaccctggtgaccatcaaagaggccatacagaggcaaaactccttatctgggagaaaattagaagtaattagancttctgcggggcatggtggctcacacttgtaatcccagcactgtgggaggctgaggcaggcagatcacctgaggtcagagtttgagaccagcctggccaacatggtgaaacccc

SEQ ID NO: 614674 - DNA, 337 bp, Homo sapiens
ctcaaattaaataatactttactttataatcattctaaaatacatattaatttttttgccatctaaacaattatcaacacctaaaaacagaatcatactgcatacccatttcttagtgtcacttttcagtaaataaatcaatttgtgaatgctgttgtacagaatattgtcacttactttttttcacatatactgtatcatagtttcatgaagctaataatcactgtactgcagaaatagtctaataggtcttttattcaccacactgcttctgtatttgattatggtgatatttgacacttgagaagcaaaagtggtgagacagtatcttcataaa

SEQ ID NO: 614675 - DNA, 378 bp, Homo sapiens
gccaggttgctggtcaacctcttcaatctggaaatataaaataatggtccacactcactccaagaactatagagggtcggacatcagctatatcggtggagttaatgttgactaatttaatctttcttccttcgaggaacttgagtgccgtgccaatgttgagccacagcctggattcgcttcatccggcgtccttgttcacaagggcagtttctgcccagtacaggacctccagaaggggaaagacagtttaacaccatctttcatgtcttcaaaaagatcgtccaccaccattggcggtttccgattggacagatacgagtagatccatatagtgaaagtacgttaatgtactatctcttgatcatcctccgtgga

SEQ ID NO: 614676 - DNA, 160 bp, Homo sapiens
cgaggtgctcagagtgtggtggccagttcaatgcctcacagctgatcaccggcgggccggtatccctgttgatccgcgggagctgacgagggggccaggcttcagctcttccgggttgttggggcccccagagtgggtttgccggagtaacggtgctggg

SEQ ID NO: 614677 - DNA, 355 bp, Homo sapiens
  misc_feature (317)..(317): n is a, c, g, or t
tgggccatttattttaatgattctggtttttactttcagaatttctatttttatatttttcatatccatctgttcttaattataactctctattttaatcatatttttattcttctttgttaccattaagagtattacctatacttatttaaagttatttttggtttgttctacttggattttgagagcagtaaatttatatcatgattgttgcatttgttggctgtctcttacaaattttttcttatgtgctttggaggtttcatttgtagctttatcctgagtgggaaattttcttctctctaagagcctattgngtggttgcttcctctcatctccctggaagcctggtctg

SEQ ID NO: 614678 - DNA, 172 bp, Homo sapiens
gagaaaattttaataataaaaagttttgttcccccccatttgtaaaagtgataatggccaggcagagtagtacatccctgaagtcccagtttcttaggaggccaaggctggaggatcacttgagcccaggtgttcaagaccagcctaggaaacacagcaagcccctttctca

SEQ ID NO: 614679 - DNA, 575 bp, Homo sapiens
gaaaagtaacatttaaaaatcctctgggtaattcaaattacagatttaaaagagcttaagatctggtgtttgttaatgcttctgtttattccagaagcataaaggtaatccattgccaagtatcattcttgcaaattatcctttatataactgaccagtgcttaataaaacaagcaggtacttacaaataattactggcagtaggttataatatggtggtttaaaaataaccatggaatacaggacttgtagccaatatgggtaattttcattcagtatgtatagtaagttttagatttgaaacctggaaatacagtacaactttgactgtcttaaaactgttggccaacaacaacatcaacgatttaatttctctttatcttgtactgaaacaacctaattcataacctgttaatttctcagccatcttttgaagcttgacaagaagagtctataggtcattatggtaaacgtttagcacgactttcctgcccagtgtcagcaaaatcctatctatgaatcctggtacggtatatccttgggctatctcgacaaaaacacctaccaaatagtaa

SEQ ID NO: 614680 - DNA, 220 bp, Homo sapiens
aggataaccctcccaagactaaactacgaagaagtagaatcccatttcagctattctacatatggctagccagtttttccagtaccatattaaataggaaatcctttctccatttctggtttggtcaggttgttgaaaatcagatgcttgtagatgtgtggcgttatttctcaggcctctgttctgttccattggtctgtatatctgtttgggtaccagt

SEQ ID NO: 614681 - DNA, 838 bp, Homo sapiens
  misc_feature (40)..(40): n is a, c, g, or t
  misc_feature (146)..(146): n is a, c, g, or t
  misc_feature (177)..(177): n is a, c, g, or t
  misc_feature (205)..(205): n is a, c, g, or t
  misc_feature (213)..(213): n is a, c, g, or t
  misc_feature (219)..(222): n is a, c, g, or t
  misc_feature (228)..(229): n is a, c, g, or t
  misc_feature (262)..(262): n is a, c, g, or t
  misc_feature (264)..(264): n is a, c, g, or t
  misc_feature (291)..(291): n is a, c, g, or t
  misc_feature (449)..(450): n is a, c, g, or t
  misc_feature (452)..(452): n is a, c, g, or t
  misc_feature (456)..(458): n is a, c, g, or t
  misc_feature (464)..(464): n is a, c, g, or t
  misc_feature (467)..(467): n is a, c, g, or t
  misc_feature (499)..(499): n is a, c, g, or t
  misc_feature (509)..(509): n is a, c, g, or t
  misc_feature (512)..(512): n is a, c, g, or t
  misc_feature (523)..(523): n is a, c, g, or t
  misc_feature (528)..(528): n is a, c, g, or t
  misc_feature (530)..(530): n is a, c, g, or t
  misc_feature (572)..(572): n is a, c, g, or t
  misc_feature (575)..(575): n is a, c, g, or t
  misc_feature (577)..(577): n is a, c, g, or t
  misc_feature (580)..(580): n is a, c, g, or t
  misc_feature (718)..(718): n is a, c, g, or t
  misc_feature (831)..(831): n is a, c, g, or t
cttctcttgtatctgtattctaatggctcccagcagtgcnttcacacagcccctttattccccttcttgtgcctgcccatgagcctgagtgtgacagatcaattagctttgtccctccaaactgtgggagcaggactagactcttntggcaggcagagagctcctcctcggccagtnttcgagcttggtccaccactcccagttnttcttgtnttggcnnnntggccnnggcatccagcgtgtctgggcatgatgaggtgtncncagctcaagcttaaggtctctcaggcntgcaccagccacagggcattcatgaagacaaagtaaaaccagaagtcgagagggtggcccagctctccgtgctgggactccgtcgcggtgctctgtcaggaagtagagcacatccccatagatctggcccagagagaccacaagctgtagaatgaagnncngggnnngtggtngcncaaagcgcatcaccacccacaggctgagtggnccccacacgnaanctggtgatggnttgcntngcacatgtagaattggtcacccaggatgtatgcggctgtgtnccntnggnatactcttttccagagttagagataagaaggcttggtctccaagcaggtcttcgtagtagagaacgaaccagccctcgatcaccaggtgaatgaacccacacactgcaaaccagcacagggacagttgccgccaagtncccaatgggacaaccgcagcacgacctgacaacagccatgtggtcacgactaagacccctgtgacagagaagaggccagccagtatatgccagggggggcggtcattaggtanaagttgt

SEQ ID NO: 614682 - DNA, 977 bp, Homo sapiens
gatccaaggcggcccggatgacgtgctgggcttcctgcgcgtggtgcgcttcgtgcgcatcctgcgtatcttcaagctcacacgccacttcgtggggctacgcgtgctgggccacaccctgagggccagtcaccaatgagttcctgctgcttatcatcttacctggccctgggtgtgctcatctttgccaccatgatctattacggctgagtcgcattggtggccaggccctccgaccctcggggtaatgaccacaccgacttcaagaacatccccattggcttctggtgggctgtggtcaccatgacagagcactgggctacggagacatgtaccccaaggacgtggtcaggcatgcatgggtaggggcactgtgtgcacctggcatggcgtgctcaccatcgccatgccggtgcctgtcatcgtcagacaagttctggcatgtactactccgctggaccatggccaagcagaagctgcgccgaagaaaacggaagaagcacgtgccatgggcggacgcagctggagtcagccatgtactgcaatgtctgaggagagttccgcccgggacagaagctgcaggtgaatacaggccccctggccgggaagagggtcatgatcgcgcaggaaacgggcagactctaagcggaatggcgatgccaacgcagagctcgtctgatgaggcagggagctggcctcagccaagcccgtgggggcacctacccgaacacacgaaggaagcgacgggacactgcgaacgtgcacacgacttcgagcaagggagctccaggaacgcgggtgtacctttgcttccctggtcagacagtggtgcgactatggactgtcggccgagtagtagtgtcacggtaacggggacatttcgacctccctggacctatcccgcttcagcgtttccactgaaggcatgatgccctcgaagaggctggaatctcgtctatgcccacaatggtcgaggg

SEQ ID NO: 614683 - DNA, 117 bp, Homo sapiens
tgttgtggaacgctgccgcctggactcggagctgagaaacatgcaggacctggtggaggacctcaagaacaaatatgaggatgaagtaaatcagctcgatggcagcgttccacaact

SEQ ID NO: 614684 - DNA, 179 bp, Homo sapiens
cgctggacaggggccctggcagaacgcccagtaacctgggctaccagcgtagccaagtttgcctggagagagtgcagactccggacctagtaggtttgccctgtaggacatttacgtgagtccagtgaggtccacagtcaacgcgggccgtgcgtgttgcgccttcgaggagggatcca

SEQ ID NO: 614685 - DNA, 422 bp, Homo sapiens
gagagagagagagagagagagagagagagagagagagagagagagagagagagacagagagacattcgggctttccttgggacctgttccgggactatctgtggggattgagtctgttcaacatgacaacttacttctttcacagactctttagtgtatcagatcttcgctgacatccctgtgcagtgcctgcatattatagaggaaatcctgtcttctaaattacttgtgagcatttgattcaactcctatgttagtctcgcccttacaatgcatctcattaatggcacctttctctattattgctgaactgacttgaggatctgtgtcccccattgacccagagctctgaatatcctttggagagtgcactatctcttgatgattgaagacatctgtcacgttctcctcttgatgcatgt

SEQ ID NO: 614686 - DNA, 1630 bp, Homo sapiens
  misc_feature (601)..(601): n is a, c, g, or t
  misc_feature (636)..(636): n is a, c, g, or t
  misc_feature (672)..(672): n is a, c, g, or t
  misc_feature (734)..(734): n is a, c, g, or t
tacggtctgcctgttgtttttgccccgttgttgttagggtcccttctgtcttttgttgggttccccgtgtgagcggtcgcggggtcctgagtaacgctgtacacctccggggtttttggccctttccgccgctctatttcccctccgtttttgagcgcacctaaaggtttaatagacccaacccgaagcggggtcgacgcagccccggccggccactcttgttttagagcacgccccttgccagccctgtgagttaccagagatccgggcgcataccgagttcttgaggtgcacacctgggagccggaagcgtgttttttctttataagaccctgggtctccccctgccaagactcctccccgggttttaagccttgttgttgagtttccgaaccacgtcccatgagcctttttgacccgctggtgtagctacagagacaccgccttcccttcccgagacctgcttttggcggggaggaggaaatcccctcagacccttggacgcttttctcattgtcttatttattgtatttctggggtatgcgcgttattccgagcaccctcccctccgatggccgcttttacaaagattttttttttntctctcaacaccatgattcctttaacaacatgttnccagcattcccaggtaggcccaggtgtcctaccagnaaaaccttgggtttagacctacagggggtctggctggtgttaaccagaagggagggcaaganctggtgcggctggcccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaaaaaaaaaaaaaaaaaaaaaaaaaacaacaaacaaaaaaaacaaaacaacaaacaaaacaacaaaaaaccaacaaaaaaacaaagaagagcggggggcgcgcgccccactaaaaaaacaccccccccacggggaggcgcacccaactcactgccgccaccacagccgcatttttgtgcaaacaacgggctccccccactatgagggcgcccatacataaacacacccaaccgccgggcgcgcctctacacaacaacccgcatcggtgagccgagaccaaaccccctcggtcgcccctccttgagcaggaccccccctctctggcgggaggaacaatctcggccgaccaccacaccacccaaacaacataagcgtcgccgcggcgcgaaacacaaacacccggggggtcagcacccgtccccaccccccacccattccgtccgctgcgacaagaacagcgccccgccaattcatctcgcccactcctcagccggcgccgcatcaaaacaccgagcaccaagcacagaccgacgcagcaccacgaacgctgagtcagcaacaaccgacgcgtcagaaccagcaagtcaagcgaccagtcacacacagccacaccacacagccgaccacacacaccgccaccgcgccaccgaaacacacacaaacctaaccatcccgagcccagcccaacaccgcac

SEQ ID NO: 614687 - DNA, 686 bp, Homo sapiens
  misc_feature (38)..(38): n is a, c, g, or t
  misc_feature (63)..(63): n is a, c, g, or t
  misc_feature (140)..(140): n is a, c, g, or t
  misc_feature (157)..(157): n is a, c, g, or t
  misc_feature (233)..(233): n is a, c, g, or t
  misc_feature (244)..(244): n is a, c, g, or t
  misc_feature (267)..(267): n is a, c, g, or t
  misc_feature (275)..(276): n is a, c, g, or t
  misc_feature (309)..(309): n is a, c, g, or t
  misc_feature (442)..(442): n is a, c, g, or t
  misc_feature (446)..(446): n is a, c, g, or t
  misc_feature (453)..(453): n is a, c, g, or t
  misc_feature (490)..(490): n is a, c, g, or t
  misc_feature (495)..(495): n is a, c, g, or t
  misc_feature (516)..(516): n is a, c, g, or t
  misc_feature (519)..(519): n is a, c, g, or t
  misc_feature (609)..(609): n is a, c, g, or t
  misc_feature (613)..(613): n is a, c, g, or t
  misc_feature (623)..(623): n is a, c, g, or t
  misc_feature (662)..(662): n is a, c, g, or t
ctgtcctgggccctccttctcccggccccgggccgggncttccttctttgttggttgtgtgcnctgcccccccttctctttctggttctctccccgggtttgtgctttgttgcctgggggtgctgcttcccggggcctgntctggcggggccccccnccgggttcgggcttccctggggtggggccggggcttggccttttgggtcctggcctggggggcgggtggggcgggnttctgtttggnggtttcttccttctggtcttggntgctgggnngggggctggttcgcgggcctcctggggcttccnggggggggggggggggggggctgtggttctggggttggggggtggttggggttgggggggtgggcctgggccttggttccttttctggttccgggggctgtggcctttgctcccttgtgtggttttgggtgtngggngtggctntttttttttgtgccctttccttttggtccttctggtngtggntttcctgtggcccctggctcnggntggcctgttagcctaggtattgggttcctagctgaagccaggccagagttgccaagtggggtttgggtttttgtccaaacagctcaggcnagcntctggtgggngatgggaaggtgggaaatgggcagatgctctttgggcgngaccccctccccttcaggccccgc

SEQ ID NO: 614688 - DNA, 1200 bp, Homo sapiens
tttatttattttatcctctggtttaattacataatttttttgtttaactattaagtttcagtgatacatgtgccggaatgtgcaggttggttacataggtatatatatgccatgatggaaatattatattattataaagcagtaatttggccaaataatcaaaaacagaaggcacaattggagaattcagagggcaggtagtttcaacagagcaggtatatcacgcagtcacgaagatttggaatcgctgggcagcaggtctcaaggtggcaatcaagcaatttcagggagcaaagtgtgtgttcactatatgtggaagggctaaattgagtggtgggtgccgtgaggttcgtggttacgtataccttcgtgtaaccacagttctcgtggatcctgtcagagagtggcagaactcttgttagacgcttctcggtaagaacgctccatattacgcgtagtattacataaaggctagcgtggatttcgccttgtgggagcattttatcacgtgttcaagcacgtaattagttttaccattgtatagtagttacgttggacaactcgtaaggcatttatttaacctagattagtggggacatggataaggttacaattgaagtggggtgtgacgtgggggattctaaattgttgtgggaattgcggagttccaaggggcgacacggatgcacaacaggtcggacttttccttaaggacaaaggccctggtttgcccgcttacaacgtgggacttgtcaacacttacacttccgatttcttgtgggtaacgattagggactctcaacttaacatcttgtgtggcaacgtgtaaactccgccgggcaaccccataaaatgctcggcgggcggggaagaaaacaccagatgccgaaaacctaacaggaaagacaccactaagataaaactaacaactggcgcgcgaccgccggtggcaccaaccagcactaattccaccttagaacactatgtgcccccacaactcttggggacgcccaataagagagaacggcacatttccaacggcgcacgtcgcaccaaaaaagcccgcgcacgagagaaaacagataaaaaacactacctataacctaccgatgtaaaaacggaagagatagtaccacccgaacacgaacagcggtgctgacatacacgacgcgcacaggagcggcactagctgtcagaagc

SEQ ID NO: 614689 - DNA, 331 bp, Homo sapiens
ctgactttcccttgcttttttagtggaaaccagccagtttgacggcccggtggggaaacaggactccatcagggtagtgttggggaaccagcccggcagccttccatgtgaattccaaagctgtttcaaccctgggtgataggcagacaaaaggttacttgtgtgtttttcttaaaagcggggtaaatgaagtccccttagaaaatattttgtgcggatggttatattttgttaacttcccgacttatggcatgtttttttttaaaaaaaaaaaaggactaggggccaataacattatgaagtggtatttaattaaaaatccatgcagtga

SEQ ID NO: 614690 - DNA, 270 bp, Homo sapiens
  misc_feature (136)..(136): n is a, c, g, or t
tgcccgggggggtccccccccgggggggggggggcccccccccaaaagttttccccgggggggggggtttggggggggggggccccccccccccccctggtttcccggggccccccccccccctttgggggtgtgncccttttttccaggggggggcccccccatggggggggccgggggttttttttcccccccccccccccccccccccggggttttttttttttttgggggggggggggggtttttttttggggtttttttccccca

SEQ ID NO: 614691 - DNA, 890 bp, Homo sapiens
ccccgtctgtaggacgccgccaatttttgtgcggaccatacagtttcgagtccgtcggctatttgccgattgtcccatcgcgcgggggggaccacttcggtaccgcgcctcctgcggtccgccgaggcaccacatggcgaagaggtttactgggtaactcaggcagcgcgctctcggttcgaatctttccagggagcccgagaacagtgtactcttgggtgcgcgccgcaacccccgttccctccgggggtcccgccccgggtacccgcatctcttgggggagaccctcgccttgcagcggccaccggctggtgtggcccggcggtccaaccgaccgcccttcctggtgtacgaccctctgccggccgtggggttttaacaaaacaacttgggatgacttcctggaacatggtattgggtgcaccgcagaattgcttctgcagtcatgtgcccagggtgccccgcgcatattgctccccctccccgccagtgtgccctcttgaaatctttctgggccccgtctgttgggggaattcttccatggccccttgtgcttcagccgcacgctacccccaatgggggtggtccccggcgcccgcagttgttcctggcgcagtcctttggggcacggggctatgatccacccgagcgggcttcgcccggtctcgtatggctgcccgatggtttgccccctgcacccaccggggcaacagaggttttcccgcctagcgccgctagcgtccccctggtcgcccgcctgcctagctttggcatcttgcgtccgctccgaggacgggtgtccgctgctcgacccggttaccccccccgcctttttcccggggggtccccaacagggaaaagattttcgggtgtcgcccccaaacataaca

SEQ ID NO: 614692 - DNA, 333 bp, Homo sapiens
tcgtcgataaggttggggagaggaatttgagaaactttatagcagttatgagaaacaaggtcgtgtccgcaagttgtaaaagctcagcagctatggtataccatcattgagtctcagacggaaacaggcaccccgtatatactctacaaagattcctgtaatcgaaagagcaatcagcagaaactgggaaccatcaaatagcagcaacctgtagcacagaaatagtggagtacaccagcaaagataaggttgcagtatgtaatttaggcttccctaggccctgaatatagtatagtcactatacagatatcggaatatactggggatacctct

SEQ ID NO: 614693 - DNA, 305 bp, Homo sapiens
  misc_feature (8)..(8): n is a, c, g, or t
  misc_feature (21)..(21): n is a, c, g, or t
  misc_feature (62)..(62): n is a, c, g, or t
  misc_feature (263)..(263): n is a, c, g, or t
cgtaagtnaaaaaaaatctgncagggtcttccactatcctttttcaggttgataatgctgtnctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctantacaatgtaaatgctctgtaaatagttgttatactatattgt

SEQ ID NO: 614694 - DNA, 134 bp, Homo sapiens
tcggagcgactggagtgcagtgcagtctccacctccacagctcaggcattcctcagcctcctgagtggctgggaccacaggtgtgcaccagcataccggctaatttgtttttaaactatttgtaatcgatgggg

SEQ ID NO: 614695 - DNA, 220 bp, Homo sapiens
gtggtgttctagaggtactcagccatgtcacatgagatggtagccatgtcacgcagccggcagtgtcaagcagatcgcaagccgaagcctgtgttacagaagtacgctgaagctgctgggtgttgcaggttgtggtcaacctgcctgagtatgagagaggtaatttccacgtttgataacgatctgttaggaagtctttggacagatctaaagatgagaa

SEQ ID NO: 614696 - DNA, 415 bp, Homo sapiens
  misc_feature (9)..(9): n is a, c, g, or t
  misc_feature (19)..(19): n is a, c, g, or t
  misc_feature (52)..(52): n is a, c, g, or t
  misc_feature (72)..(72): n is a, c, g, or t
  misc_feature (171)..(171): n is a, c, g, or t
  misc_feature (408)..(409): n is a, c, g, or t
tcatgcctnccctccccanaaactttctggaaaaaaatgctggcctttgganatggataatagggttttccnccttaaagacccacctgttcctccctagcaaaaaaggccctacccttggccgggcacggtgcctcacgcttgtaacccccagccctttgggaggctganacggtggatggcttaagccccaggagttcgaaactagcgtgggcaacttggcgaaaccccatctctgcaaaaaatacaaaaattagctgggtgtcatggtgtgcgcctgtggtcccagtacttaggaggttgaggctggaggatcacttgagccctggagttgggaggttgtagtgagccaagattgtgccactgcacttcagcctggctgacagagacccctgtctcaacacaatnntttagg

SEQ ID NO: 614697 - DNA, 1156 bp, Homo sapiens
  misc_feature (350)..(350): n is a, c, g, or t
ggctacgctacggtgcctcgtagaggcccgtcgatgacgacttatattgacctctttcgaagcgtgccgtcgacgacggtgtccttgtatgcgtatctccggatcgcctgaacggaacggagaacggatctcgtccaacgtatgtctctcctcggacgaaccatcgggctggaaggattagcaatccatgctcgcagacggagtcacgatccgctgtagggcccgaggtgagtaatcatgtgactagtgtgctcgatcggaagttgtacttagctactcgtgcgaagaacagcaatatagctggagtactgtagtagcgcagtagtcgatagttggtgacacatcactgnacgtttctggctgcaagcggtctttgggctctgtacctggcttgcgtatgtaaggagcacgaagaggcagacctcgactgaatatttgggggagatgaactatttatatcaggggaacgagatttccaacactgaagtcaacaaacctgagcagtggacccacgcatgtgcgcaacactgcgagggtgacctagcaggggattcaaacttgcctagagttgggatagtaaggcccgaaaaacctcactgctagtttggggactttatgcaatgagttgacaacgagttcttgtgcgtcaccccatagctatgcaatggggatttccctatatattagtcttgaggacagaaatgcccttgcgtaaccgcgaacaaatagttgcgtggtcactaagacttcaatgtgaaaatccttgaatgggaaagaccgatccggggaatggttcatatagtaaaaattctatgcagcccctcacgggtgcgtgctcgttataggcatgacccaccctggagagaatgtcggtctaactccgtttacaccgcgtttaaaccgaacgttggctgacgcatacttgataacgttgacccattctccgtgaatattctccccttttaacaagttgtcctaccgaacagggaagcgttgcgcaatttcaccctcggcgaattggaactgcaaggtcttcggctaggagaaacaggtttggcttttcacccctagagtaaagttcgttcggccaccgggcctacttcggtgccccaaagagcgtgtgcacacagaattttttttgggaggattccctata

SEQ ID NO: 614698 - DNA, 421 bp, Homo sapiens
tgcgtcagcaatcagttggcacagacatgaccgttgacggtcaacggggtataagatttagacattgtttacgcagtaaggccttgtaagttgtcgagaaagagtatgcctggtacggtagtatacctgcatataaagtcagcaagacagtatacccccaatgtgtataaggggcagcacagccctaaagtgactcgactcgctgatcatactttgctatcaataggcctattatacgtgcaatttcccagaacattgtgtgagtctttgactactatgttcctgcggttaagtaccgcaacgtccaattacatatcccatgaagttaagggagtagccccaacgtttggttcgagtggtatacaaatgtatatacaaagatatgagctaattggtaagagaggtaataaatggactcaag

SEQ ID NO: 614699 - DNA, 141 bp, Homo sapiens
actcctcctagagattcctttgcaggtgcaacccttgttttctgatggtggagctgctcaaaagttgagcgacgaactgagctgtaaccagactggggaggggcaggcggagaggcccccatcagtgcaccagactgttcc

SEQ ID NO: 614700 - DNA, 446 bp, Homo sapiens
  misc_feature (144)..(144): n is a, c, g, or t
atatttgcatcataaggacatgattttgttggggcaggagcagaatgctatggtgtgaatgtgtactccaaagttcatgtgttgaaacaatccccagtgaaacagtgttgggaggtagacctaataagaggtgattaggtcacncgagctctgccctcacaaatgaatttatatcattatcatgggagtgggtcattaaaaaagcaagttcgggccagatgcagtggcttacacctgtaatcccagcactttgggagcctgaagcaggtggatcacctgaggttgagggttcgagaccagcctgaccaacatggagaaaccacgtctctactaaaaatacgaaattagccgcgcatgctggcacatgcctgtaatcccagctactcaggagactgaggcaggagaatcgcttgaacacgggaggcggaggttgtggggagctgaga

SEQ ID NO: 614701 - DNA, 110 bp, Homo sapiens
agtgaaacattcctttgtaagtgaatcttcaatgaagacgtcccgagtgtgcgtggttgctgatggggccgttttgggaggaaagcgagcaaactgcgctcatccccctc

SEQ ID NO: 614702 - DNA, 194 bp, Homo sapiens
tgacaaccagctcgtacccccttctacgtctcatcactggacagagttcccagtgctacacagcaggatgtcattgttaatccattccaaaagcaatacattgcatcaattaaccccacgctaccaatccattcccctctctccccctcctgctccctcttggtaaccacaagtcagtgatgagacgtagaagg

SEQ ID NO: 614703 - DNA, 229 bp, Homo sapiens
  misc_feature (229)..(229): n is a, c, g, or t
gctccacgagggttcagctgtctcttacttttaaccagtgacttgatctgcccgtgaagaggcggggcatgtacacaagcaagacgaggaagagccctattggaggctttaatttattaatggcaaacaggtacctaagaaacccaccagggtcctaaactatccaaaccctgcacttaaaaaatttcgggtttggggcgaccctctgaggcagaacccaaccctccgn

SEQ ID NO: 614704 - DNA, 746 bp, Homo sapiens
aataaattcaccggcacgcttgttgtgaacgcgggtggtgcccgaaacttggaggcttcccgtaaacccagctccttcctcatctgggaggtgggtcccgacgcgggtccgccgccccctccctgtgccccatccctctcgtgtctttcattttcctggggctccaggggcagcggagaagcgtgcatcccgagaggagcgcgtccagagagcaggacccgggagtgtaatcaaagagccagtgaacaaggaccaggggcccaagtcgccaccagccatgcagacctgccccctggcattccctggccacagtatcccaaagaccttgggaccctcctgtattaggctgcctccattgagttgctcagaatgacaggctgggacatgccccaatcttgcacacgagtgggggtagtactctgatgctcttggggcgacgaatcacacgtccatgtcctagacaagcaatctccaacagccttctcccacggtcaaacattcaagactagcgcttgcaccaccggggcaataggaagagccgcacaatcctgtcacaatggaagagctgggactccacagggactaacctaacgacccccgggagaccgagactgggcaaggactcccagggttaccgcggaagggcggtgggcaacccggcctgggtgactccaaaagggcccgccccgggaagctccccatgcctggcaccgaacaatgtaggcacctcgatgggacaccaaaaa

SEQ ID NO: 614705 - DNA, 101 bp, Homo sapiens
gcttgcggcagactgtgttgctgctccatgctctgcgcaataagatgggtctgaaatttcagagataccgacttgttccttacggaaaccattcatatctt

SEQ ID NO: 614706 - DNA, 1001 bp, Homo sapiens
  misc_feature (405)..(405): n is a, c, g, or t
  misc_feature (644)..(644): n is a, c, g, or t
agatcatcgttgctgcgacggggacatgaacctatgatacaccattcgtcactaatatgactgacaggatctaggcgccctatagccttgtgcataatgagatttagatcaaactatttgcgcaaggaaaagtccaagctcagcatcccctcaccaccaacgaactagctaacaacatctcgaaagtagtcagcatactcggtacgtgagtgataagacagatactaagatcgtgagcaaaagattcttggtgaagatcaggagtgcggacaagaacgctgagccgcagaggcatggaatgaaatcatgacctgggctctgatctcaccggatgaggagactcattgagggtctactaaactctccttagatattagcgcacccactacacagcgcctgcataanaattcctctctctgataaaatattacacgtaggtctaggtctcaaaagaagggaataccaagggctacgtatatgggcaccaacgtgacgtggagagggatagagcacgtctgctcatcatgtggcatgtagagaaaacaatatattggtgaaccactgtgaaggtgacgaccgtagagaaaggcgtgccagccaggtatgacaggagacacggcagttatcaatggcgtctcgcagcncacacttagcactatcacgaattcccccgaacattattaatgtcgtaaactccctacgaacaatcgcaccatagtttggggtatcgcaagagtgctttattcaacctcctcactaaggacaccagagtgacattgttttagcttacctaagttcaaccgataggagccagcgatgaattcccgtgcacagccaggtgcaaaagccatagcccgtcccacgaatgttaactaggaacctgaaactagtactcggttgtaacaaccaaggaaccaaaataaatcctaacaaaggtcgcttccccatcggggaggcctagaaggggaaccccttttccttttggccttcccccgaacctg

SEQ ID NO: 614707 - DNA, 808 bp, Homo sapiens
gagaatctgggagccagttccgtgctgacagagttcacaggcatatattggtggattcttgtacgcgagtagttgcatctgcttaatcgaattaaccgaaagcagtgtcaacgagatgtagaggagttcaaacgcatttagccaaaatatcgagtctagagtcgcattctactcgtcttcctggacattgatctggtggtaccacgtgggcgcagtagcgtactgatgtatgatatgtgcgctcgctaatcagagtttactggggcaagattcagtcacgcaaaagtggtgcagccatgaattgtgatagctggcacctgaagaggctagcgcgaaggtgctcatgtactaggggatggagcttgaaagttggtagcaagtggtaccgaatgtgttgccttccttgggaatcaaagttgatcttttagctttgaggcacattgaaagctgagattgggcaacattagtgggcatgcaatagagggccttttgcagaaatggtgaactagtagtcatggcatagctggcttcaatgtcctatggatgcgacgaaatctttcgtgaggaatagattgcgcatagcatttaacctaggggcagaagttattggcttcttaaattggtaggagcaaactggaagagagctgtcgtattgaaaccacaaagaaagcttgagcagaaggtgtggtggggggcctcatatatacgcaaagagtctcttgggaggggaatcatggaaagggttaacgttccaataatcacaggaataccaaaaagcgtgggggttctttttagacagggggttggg

SEQ ID NO: 614708 - DNA, 224 bp, Homo sapiens
  misc_feature (80)..(80): n is a, c, g, or t
  misc_feature (122)..(122): n is a, c, g, or t
  misc_feature (213)..(213): n is a, c, g, or t
gactctacaggatcttccccgactagccagacaggccaccattcaatcaggaaatacgggtacaccacaaagatactcgntgagaaagagcaaccccaagacacataatcttcagattcacncaaggtttgaaatgaagtgaaggaaatgttaacgggcagccagaagagacagtgtgaggttaccccacaaagggaacccttatcagactanacagcagatct

SEQ ID NO: 614709 - DNA, 233 bp, Homo sapiens
  misc_feature (54)..(54): n is a, c, g, or t
  misc_feature (82)..(83): n is a, c, g, or t
tggtgccgctctacgagacctgcggcaagaagtacgtgtcgccgacactggcgntggagctggccaacgccatcaccgacgnnagcgagcgcccgccgcacgaaaagctgtctgaccgcgagtaccagacgctggtgatgatcgcgtcgggcaagacgctgacgcagatcggcgaagaactgaatctgagcgtcaagacggtcagcgtctatcgcgcccggttgctggagaag

SEQ ID NO: 614710 - DNA, 329 bp, Homo sapiens
  misc_feature (253)..(253): n is a, c, g, or t
  misc_feature (306)..(306): n is a, c, g, or t
aaatccaaaaagtacacaagtagttcttgccaggtggactcaaagcacgtagaagacatactaggtaatcacaagtctccatctccagtaaataaagaaaggtgtatcagtcaactgaagtccatgacattctggatgtccaagaagagaagtgcccttaatgataagggtggtcaacaaaaacacagtgaggaggtaccagaccctgtcattcgacttttttaaagccgacaataaggtttttaaataaaantcaagcctggagggtttcaaacggaaagccagcttgaggattacagggaaacntgttttccaggccaaacccttaa

SEQ ID NO: 614711 - DNA, 426 bp, Homo sapiens
  misc_feature (38)..(38): n is a, c, g, or t
  misc_feature (82)..(82): n is a, c, g, or t
  misc_feature (91)..(91): n is a, c, g, or t
  misc_feature (101)..(101): n is a, c, g, or t
  misc_feature (115)..(115): n is a, c, g, or t
  misc_feature (117)..(117): n is a, c, g, or t
  misc_feature (125)..(125): n is a, c, g, or t
  misc_feature (132)..(132): n is a, c, g, or t
  misc_feature (143)..(143): n is a, c, g, or t
  misc_feature (145)..(145): n is a, c, g, or t
  misc_feature (162)..(162): n is a, c, g, or t
  misc_feature (167)..(167): n is a, c, g, or t
  misc_feature (219)..(219): n is a, c, g, or t
  misc_feature (231)..(231): n is a, c, g, or t
  misc_feature (261)..(261): n is a, c, g, or t
  misc_feature (270)..(270): n is a, c, g, or t
  misc_feature (272)..(273): n is a, c, g, or t
  misc_feature (276)..(280): n is a, c, g, or t
  misc_feature (297)..(297): n is a, c, g, or t
  misc_feature (336)..(336): n is a, c, g, or t
  misc_feature (346)..(347): n is a, c, g, or t
  misc_feature (358)..(358): n is a, c, g, or t
  misc_feature (361)..(361): n is a, c, g, or t
  misc_feature (374)..(374): n is a, c, g, or t
gctttgactgcttggttccctgcgtgaggggccggatnttaaacaccgaaaactcccgggtcagggcttccgcagctgaggnccggcaggnaaaaaaaaanaatgaataaatatnanaaacccantgaatcntgaaccccttntnttggaactcaaaaaacnttgcnaaacaaaaacacataaaaaatacaaacaaaaaaaaaaaaaaaaaaatctctnccacgtgggcanggtccttctctcccggccgctcctccctgncggcggccncnnccnnnnngatcttctctatctgantctccttcttcgtcaggttgtctgtgctctcctgccgcngctcactgtnntcgtcctccgngcngctgctggggccntcctcttccacctcctcttcgtcctcttcctcctctgccaccagcctcttct

SEQ ID NO: 614712 - DNA, 408 bp, Homo sapiens
tcggtactctcctactgtatctatatgaaataaataagttgaataactctataacccacctaaagaataacacttaaaaaaaaaaaaaaaaaaaagaggaaaagctctggagaccaaaagtgaaaaaaccactagggattattcctagctacaaggggcccatttctggctcgggatttaatagggagccatggttcgggaattacaaacacctaaataggcactgggcgtgagtgtggttttggggtcggcacagcccagaaagcggattttggggggaccggacaaacagagaccacaatttatgtggtttcctcattgtgtaggggtttttttcatatttatatttctttttttctctaggatacaggaaggggagagggggactcctctaagagtcagaccggc

SEQ ID NO: 614713 - DNA, 277 bp, Homo sapiens
gtcgacttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatcttctttggtttttgctttaatttatttattgtttttacacagctgggaaatgcttaaggtacaaattaataaattttaaactcagtatagaaaatacatt

SEQ ID NO: 614714 - DNA, 204 bp, Homo sapiens
tccacctacaaatgtcactggcatttggggggccgaggcagtgaatcacctgagatgaggagtataagccaaacaggccaacatggcaaaatctcatctctacttaaaatttaaaaaaaaaaattagccagtcatggtattgggcgcctgtagtcccagctactcagaaggctgaggcacgagaatcacttgaacctgggaggt

SEQ ID NO: 614715 - DNA, 173 bp, Homo sapiens
ccagatgtccttgccatggccccaaacaattttccgttttctggaaacgctgggggtgcccttcaaaaagctggcagcccccgcagtcagggcctgctttgcagaatagaatgtgaaccccactcctgatggcccacttggctttttttattaaagatggaatcctgccatga

SEQ ID NO: 614716 - DNA, 185 bp, Homo sapiens
cccaggcacagcttgtgggcccaggagccagctcaggtgctcccctccaccatgggcaggcgtgtgcaaaaagccaccggcgtttgtctcagcattgtgctgcgtgggcctctccgtgggactaccagtgtggctcttacgtgttgtctttgctacagtaaaccctagtatcttgaacaacagaa

SEQ ID NO: 614717 - DNA, 135 bp, Homo sapiens
  misc_feature (130)..(130): n is a, c, g, or t
gtggaggggagaagagggaacagtccaatattggtcctgctggtacctcttagtgtgtgggatgtcatcatcgtaaggggttaccacaagtggatgccactctcttaacttcctgccacaaccgtctacngggta

SEQ ID NO: 614718 - DNA, 243 bp, Homo sapiens
accagtctccaagagggagatccacactgtagacacgacagacatgaacagtatgattatggagtgatgatgtggcagtccctggagacgatcatggaattggtgctggaataattggttgctatatgtattactatatatgtatatgccatcacgttcaagtccaggcctatggcgtaagtggaggagtgatcaacatgtatctggaattagatgtgatgttagcacaactcggcgagattc

SEQ ID NO: 614719 - DNA, 725 bp, Homo sapiens
ggaacagagtagaggcggcggcggggggccggaccagactgtagtgaggcttggaccccgagccgctgaatgccgctggagctggagctgtgtcccgtggcgctgggtgggcgggcaacaactcgtgcttcatcattgccgagatcggcagaaccaccaggcgacctgacgtagccaagcgcatgatccgatggcccaaggaggtgtgggcgctgattgtggccaggttccagaagagtgagctagaattcacgtttaatcggaaagccttggagaggccatacacctcgaagcattcccgggggaagacgtacggggagcacaaaacgacaatcctgagttcagccatgaccagtacagggagctgcagaggtacgccgaggagggtgggatcttcttcacgtgcctctgcatggcatgagatggcacgttgaattccctgcatgaactgaatgtcccatttttcaaaagttgggttctggagcaccctaataattttccttatctgaaaaagaccgtccaaaaaaatggtcgccccaatggtgatctccccagtggcaatggcagtcacggggaccccatgaagccagtttatccagatcgtgaagccccttcaacccaattttctgttcttgccagtgtcccagcgaatacccgttccagcctgaggacgtcaccctgcggcactcggatatagagctcttctgattccaaaggattcggca

SEQ ID NO: 614720 - DNA, 885 bp, Homo sapiens
atggcccccctcaagtgagcgcttttggcacaacacgaggtgtgccgcgatctgcgttccaacactgttggaggacgtcccgcccactttggggggtggccactctttgtccaccgggagttgtcggcccacttcattgggcacaaccccttgggggcaccaagagctgcgtcacacgtcttgcaaatgtgtgcgcccccacagcgccgtctcctatagtggtggtccgcgcaccccgcgcgcccgccctcttctggcgcgctgtttatcgtctaggaggcgttgccccttgaacccccagggtgtaaccaccgggggcaccacactttgtcgctgcgcttccaaagaggtggggacccacctaaacagcacacagtgggtttcttgccccccagttaataaagcaccccgtgggggaattgatggagatgtaaaacgcgccccagaaggtgttgttagggtttattaaaccccaccccaggtgttagacttccgggccccaccctcccttccatgggagccccccgtggtgttaccacccacaccgccgcgcaccagattagtgtagtgtacctccacaaatttgtagtaggcaactatatacaaattaccaacgataatacctctagtgataaaataccgttaaattttaggtggaaaaccactataagaagaattttaaatgataaccccacttattctgttttgtttttttaactaatagtccccgaagaactacagaaacatcccccattagtaaatgggtacctataaataataagggaagtgtgagcttaaaatgaatttttcccttgtccaatattcctttctgctaattcatcttaacttgccaacaaacacccaaaattatttttccacaaaaca

SEQ ID NO: 614721 - DNA, 1053 bp, Homo sapiens
  misc_feature (113)..(113): n is a, c, g, or t
  misc_feature (173)..(173): n is a, c, g, or t
  misc_feature (367)..(367): n is a, c, g, or t
ggttcttggcctaaggtgggttcgatgggtgttggtgattgacggtcttcctgccaggtggagctgtccagaagaacatgctttctctcccgtgtatcagtcacatgcccaanatatactcggcgtagagcattggctagtatcttgtcgccgcaccttcgcatacacgtggncgtctgtgctgcagtagtactctcagaagcatgccaaagggtcgggacatggagcgaaggtggtcggacatgttgagtgccggtggacccgatcgcatgctcttctagttcctcggtgaaaggctgccctcatccgagcataggtatggctcgcagaacaacgcctgggcgacgcaaaggactgcactctcaantttactgatccagagggcggggccgtatgaggggcactacgcgaagatgagacttctgaaaggcagcggctatatagagaactatagggaagaatatgctagtggggtacgtagagtatatagcgctacaatgtagactggtcgatgggaaacagtcatgcaaaagcgagttgcaaagtgccccagaatgggtctagaatggggctggtgattccttggaaatttaagtaagacaagaaatggtcccagggagaatgaacgggagggactagactctcttggttcgacttgggtggctaaagttggttatggccgatagtctcgagtggacaaggtgacccaatgtcgactaccacagtatccattcgggcaaggcaaccgtgcaggcccccgagttggctgtaccgaaacaactggattggaccatggtctccctatgcatggggggagtcaaaccagggcttgggcaccacaaaaaagggcaaggcacgcaccttggacaatcgcaagaggaaagccatacacaaggacttgggagttctccaccaggaaaggcaaacctttttgaaacaccccagttggaggaaggcaaacactaaggaatttcccaaaaagtgccccacttcaaggggcagaagaaaccaggccgtcggggctctcgggacatccccattttgggcttagtg

SEQ ID NO: 614722 - DNA, 831 bp, Homo sapiens
  misc_feature (128)..(128): n is a, c, g, or t
  misc_feature (150)..(150): n is a, c, g, or t
  misc_feature (254)..(254): n is a, c, g, or t
  misc_feature (320)..(321): n is a, c, g, or t
aaagacacacgtgacccaccaccccatctctgaccatgagtgccaccctgagtgtgctggtgccctggtgcttctaccctgctggagatcacactgtaccgtggcagctgggaatggcgatggaccanaactcagtgacacttgacgctntgtgtgatgaccagaccgagcatggacgactagaagccctatccagaaggtgggcatgcttgtgtgtgtgtgcccttcctgtgagacagagcatgagactacanccatgcacatgtacgagcatgatgggtgctgccgagagccccgtcaccgctgcagatggtgagccnnatcttcccatgtcgcaccagtcccccatctgtgtggacattgtttgcgtggcgctgtgcttgtccctagacatgtttgttggtccatccggacgcctgttggtccgacgtactggtgattgttgtagtgacggcaagcagctcccaggtgtgaacaatggacgggactgctactcctcagtgcttgcagtccaggcgacaagtgcccagtgactcctgatgtgtctctcacatgcttgggcctgagacagctgtcttgtgagggactgagatgcgggattcttcactcctcccctttggttgactcaggagctctgtggttcttcagtgaagggactgtagtgttgtggtctgttagctaggttagagcttgggaggacaccccggtcattgacccgttctctgacaggttccccgcacattgtcatcgaggggctaacaccgctctcatatggcggggcatcactctacacggaacgttccatgatgtcaccgccgtgcacacaccacg

SEQ ID NO: 614723 - DNA, 788 bp, Homo sapiens
taagatcagactctgaaaaagggaaaagcactaaaaaaaaaaaacaaaaaaaaacatcaaaaaaccaaaaaaaaaaccatactaactaaaaaagagaaacaccaaaacaactacaaaaacaaaaaaaacaacaggcaactaaggggtacactaaaagttaaaagataataaggaattttttggccccctgggcccagaccttttttaacctcgcccacttttttcctgcccccccatttgggctccctttggccattttccccttttggggggcgatttcaaattcccggcccccttttttaacacgggggtattggaaaaacccggcggatcccccatttattaggtttgtaaaaatccccctttttccagtttgggttaaatgcaaaaagcccccccaccttcccctttcccaacatttcccccccctaaatgggaaaaggaaatttttcccctttttttttttggaaaatccggccaaaatttttttaaacacacgctttttttataccccaggccccaaaagcccaaatcccccttttaataaaaaaaaacaccccgattacggttgattgtttctccccttaggaaccaattccctctttttaaaaccgggcaccccaactcaaaaggcgcagaaacctgttttgtgggggaggcgcccttccggaacaccaccccctaataattttcttgggcgccggggcccaaaatacattaatcccccccccaaggccccccccatttaatatttcccgggaaacccccccccctgcccaaatagggga

SEQ ID NO: 614724 - DNA, 245 bp, Homo sapiens
ctggatgcaatgggtgtgcagccctcaggatgactctgcaagcatgcagaccacgaaatgcaggagtttggcgtgaggagcagctttcggtatggattgatgactaagtcaagctacttcctgagcttctctcagatttccaagagccagagatgaattgtgctgcatcttgccccaattcttaggatttcttttcctccgccactgcagtgattgttagaggtacgttttcttgaataaatatt

SEQ ID NO: 614725 - DNA, 571 bp, Homo sapiens
  misc_feature (9)..(9): n is a, c, g, or t
agttacagngaggcacacctgtatcccagctactcaggaggctgaggcaggggttccttgaactggggtcaaggctgcagagtgagctgtggtgggccactgcactccagcctggatgacagtgagaccctctctcaaaaaaaaaaaaatgagagactatttttcctgtcctagagatgaggctgaagttcccaatgcagacgatttttgcctgagctaacagcattaatggatgagcaaggacttgtttagtcctttggctgttgtccacagggtcatggtgctagctcaggcaaaaatggatgagcaaggacttgtttagtcctttggctgttgtccacagggggtgatagcgctcagtgttatgtgacgtcagaaggccatcatgttaaaatatagcacgatagggacaactgatcactctcttgaagtccggagctcttagaacagatggtctgtttttctgtagtaatgctcacaccatgtcttcccactcatagctcccactcactgccccttaccccaccccagcctccagtcgtcaaaatttaaagctgtaaagggaagacgt

SEQ ID NO: 614726 - DNA, 137 bp, Homo sapiens
atgatatatgaagaagagaactccccactgttatcactgtggttcatagattttcactgctgaataacattacacagtgtggttgatatcatacttcacccattactcactggcatgggtctttgcgttggttcggt

SEQ ID NO: 614727 - DNA, 100 bp, Homo sapiens
ggattccgtgtgatctttgctggggaaaaaagtggagacagactccaataagccgaagaaccagaacagtttccacaccccagtaaattggccacaaacc

SEQ ID NO: 614728 - DNA, 834 bp, Homo sapiens
ctgtaaacaagccgcatttctccttggggaagactgatcattgaacaggttagttagtgtcagaaacattcccagcttcatcaccaaccctttccttccacctctgcccactggagaccacttacatcccgaagtcggacgcggcagactgtaagtcatggaaaccatgcatcgacattagcaggagccaatctgcagactttagaactccgttcaacatgtggatgcgcgcacgagaaactgacctgtccagacaagccggggtcagtctcataacactggttcatctgctccctgtgcgctcccgcgggtgcgtaagctactggtagcagaccggcgctccataggtacccgcgagaaaccttctgtctgggcactgcgttgtgccatctacttgggcttcctggtgagccaggtggggagggcctctcttccacgcatggacaaggccggatgagaatgggggccacactcgcaagccgctgacaccagccgagccgatccttcccttgaagatacccctggatgagtacccgtggccccttccatgaagtcccacgaggcgaagtgcggtccacgtcttgcatgcccaattgtggtgtacacttacccttacgcgtcctaaggcgcaatgcaacgccggccaagtatccgtggcaccgtgaagcccaatgctgcaggtaaaaagcaatgcagtgagcatcggctgtccccagcgcatgaggctttggtcggaccatcccttcagccgcaaggaagcggctagggaagctgatgctgtagcacctgggtacgctcagggagcaaacctggttaagattggagagcgaccct

SEQ ID NO: 614729 - DNA, 1222 bp, Homo sapiens
  misc_feature (288)..(288): n is a, c, g, or t
tccccagcataaccacataccagtaagtaggcattcccactaagaggttcccatggctcccctatcactaggtattaggaattttccagctctattaaaatccgatgggcccaccaattgtatatgtggtctgccattggctgaagcatcattatttggtgcatgactgtagacctttaagcaatgatgaaaatgctctatatccacactatcaatatgggtaaccactagccacttgtgactactgagtgtctgaaaggtgactggtacaactggggaactgaattntaaattttctataatttaaattaaaacagccacatttattttatggctattatattgtatcctatatcatatcatatttatatatcatatcatatgttacatggtatatcatattacaaatgcagctttagatcattactttccctagaacacaaattacatgaaaatcttgagtacaatgacatagttactgattttgccaggataaaggaaaaagtaaatgttatttaaaaagcatataatttatgaattattaatatcttcattgattatccatccaaacaccacaggcccatcaacagaattcccagtatatgcgataataattatgttcagtcatcgttgacgttttgccagctttcagtcaattagaaactttgaactttactcgtatttttctatctaatcattatgaagatatatttgtcaaggaaggagaatagaaagcatgttgttcaactctttgtgattagaactgttaaatatagtcatatgatatgcaggttctgcttgaattcttgccctggctcttggtgaaggatcggcctgctggatctgagtcatccacctataagagggacaacaccacacattggtcgctgctctcaagcccctggaataccaccccacttggcttctcctgattctgctatcagctacaggtctgggtttgtgtctccgacaaagaaccacctcaaagccccacagaaaaggactgtaccgtatacttcaaactattgacacctcaaagaacagagcttgggttcaggcttctgatgcattctgagacactctcagaccataccagtgggctgggtcaggatttacagaactattttcatttcaagagcatacgggctcatgagattgctaactcaagatccggtggaacagaaatacttatatcggactgaataaactgatgaggaaaaaa

SEQ ID NO: 614730 - DNA, 164 bp, Homo sapiens
cggtacccggactagccgacaggcgttgcgccgcactgggcggctgtgtgcagcccacagcctagactcagccacaactcgctgcgcgcacgtgtaaaccctagcgctcgagatgcatgtggtccagcgccctgaactccctcaatctgtcgggctagtggggg

SEQ ID NO: 614731 - DNA, 387 bp, Homo sapiens
cagagagacaggtaccggctggacgatggccgccgcgtccgggacctggaccgagtgctcatgggctaccagacctacgcagccctcacccgtcttcgatgacgtgcaaggtcatactcatgggcagtgtcaccctggacactttggggaggtgcagtggcggctagacacggcgtgaatccatgcaggtgtgtccagtgctgagagcagagagaagctcatcccgttggctcgcagtggaggcctgtgtggcgtgactgctgtcgagctcacggctagcccaggcacagccagcctgtcgtgtccagcctgacgcctactggggcagggcagcaggcttttgtgttctctaaaaatgttttatcctccctttggtaccttaatttg

SEQ ID NO: 614732 - DNA, 179 bp, Homo sapiens
ctttctggtggggcacattcatgaagcagcgacggcggtaaaggaagatgggcgatgacatgcacaccatctggctatggcatccatgaggttccagaggagttaagtgggcagaccaacatccacctcagcaaaaacttcttcctgacgaatcgcgcccagaatgggggatcctctag

SEQ ID NO: 614733 - DNA, 102 bp, Homo sapiens
ttacttcagtgctctgcaggctcctataaaccagagacctcacatatctttcttctccattccctatgttatcaacacccgaccagagatagggtaccggta

SEQ ID NO: 614734 - DNA, 349 bp, Homo sapiens
cgtgggtttaccccaaggatggttggttttcttggtccggggggcccaggagtgcccccgcaaagagtaccttcttgggcttccgcgcaggagcccagccagggccccccccctttccttgttaccagcattctggggggggcaaccgaggactggaagaagggggacccctttttctgcatggtgggccccgaggcccttccgctggccttcccccagaagaccctcggccgcttggggggttaacccccccctgtcaatgtgtttgttgtcatggcggaggtgggcggcccctgctttttagccgcccgcctgtccccccccctgaattaactccctgctcccccca

SEQ ID NO: 614735 - DNA, 101 bp, Homo sapiens
ttcgttctgcacggggctcactcagctctgcagcagagattgtgcacgaggacttcaagatggggtctgatggggagagtggacaggcttcagccacgtcc

SEQ ID NO: 614736 - DNA, 111 bp, Homo sapiens
cagataggttaaccactcccatatttctataccccttattgtctgccttgaggaagcctaacatactgtacgtatggtattcctaggatgagcaggcaggcctacctccaa

SEQ ID NO: 614737 - DNA, 134 bp, Homo sapiens
  misc_feature (99)..(99): n is a, c, g, or t
cggtactgggtggtgcagctgatccatcagaaggcagggtctgaaaaatacctcaagcacccatgttaggttttacaataataatattatctacaggangcaattggggaggttcatgatctctgaggcctttg

SEQ ID NO: 614738 - DNA, 335 bp, Homo sapiens
acgagctcttcctggagaaaaggcccttggcagatacaaggattttgagatgagctcgtcctggagtatctgtgtgggccctaaatgcaatgacaagtgtccctatacaggaaaggagaggagggacactggagagcagggggaggccacgtgaggttggaggccagcaggggttacacagccacaggccaaggagggccagagccaccagaagctgaaaaagatgaggaagccccttcccctggagccctcagggagcgcggccctgctgcccccttgatttcagacttttgtcctctgtaaccaagggaataaagtcctgctgtgtgaagcca

SEQ ID NO: 614739 - DNA, 81 bp, Homo sapiens
gtctttgcgtttccagggcgtggggaccccgggccccctatgccgccaagcccgccacaccgccctctccctggcttttgt

SEQ ID NO: 614740 - DNA, 353 bp, Homo sapiens
taagctgggcaattgtagcaggcagatctcttgtgagttcaagacctacctggtcttcaaagtgagttccagtatagttagagctacacagagaatccctgtctcaaacaaaacaaagcaaaacaaacaaacaaacaaacaaaacagataatacaaactatattttaagatttctctcccactgaagtgacctcttgagaatagccactgttcttgcatttcttcataaatctgagtgttccccatctcactgagtggaaatactacagatacatttaaaagatcgcctatactgtgtaagaaattacctcctgatgatccagtagaactcactgtgggatagacacgtctgt

SEQ ID NO: 614741 - DNA, 443 bp, Homo sapiens
cggtactgcgctactgtagccttgatcacgtagcaatgcggtatataggctgagcaaaggtggtgaggtgatctggggttatcgaattcacagaacaggctcctactagagggatatgaagcaccgcacaggtcgtttgagctttatatctggtggctcgtagtgttctggcgatcagtgttgtagatttaacgcgttgtaggttgagggctaagcatactggggtatctaatcccagtttgtctcatatctattcgtgtgtgcaaaatatgttaaagccactttcgtagtctattttgtgtcaactggagttttttacaactcaggtgagttttagctttataggggagggggtgatctaaaacactctttacgccggcttctattgacttgggttaatcgtgtgaccgcggtggctggcacgaaattgaccaaccctgggg

SEQ ID NO: 614742 - DNA, 553 bp, Homo sapiens
agcggatttgcacgcgccgcgtcacgggccgctcccggctgggctcccgggggctgtcagggaggtggcggcggtgaccggggacggtggcggcaggcgcgagccgcgggccgcccgcctgggaggcgcccgggcctcatcaagtgaccagtatcccttccagggaacacggtccttcaaggaaagcgagctccaaccgggcccggcgccaagccgcgtcatcttcttcctgtgccaggaattgcatttgtgaacaaagaacaagaattttctgcaaggatcatatctaagtgcaccttgtgctgatacttcatttcgaatcttgtagaaaattttcagctgtagcccttggactagaagctgcaataacagaagctgtgtacgatgcattagggtattgaacaacactaacttttgaattaactattggcatatacggaaaatacggagacgttgcactgaacctggggcggacgacaatacacatcacccgcctactggatgacacggcaccgacaggtcaccttttacaagagaaagtttgcattaatgc

SEQ ID NO: 614743 - DNA, 188 bp, Homo sapiens
gctggggttactatgagaccactttgcggccagcaagtgtgcatcaatctgcggatggtggagggcttgccgatgtgctggtggtagccacctaccaaaaggatgctccacaggataacatggccacaccccgtactcgtggccagcagttcctactttgccttatattttgtggtacgcccgccctg

SEQ ID NO: 614744 - DNA, 715 bp, Homo sapiens
cacacgcccgccgtgaaagctggtggaatgcaaattgtgcagaaacactcacatacaggagacaccaaagaagagaaagacgaggatgaccaggaatgggaaagccccagtccacctaaacccactgagttcatctgtggcgtcatcgaccagagtgacagaggagggcggccggctgctgcgcaggtggctcaccagaagccgggtgcctgcatggacaagcatcctgcgccaagaacccagcgcatccagcagccacgcgagtgatcctggagtccaccagcctgccgacatggggccgggtctgctgcacttggggttggcctgacagatggaacggggagggggggggaggtcctactgtgctggtgaatctaaggcagaaccgagggctctgggctttgccttacatggggctatggaggactagagacaggtccagcccggacgtagtgtatggggatgcgggttggatgtcatttgaggagcattgtgcccgtagaggtgctcatagcaggaatctgccaagatgcgagaagggtggtagctgtaggtctgatggagcagtggcctgacgggctgggctatgatcgtaggagcaataacggcacagttcgagaggatgagagggggttgcgaggacctgaggagtgcatgctgggtgagagggggcagtgagaagtggacacctgtgggagaggggggagtggggtgg

SEQ ID NO: 614745 - DNA, 373 bp, Homo sapiens
ccatacagtacatcaattccattcctaggggcagacgcaaaataaatgaaagaggacttaaaaagatatctgtacaccaattttcatagcagcattattcgcaatagccaaaagataaaacaacccaaatgtctatcaacggataaatagaacaaaacgtggtgtatacatacaatagatattattcagccataaaaaggaaggaagttctaatacacgttacaatatggatgaacctataaaacattatgctacgtaaaatatgccataggctgggtgctgcggctcacgactgtaatcccagcactccggcaggccgaagtaggcagatcgctcgaggtcaagggttcgagaccagcctggccaccatgac

SEQ ID NO: 614746 - DNA, 436 bp, Homo sapiens
cacgaggggcattggccgtgaaatgcacgaacctccggaagtcctgcactggggaagaccgcgaacagggctggcgctgcgcgaaggcatggtgttcaccattgagccgatgatcaaccaggggggcaacgcggttctgaccgaggacgatggctgcacggtggtcacgcgcgatggccagctgtccgcgcaattcgagcacaccgtggcggtgacgcgaaacggcgtgcgagtcttgacgttgcgccctgatgagaaggcaccgaatttcgcgtcatgaggtccgtggtagagtcgttcgtggttcttgatcgactccgccgctgatcacaacaatatggaaagcgccgccgatagggccaatatgactacgcagattccggcaatcgttcccgcaaaaaccgcgctgttggtcatgcactgtcagaccgacatc

SEQ ID NO: 614747 - DNA, 819 bp, Homo sapiens
  misc_feature (318)..(318): n is a, c, g, or t
tggacagcagcatcttggttatattggacaatcccaggtctatccctaacacgccgaagaaagggtctctgtacagcccggcccggtggggaggagggagggaaggcaggccacccgaagacccggggttttgttcgggaaggtgcacacaaacccggtggcttttccctttgtggcgctctaaaagaaggaaaacaccttggataactcaatatatctccggcctcattaacgttaacacgggtgcgcaaaaagaaagacacactttggagtgtggcttcacaactcgtgcggggtgttgtggcgacaatctctctncctctctctccacccaaaatatttgccatatgatgtgcaccccgagtgtataaaaatgtggcgggcaataaagtgccgatcacgcggttccacccgagccgagaaaaacccacccgtgttgtaaaggtctacaaaaacccgaaagtgtgtctcgagcgaagaggaacacaaagagtttttgtgtaacccaagcgaggaagatgcctctcccgagagagggggccgggctctcccccaagatgcgccgggggcccgccactgggaggcggcactcctcccaagggttcaacaaacgccgagacagccgcgtgtgtgtgcccacaaacaaggggggggcggggcaccaactctctgtatctctccctcgcgagaaaaactcctctgtggggaggaacgagcctctctgccgtcagaaactcccgccggattctacccccccccaagtgtgtctctacccccggggggagtgccccgggggaaaataaccccccggggggccaa

SEQ ID NO: 614748 - DNA, 662 bp, Homo sapiens
  misc_feature (279)..(281): n is a, c, g, or t
  misc_feature (283)..(283): n is a, c, g, or t
  misc_feature (286)..(286): n is a, c, g, or t
  misc_feature (290)..(290): n is a, c, g, or t
  misc_feature (293)..(293): n is a, c, g, or t
tgtgatgctgttggtcagctggctcagctcccagtatagccgctctctgtccagtccaggtccgatgggatcaacgcggtgggtacagatggtgtccactccagtggctgcctcatgcttctcaggtctgagcaaggtcagtctgcagccagagtacagagggccaacactggtgttcttgaacaagggcttgagcagaccctgcagaaccctctccgtggtgttgaacttcctggaaccagggtgttgcatgttttcctcataatgcaggttggtgannntnaanttgnaantgaatggtatcaggagagggccaggctctgtgtggccggggaaggaggatggagtcccagtggttgcccagtacactgtggaggtcccaggagtactggtggtgggcacagagttctgatgggtgaaaccattgacatagagactgtccctgtccaggctgtaggggcccagctcagtgatgttgtgggtcagctggcttagctcccagtacagctgctctctgtccagcccaggtcttttgggattagggtggtagaggcagacagcatccattccagttgctgccccatccttctcgggcctgagagaggtcagtctgcagccagagtacagagggcccacactggagttctgaaaatgggactagc

SEQ ID NO: 614749 - DNA, 714 bp, Homo sapiens
  misc_feature (279)..(281): n is a, c, g, or t
  misc_feature (283)..(283): n is a, c, g, or t
  misc_feature (286)..(286): n is a, c, g, or t
  misc_feature (290)..(290): n is a, c, g, or t
  misc_feature (293)..(293): n is a, c, g, or t
tgtgatgctgttggtcagctggctcagctcccagtatagccgctctctgtccagtccaggtccgatgggatcaacgcggtgggtacagatggtgtccactccagtggctgcctcatgcttctcaggtctgagcaaggtcagtctgcagccagagtacagagggccaacactggtgttcttgaacaagggcttgagcagaccctgcagaaccctctccgtggtgttgaacttcctggaaccagggtgttgcatgttttcctcataatgcaggttggtgannntnaanttgnaantgaatggtatcaggagagggccaggctctgtgtggccggggaaggaggatggagtcccagtggttgcccagtacactgtggaggtcccaggagtactggtggtgggcacagagttctgatgggtgaaaccattgacatagagactgtccctgtccaggctgtaggggcccagctcagtgatgttgtgggtcagctggcttagctcccagtacagctgctctctgtccagcccaggtcttttgggattagggtggtagaggcagacagcatccgaagcagttgccggccgcatccgaagcagttgccgaccgcatccgaagcagttgccgaccgcatccgaagcagttgccgaccgcatccgaagcagttgccgaccgcatccgaagcagttgccgaccgcatccgaagcagttgccgaccg

SEQ ID NO: 614750 - DNA, 561 bp, Homo sapiens
  misc_feature (1)..(1): n is a, c, g, or t
  misc_feature (90)..(90): n is a, c, g, or t
  misc_feature (140)..(140): n is a, c, g, or t
  misc_feature (189)..(190): n is a, c, g, or t
  misc_feature (192)..(192): n is a, c, g, or t
  misc_feature (318)..(318): n is a, c, g, or t
ntgtgaagagagagcacatattgtgcgcggcgcggcgtgtgctctacatgctcgtgtatatccacacgcatcttgtggagagcccagagntgtgtgccgagtctcacagagtgctcgagagagtctcagagctcatatcncgtgccatacacagcgtgtaaacacccgctgctctttcatctaaaaaannanaacacaaaaatattatacgccgagcgctatgtgtgtgtgagtgtcgctgtgatatctccacacgcacactgtggagagctctagagcacagagagatatccgctgtgacacccgagagagcgcganagtcttcacatgtaaccgcagagtctcagcgccatgtcgcatctcacagctgtggcgcgcacaaacgcagagatcttgtgtcacaaatataatataatataatataatatatataagatttgcactgtgccctgtgtctgactcgtgtactcgtgtgatacgctttgcgcacgagtcacatgtgcctctctcagggcttctatctcgccgcgtgccatattcgtacagcccgggggatccact

SEQ ID NO: 614751 - DNA, 111 bp, Homo sapiens
  misc_feature (8)..(8): n is a, c, g, or t
  misc_feature (85)..(85): n is a, c, g, or t
  misc_feature (111)..(111): n is a, c, g, or t
tggggcgngtcggtggcggcaggccagcggccattacccgaagtatgtacgcggactcatatagggctatgactaatgccccgtnatgatactataatactaggcatgcgn

SEQ ID NO: 614752 - DNA, 804 bp, Homo sapiens
tacaacgggacgtatagacccgaagatgtgaagcgacgagccatggccgaccctgaggtgcagcagatcatgagtgagcgcaggcatgcgccttatactggaacagatgcagaaggacccccaggcactcagcgaacacttaaagaatcctgtaatagcacagaagatccagaagctgatggatgtgggctctgattgcacattcggctgataggacttgtacatcccccgcttacccgttcgatcactcatgtggaccagaggagctgggaccgcggcgagcagacacggagcggacagggagagacagcgggagagaaggcctcatctctctatattatatagcatagaccccggggaaagacaacagagactcgtacactgcagacatgatatagtgccgacgcatgcactctgggccctacacagacgaacacgcatgagtcacaaacacacgctgaccacggaggtaccatgtaatcgtttaacaatgaacgccaagattgctgtctacctgccttgctcatccacaattaagtaagaggaaacaaaaccatattagtcggaggacaagatgggggacacatgctaacatgtgagggaaggggaaaatggggtgctccaatttcacggcacctccactataccccagcaatggtacatcacggatagcaaacaatccctgcggtacacccatatctcaccaatcaactaaaagagagagttggagacggaggataactatggtcgaaacacaaaccaaaaacaccaaaatcagcaagaagaactacctactctcaaaaa

SEQ ID NO: 614753 - DNA, 193 bp, Homo sapiens
aggagcatccgtgtacgtatcatcttctccgttacgaccgtagcatgtggtctcctttatcgttagtgggccatcaatttcatcacaatcaattatcaatataaaccgctcctgccgataacccaagtaccaaacgcccctcttcgtctgatccgtcctaatcacagcagtcctacctctcctatctctccca

SEQ ID NO: 614754 - DNA, 379 bp, Homo sapiens
  misc_feature (12)..(13): n is a, c, g, or t
  misc_feature (16)..(17): n is a, c, g, or t
ttatggttaccnnccnngagtatgaatatgtgaccgagcgtcgggatagtgtatggcaaccctgaaacttatcattgtcgcacggctgcttctctctacagtacggttggttagcatgtaatatgatgatcatagatacgtaaatgttataaatgttatatcttcttgctgtattgaacctcttactaatatgtaatgtcttaatctcttgtcatcttttgttttaaagtctatttgtcttatagtcaccaccctgctatcttttggttactgtttccatggaatatttttccatcctttcactttcaatctgtttgtgtctttggatataaagtgagtctcttgtagatggacgtagttggatcaggtgctttaatcc

SEQ ID NO: 614755 - DNA, 213 bp, Homo sapiens
  misc_feature (50)..(50): n is a, c, g, or t
catttaagtttagtagtaaaagactggttaatgataccaatgcatcgtanaacctcagaagaaaaggagaatgttttgtggaccactttgggtttcttttttgcggggggcaggtttaaggtaataggttttaaaaacaggaccttttaaaggaaaccacctggcccaaaatttggccacaattttttggccccttttaaaagtgttatgtga

SEQ ID NO: 614756 - DNA, 162 bp, Homo sapiens
  misc_feature (111)..(111): n is a, c, g, or t
ggctatacattatcacatacaaccagaaatctgagaacattccaatgttctaagacatctccctttcaaagtatatacctgtttttgtggcagatttacaaatagcctaanacactcccaccctaccaaaccaagtctttctggaagtttctgtagggcaga

SEQ ID NO: 614757 - DNA, 264 bp, Homo sapiens
cggggttttaccatgttcgccaagctggtctcaaactcctgacctcactcaggtgatccacccgcctcagccttccaaaagtgctgagccaccatgcccggcctcaataattactcttgagatttgtttaattgctctgttcatatattactgtatataaatgtaggcatttactttacgggtcataagtaataatgctaattttttgtgttaaactcttattcagattctactcacatattatttgaactctatgtgttgctg

SEQ ID NO: 614758 - DNA, 109 bp, Homo sapiens
gcaggacctcggcagctcaacgggccatgttagaaatccagtatgaaaataaggttggtacaggtcttgggcctacactggagttttatgcggttgtatctcaggaact

SEQ ID NO: 614759 - DNA, 621 bp, Homo sapiens
  misc_feature (34)..(34): n is a, c, g, or t
  misc_feature (223)..(223): n is a, c, g, or t
  misc_feature (228)..(228): n is a, c, g, or t
  misc_feature (232)..(232): n is a, c, g, or t
  misc_feature (239)..(239): n is a, c, g, or t
  misc_feature (241)..(241): n is a, c, g, or t
  misc_feature (247)..(247): n is a, c, g, or t
  misc_feature (260)..(260): n is a, c, g, or t
  misc_feature (344)..(344): n is a, c, g, or t
  misc_feature (363)..(363): n is a, c, g, or t
  misc_feature (382)..(382): n is a, c, g, or t
  misc_feature (402)..(402): n is a, c, g, or t
  misc_feature (419)..(419): n is a, c, g, or t
  misc_feature (422)..(422): n is a, c, g, or t
  misc_feature (426)..(426): n is a, c, g, or t
  misc_feature (428)..(429): n is a, c, g, or t
  misc_feature (436)..(436): n is a, c, g, or t
  misc_feature (442)..(442): n is a, c, g, or t
  misc_feature (453)..(453): n is a, c, g, or t
  misc_feature (457)..(457): n is a, c, g, or t
  misc_feature (490)..(490): n is a, c, g, or t
  misc_feature (541)..(542): n is a, c, g, or t
  misc_feature (558)..(558): n is a, c, g, or t
  misc_feature (560)..(560): n is a, c, g, or t
  misc_feature (562)..(562): n is a, c, g, or t
  misc_feature (573)..(573): n is a, c, g, or t
  misc_feature (583)..(583): n is a, c, g, or t
  misc_feature (593)..(593): n is a, c, g, or t
  misc_feature (600)..(600): n is a, c, g, or t
cagaaaatccccaggtacagtagccatgacatancaaagttctgggcctgagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttttgaaattgacatgaatgatatcaangcctntatnagaagangnatggtntctccctttgccnagccctcctggatgaaaccaaaggagattatgagaaaatcctggtggctctttgtggaggaaactaaacattcccttgatggtntcaagctatgatcagaagnctttaattatatattttcntcctataagcttaaataggnaagttttttcaacaggnttncagngnngctcccnccatgntgaaaaaaaangccnttaaatcctttttatattataactctggataanaaagataaggcccttttttaaaaatgttttcccccaaccataaaaccctanncaagttgttttagtancnanacatgagaaanatgtttatgnagctgaaaanaaaatgncgtccccagaaaaaaaaaaaa

SEQ ID NO: 614760 - DNA, 1631 bp, Homo sapiens
  misc_feature (172)..(172): n is a, c, g, or t
  misc_feature (253)..(253): n is a, c, g, or t
  misc_feature (770)..(770): n is a, c, g, or t
  misc_feature (800)..(800): n is a, c, g, or t
gcatgaaaagaactgaggaatactgaagagacatatgcttgagtctgtggagcatggggatggagtaacctggaggtaccctccatgtggaaacattctcgcgcatcgttttgatacatcaacctggcaaggatgacgagaggctgtgctacagggactgtctgcaatgttntgggggaatgtatgcaggtatgatgatgagtgagtgctttgtataactactatccaccaatgtgaaaaaaaattcccatgnctcagccatggccaggcaaaggctcaggcgacgtcacggcgccaagcaagccaacgcccgacttgtttcttaggcttggaagacattagacgattatagggcgaacgtcgcatcgttgccagtagccaaacaaaacacgaattagagcagttccgtgggcgatgctctggggcagatacgtacgcataaacacgagttggaggatatatctattattctcaacagaaaatacatagaagagaatagggttgacttcatttctgtcgccacattgcaggtatgcgtcgtacggacatgtacgtcctattttctggatgcttttccgaggccaggttagacccgtaggtgagacagcttgctcgatcgagagttctagagggaggagaacggtgatgcgagatggagaacgctaggggtctaatcgatcgcaattgtgtgggtttcgctctttgggtataaaggttacaaaaggtgcgattggcaccatttgcgaaccaatctatgagtaacattgaancgagaaagacaagaagagctagcttattcnacaagtgggggctactacgaagttcccacaaacccctttgggcccatgtggagcaacatgttgtacacatgcatgtgggcataggggtggcgatgtggggcgtctgtccacattgtccttgagctaagagggggaagcgcgtctccaaagggtgtaccctccatatattttgtaaccccaaaggggtgtccatggcaaggaaaaacgtggcaaacgattggggtggtctggtttgtgaacctgtgcgaacaagcgtcgggggtataattcctcatactaatgttcgttctaatcctatgtacaaaaggcatttgcgattaagactgggagtctacccatcgtttttggtacgcttcccacaagaaaacacccccaaggggtgggcttgtaggcaagtgcgtcaggtccaattgtcctcctattgagcaaaaccattcacgtcacctgccataagggtaatcttaggcaacgtaactggggcacttgtccggagcttctaaacattggaggcacatggctggggcaaaacacaacaccccaggaacttaaggcaaacggaagtaccttcagcgggcgcggcagcggtcccccaatgtcaacacggtggtgtcgtcggacccgtagaacgtcaggttgtacccggcgcacagcagggcaccggcccgtgttcccaccaggtgacgcgggcttacgctggtaaaccacacagtggccttcccgctggcgtcacaacagcgtgcggtgtgtcaacatacggcggcgggatcacacccactatattcggaggggcacagggtacaatcggcacaacccccccgtgcaccacacgtc

SEQ ID NO: 614761 - DNA, 229 bp, Homo sapiens
  misc_feature (175)..(175): n is a, c, g, or t
  misc_feature (218)..(218): n is a, c, g, or t
atgctggattacagggataggtgctgggctgacaacacacttccagagtgttcaaagacagctaatgacgctatccaggacatgttatgtgacatggagggactgccgcagaagcacaacttttctcattgctgcgggaaagccggctttccaagaagactctgtttcttctacnaccaagaaaagctaatgtaggattcttgcccccctttccccantctgggatccg

SEQ ID NO: 614762 - DNA, 289 bp, Homo sapiens
  misc_feature (32)..(32): n is a, c, g, or t
  misc_feature (46)..(47): n is a, c, g, or t
  misc_feature (58)..(58): n is a, c, g, or t
  misc_feature (70)..(71): n is a, c, g, or t
  misc_feature (84)..(84): n is a, c, g, or t
  misc_feature (93)..(93): n is a, c, g, or t
  misc_feature (112)..(112): n is a, c, g, or t
  misc_feature (118)..(118): n is a, c, g, or t
  misc_feature (134)..(134): n is a, c, g, or t
  misc_feature (148)..(148): n is a, c, g, or t
  misc_feature (193)..(193): n is a, c, g, or t
  misc_feature (206)..(206): n is a, c, g, or t
  misc_feature (216)..(216): n is a, c, g, or t
  misc_feature (241)..(241): n is a, c, g, or t
aacagctaagagatatcctttagaattacatntattttagcataannaaattgaaaantaaaacatactnntttttttcaacangaccatatntaaattaaatagtgaaatntgtatnagtttcagtagaactntaccatcaacaatntttccataaatatgcagagttctttctttgtattgttatttacantatttttaaattnaatgcatttncaatttctaggattctaaagaattnagtacagaaagtagcaattttattatttgatgataatatgaggattac

SEQ ID NO: 614763 - DNA, 406 bp, Homo sapiens
attcgaccgggctcctgcccatgtgcatttccaaatgtgaatagctggaatccaaaattcattaatttaattttcatttcagttgaccctcgaacaacaaaagtttgaactgtgtgggtccacttatatgtagggctttttttcaataaacatattggaaaatttttttggggaattgtgacaatatgaaaaaactagcagatgaaccatgtagcctagaaacataaaaaaaaaaaaattcaagaaaaggttaggtatgtcatgaatgcttagaatatatgtagatcctagttaaagtatgggattaatcaattatttatgttatcaatacggttaccagtcaacagtaggctattagcagttaagtttggggggaatcacaagttgtacatgggcggggagcccg

SEQ ID NO: 614764 - DNA, 211 bp, Homo sapiens
cttcacctgctcacagtgcagtctacctctgacacacacccgcacagccacacccagaaacaatgcttccccggttctccaggtgtaccttcatccagtcaagttgacacctaaaattcaccatcacagctggattggagtctctggatggtttagtgaaatgccgtatacccctattatttaaggaggtctgtggtgtaactgctcttgt

SEQ ID NO: 614765 - DNA, 306 bp, Homo sapiens
tctgctgcgcctctctgtgaattccaaggccccatcagtatcagaatgaaatgaaaactatctcaataggggcgtttctatcaacttctgtctgatccacacccattaatgcatgagactctttaacacaaatactttaattgggcgtcaccctacacctaaagtcaaactaattacaaatgtgcgtgagaacatatggccacaaaacgtaataaaatgcttgttgaatacaaactgctcgcgtctccactccgagggtcacagtaagtcagtggccaaacaagtactgcagattataacgagcta

SEQ ID NO: 614766 - DNA, 94 bp, Homo sapiens
  misc_feature (38)..(38): n is a, c, g, or t
  misc_feature (61)..(61): n is a, c, g, or t
  misc_feature (91)..(91): n is a, c, g, or t
caaaacgttgtgggcaaggactggtcgccccgtaagcngccggcgcaccgcagcccgtgcnccaggagagactcgaggccctgatcccgcncct

SEQ ID NO: 614767 - DNA, 475 bp, Homo sapiens
aagaactgattgctatactcacagaaaactatggtgggaaatggccctttatgctgtcccctcgccaggtaatgtgtagttccagtgggatcacacctgtgatgaatatgcccaaaaggtacgacaccaattccacgatgccaaattcatggcagacatatgatactggatccaggctgtaccttgaataagcacacgatacgaaatgcacagtaagccacagtcatcacttcatactatagttgtaggtgaaaaccgagaaacatcagttggcactgttacataatccgcacaagagacaataaggtccacggggaactgcaccaatttactgaaactatcgagcggctaccagcaactccaaagagttccgggagcaacaacaggccgaagaagactgtacactgcccaaattaccccagacttggaccatggaaacaaggaggactagcgtttccgtaaaaattgactctgt

SEQ ID NO: 614768 - DNA, 836 bp, Homo sapiens
agagtaaatagacaatctacagaatgggagaaaatactcataaactatgcatctgacaaaggtctaatatccaggatctataaggagcttaattcaaagcaaaaatcagtcccatcaaaaagtaggcaaaggacatgaacagacatttttcaaaataagacatacaagcagccaacaaacatgaaaaaatgcttatcattactaatcatcagagaaacgcaaatcacaaccacaatgagatactgtctcacaccactcagaatggctgttattaaaaagtcaaaagacaatagatactgacaaatttgcagagaaaaagcaatgcttatacactgtggaatgcagtttggaaatttctcaacttaaaacagagctaccattaggcccagcaatcccattactagatctatacacaaaggaaaatagattatcataccaaaaagatacatgaagttgtatgttcattgccatgccattcacaatagcgaagacatggaatcaacctaggtgcctatcagtggtggattggataaccgacaaatgtggtacatatacaccatggaataccacacagccctgaaaaagaatgaagtcatgccctttgcagcaatatgaatggagccagaggccattaacctaaacgaattaatgtaggaacagaaaactacatatccacatgtttctcacttataagtggggatctaaaccattgagcacatgttggacataaaacatggggaccaggtagacattgcccgactactagagcgggcagcacaggttcaagaacaaatacctatggggtaccatgctcactacttgactgcagtataacc

SEQ ID NO: 614769 - DNA, 136 bp, Homo sapiens
cccctgataaggttcaataccaaataagcttgcagtagaaccaccgtcagtcgctttaggcttagttttgcgcacacgttttgtagatttttcatctacaacatcagtttgttcgtctaagacagtattttggttg

SEQ ID NO: 614770 - DNA, 360 bp, Homo sapiens
atgtgtggtgtatggcttagataatggttctttgacaatgatgatttcgtacaaggtggcaaattaatggctcattgtagccatcgcgtacatgcgattaaggttagaacttaccatctcaataatttttctcttatacagtaagatgtcaaccttagaggcaacattagtccatcatgccatgaatacatggaaattcttgcgatctccttgaacaatcaaattgagttgttcctcatgctttgtaatcatagtgtacatggaaaagcgacctataaaatatgtaattagattgataacagggaaaaacttaccccacaattgtagtggtaccatcgctcgacataacaccacacaatt

SEQ ID NO: 614771 - DNA, 124 bp, Homo sapiens
  misc_feature (33)..(33): n is a, c, g, or t
  misc_feature (37)..(37): n is a, c, g, or t
atatccaaacagcatccctgcaaaaataactgnatgnagcctcccagttttttaacttcttgtcgtggactcatcctcaagtcttgctatgttggcacaaggcagtaaatcactcagccagtgt

SEQ ID NO: 614772 - DNA, 1078 bp, Homo sapiens
  misc_feature (914)..(914): n is a, c, g, or t
gctgcgggaggctctggagcggagacttggggagctgcccgctgtagcaccccaaggggcggtgtctgcgagaagagctcgctgcggtctcctccgatgccttcagcacccgcctggccgggccctttcccgacagagctctacatctacccttgctgcaatgcctcgcgcctgactcacgaggagagcccgtgagcaggtacagaagttggtggggtctgcgaggaggatcctcccagtacgaacattctcacgtggatacaccttactcgcgcgctcaaatggagtgcggaccttgagggactcccacagaaacacgcacgtgcaccccaacattatccgtgaaggtcgcagcgcgctagactcctgggggtccattttacgaagaggcgccaaagcggtgacagcgcgcgtccaaggttgggcgcaggtaggcaagcccgtcgatacgtgccaggaatgggcacggcaggcacatgagcccagggttgataggagttcggggcaatctggttgcatttaaaacggcgtacgggactacacctagcccaggtaggttagcgcgtgcaaccgaaccacgtcttctcggcgcacaccgacccacttcgttgaggcgtcacacgcacaaagtttcggcccctttgtggtggaaccaccactgaaaggcttctaacagccttcgttagcgcacggccttcggcgaagcacgcggtgcctcagcggcggtacaccttggggaaggtctacgagactagattgccttactccttgaggtacggtgcgaaaagcccagggagtccggggttggcacctttcgtatagcctaggtccccatttcacaaaatcgatcatccgcctttgagataccagaatatcgctgacaggcggtagcatctgtcccgtatcttgtgcgncaccgaaccacttgagcaccgcaacgggtggccacctttagtacgtagttttgacgcacgcacctttcgcggaccctatagttgttaagaccgatcagctcctaagggttacgcttgcgccctactggttagtgcaggccatgcacgtaggtttcagcacacga

SEQ ID NO: 614773 - DNA, 624 bp, Homo sapiens
tgacgagtattcattatgcgtgcatattagttgtagggcataaaagacagcttagaggacggaggtaacatgggattacatttttgctttcccatcctcctcccccacctctcaccagtgggcttctgtgtaaagtgagcgctggaaatgaaaatgcttgtctgacaacaaagcattgagctgcccttggaagactagaaccaaagcgggttgcttgggtgatagcattgtaggtactgggcgtcggttagcatgaggtctttatgcatgaatacattctacatatgtataagcagtatgctttgatttttacttaatttaatcttcagtgtttaaatgcaaatttatagacatcaaaagagaaagacatctaaatttggcaacagaaacgtacagacggaagattcagtgtttctgtttcactttaacggtatggctcaaaagatcaaaatgatttatagggcttattaaaaatcagatttgtgagttaaatctcagaggataaggcccaggaatttacattttaactagtttaccacagtggttgttaggcacaggaacgttgagataaagcttctcatatcatgtccaataacatacacagagacggcaaaaaatagaaga

SEQ ID NO: 614774 - DNA, 222 bp, Homo sapiens
tctgctaccgggactaacatggaagcgtttttggggtcgcggcccgcactttgggcggggggtccggccccacgacagctttaccggattccatccactcccgattccttcatggatccggcgtgtgcactttacagaggtccaatcacgcgaacccagaaccccatggtgaccgggacctcaggcctcggagttaagttccagggcggtgtggcgattgcc

SEQ ID NO: 614775 - DNA, 1314 bp, Homo sapiens
ttgtcacacgcgcattttgtcgtctcgcgggatgacacaaactatttctcctgggggggatgagaaaacaacaacagccgcttgtgggaggagttattttgcgcgaaccacctgtctcatcgcgggttgtgcgccgcgtagagatctccaccctcttgtgttgttggacccgccctggggtttttgcccaaaaccccccgctgtgacggcggactcttgcgggaaaataccggggccacacagggccgcgattttctccagtgtccgctgggagagacctcctcctgggtggaaaagattcacaccaaaagttcctctagcgggcaaatatccggggggcgccctgtttatccacacgggggcttctacaccaggttgctcccgcgtatcaacggggcacaatcaatattaatatgttacccggggcgggccccctatatttttcgggccccgttgtacacgactaatcagggccccaaaaggggcaaatagtcttcctccgccgatctccccccatggtacaaccgccaacacctctgctgggtgtatacctgggaatgtaattctgccgccacgagcctgctgatgacgcggcccgcttggccacgggctctgggtgttctctataccccccctttgagacaccgggctttcgtgcggcccgcccactcgagttgaaagcgccagttcccgcgggccgcccaaagggaggccctaacacttcaatggaacacgggggcaccccctcgacctctttgtgagggaaaagaattttcaagaagaatgtaagggggggcaaaaggcccatttttttcaaaagaggtgccgtgcgtcccaacacagtccctctcgcgggacacatgggggggccgcccttcgctgcctgggtccctggtatcgaacgagggctcaaagaaaggggaatctaaaagggcccccggcgcctccctccaccaacaacaacaacaacacacaccccaggggagaccccaagaggagacccccggtatgaaatcctcacacccgtgcggagccacatcaaaccttcgagagaaaattccacgttgtcttttttcccacaccgcacatcctgcccgtaagagatggccggggaaggctttagaaaaaggggcgcacttgcgaatccacaaccaatcggcacgccgagattccctgttttgatcaccggggtgggaagggaccgctggcgtccccgcgtggggccccatgggtgagacactcccagtactgagacctagagtcccaaaagcttgtaggagcccagtcgtgttctaagtatttattttaaaccca

SEQ ID NO: 614776 - DNA, 748 bp, Homo sapiens
gaggggacgtaacggaggcaggttggagccgctgccgtcgccatgacccgcgtaaccaggtgagttcgcccgcagaagaatatgaaaaagcagagcgactcggttaggggaaacgcgccgagatgacgggctttctgctgccgccgcaagccagagggactcggggatcatgcagcagaacgcagaaaagggcaccgagaagaaggaggaacccaagtagcttgtggcttcgtgtccaacctcttttgccctttcgcctgtgtgcctgggagccagtcccaccacgctcgcgttccctcctgtagtgctcacgaggtcccagccaccgatgggcattcccttttgccctgaggtctgcagcggtgtccttggggtgctttccttcccctcaggtagccttatctccccgtggccacttcccggggtggaggggggttacccctttcccgggctggtccatccctgtggggctcacccccaggagtttattcaagagttccgctttggttaccaacacaacacgaaccggagcacacacaactttgctggcccaacctgcagccctctgaaggaaggtcttcacaagcaatttgttgtggtcgctggaccacgtgtgtggttgagcacaacggtcgcaatcagggctctcaagcggaactgcgcggccaataacagcggcgtggattacgcagattaaaagccccgggtggacccacgtttggcacacccacacggctcccaggcccaa

SEQ ID NO: 614777 - DNA, 86 bp, Homo sapiens
caggaatgccatcctctcttctcctgcctggattatttacaaagcatgtgtggaaacccactatttaataaaagtgatagaatcag

SEQ ID NO: 614778 - DNA, 195 bp, Homo sapiens
gagcatgtggatcagacgttgtgtcaaggggtcaaatatttacatgtcagttgggtgtggtggctgaaacctgtaatcccagcactttgggaggctgaggcaggaggattgcttgagcccaggaggtcaagtctgcagtgagtcatgattgcaccactgcactccagcgtgggtgacagagtaaaccctgtctca

SEQ ID NO: 614779 - DNA, 412 bp, Homo sapiens
  misc_feature (12)..(12): n is a, c, g, or t
  misc_feature (178)..(178): n is a, c, g, or t
  misc_feature (185)..(185): n is a, c, g, or t
tttccctttttnttttattctcccccccaaaaagagccggggcgggggttggcgagtggggcgtttaaaattaaagccctatgccaggtccaatgtacagctgcaaagtggcaagaagccctaagaaagttcaagaagcaggtcaagggggtgggttggaagatggacgttcaagcanaacaaangagccctccctccccctccgtaacttaatgtcacaggtggaattaaagaaatctggcaaaaaataaattttgttatccgtgcttggggcggtgacccttgaccccattcctatttaaacatctggattctctgccataacatcttttgccacctatagctacaataaagtgtcgtcttggagtctgttgtacatttaagaataaacttttgtaaggaagtaaaaaaa

SEQ ID NO: 614780 - DNA, 752 bp, Homo sapiens
gagcggacttgcgtgtgagcccggcggtgatgacggcaacatggccctgaacggtagctgtaagtctgatcgacttctccgtgggaggcccccgattgaggcggagacgaaggtgctgcaggcgcgacgggagcggcaagatcgcatctcccgcgctcatggtgcagactatctgcgtgcgcaggtctcaccgacatgtcgtgggcgagacagtgatgcggatctgcagggacgatcctacctcctaaagagcaatcagtcggagtaatctactagcgtgtgcttgtcagtgaacctcggagtcagtacgtggatataagatatatccctgttgctgaatgcgccagtgctgcccatcatcccacagctcgggattgcagcacagatggcctcatgcctcagatgctcccacctgggactctcgatcctgcgccccaagcccccaagtaccttcgtccgagagcactagtgagaggagcgtgcagcattgactcacaggcagccccaggggccacctgctacctgcatgtgcctccaatatacaagatcgtcatggcctgcacacagaacagccctcattgcagaacgctgacctggtgcctctgcgtgaactgggctctagcacactcccttggagactagacatccagctgtgtggccttatccgcgcatatgcggaggccctgcgcaggcctgcagcaggctacagcactaagagcaagcccctgaggacaaaaccctctagaaaaacg

SEQ ID NO: 614781 - DNA, 913 bp, Homo sapiens
gaggttactctggtctgggtgctctcattcatgaatcgacaaggatacattagattatatcgaaagcattttcttaacgaagcagaattcctttaactaattccttcctacgacattgaactatacttatacaaattaaagacttggggacaggagaccactgacgcagacttgccagtttgggtcctcatgaacataaagaggacagtttgataacgtaccagaatagaatacccctagtttctaacagatagtgagaatctctgaagttcatcaggcatcttaagatgcacttacttgaaagtttgagattctgtctatcatttgaaaacacatttggctttaattctttctttgacatgtggtatattccatatcaagaagtatatgaacaaaataataaccttttgaccctgaccttgctgggtgaattagctctgaaaccactctctacaaccagtaatgcatttgtcccacatttcattctgatagaaaatgaacaacatagcaccaaatcaaaaatccgaggcgtcagataatgtctggattaactaatgtaagactctctaggatttcggtccgtcatgtaccattaataacagactttacagtcagtttctgttgccatcataggtacccattaccagacaaggtaagtgtcgtgtaccattgcatctgaattcctgattgtaaagacacctatgagggactcttagcaaccgggccactccactaagatcggatttcactcacaccgtacacattaatatactggtggtagaaccacctgaaactgtacaagcaggattcatcataaggctactagtacacatatttggacaagcagtcagataggcggaacaccttggaaaaaggtgaatggacatcagcggtgtagcccatcaatgtcaat

SEQ ID NO: 614782 - DNA, 207 bp, Homo sapiens
  misc_feature (37)..(37): n is a, c, g, or t
  misc_feature (73)..(73): n is a, c, g, or t
ctctagaggatccttacacttccccacaggcgcacgnggcagctgcggtcgctcaatgatcagcttacgtatngggcatctataagacttgagcttcttcctttcagcaagatcaaagtcttagaaaagtttggtaggcctggagggactcgaacccccaaccagaccgttatgggcggtcggcggaacgttgctagcggcggccgc

SEQ ID NO: 614783 - DNA, 175 bp, Homo sapiens
ggctcgcgagcatatctttaagggcaccttgccactactggcttagctgcactgtgacaagctgcacgctggatcctgagaacttcaggctcctgggtcaaggtgctggtctgtgtgctggcccatcacttatggcgaagaattcaccccaccagtgcaggcggcctatcagaaa

SEQ ID NO: 614784 - DNA, 133 bp, Homo sapiens
agagcggacaggtaggacgagatgcgaggttcgagtcagaagcttatgtcgttgatgcaggcaaacgccatatcgggggcaccgattattagggcacactagtcagttgccaaagcctccgattatagacttt

SEQ ID NO: 614785 - DNA, 427 bp, Homo sapiens
  misc_feature (35)..(35): n is a, c, g, or t
  misc_feature (51)..(51): n is a, c, g, or t
ctgccccccagtcttttatttgtaattgtaatganatatacatagcatganatttacccctttaactgtttttaagtgtacaattcagtggcaccaagtacagtcacactattgtgtaaccatcaccaatatttacatgtagagcttcttcatcatcctaacagaaactctgtttccactatatattaactccctgacccctcccttcctttagccctggtaacctctactatattttttgtctctatgaatttgcctactttaggtgcctcatataagtagaatcatacaatattcgtctttttatgtctgtctgtcttatttcacttagcataaagttttcaagattcatccacattgtagcatgtatcagaatttcattgctttctaatgctgacacacacacacgcacgatcgtcgacgcggc

SEQ ID NO: 614786 - DNA, 336 bp, Homo sapiens
ggtcgacaagtagatcatatattatgtccccaaaaaatcttaaaactttcaaaaaatttgaaattatatcaagcatcttctctgaacataatgggataaaactagagatgaataacaggagaaattttggaaattttacaaatgcctagaaattaaacactacacttctgaatgaccagtgggccagtgaagatattaagaagaaaagagaaactcttcttgaaacaaataataatgcaaacacaacatactaaaacttatggaatatagcaaaagcaatactgagaaggaaatttatagctataactgtctacatctaaacagagaaaagccttc

SEQ ID NO: 614787 - DNA, 280 bp, Homo sapiens
gcttggctgccacgcgcagcatgctggtcacagcgaacggggtgggccctggctgggctcctgccggtatgctcaattaggtacttatcgcggggcagcttctgtgacccctgctgtcagagaaccagcacatgctttgggctgaagccacgtgccatgcacgtcagcggctccaggtcgtgcaaggtcatctccttcgacgggggatgcacccggtgtcccacctgccataatgtgtttgcagattttgtgatgatgccggctagatggggtcttcaac

SEQ ID NO: 614788 - DNA, 303 bp, Homo sapiens
aaaatccaagtgaatgaggatgtacacatcaaaaccctggactacatgagacctgagaaggggttaaaggatcagccactggggatgacagaattcctagtatgtccaaccctctgggcctccgtttcccccatgtgtcctacctgctccctagtaaaatgccaagttctataatcatttgacataactgagaggagccaggaaagaatgcagaaatcaacacacacacacagacacacacagacacacacacagacacacacgcacacacacacatacatttcacataaaaaccgtcgacgc

SEQ ID NO: 614789 - DNA, 387 bp, Homo sapiens
  misc_feature (57)..(57): n is a, c, g, or t
  misc_feature (170)..(170): n is a, c, g, or t
  misc_feature (173)..(173): n is a, c, g, or t
  misc_feature (182)..(183): n is a, c, g, or t
  misc_feature (186)..(186): n is a, c, g, or t
  misc_feature (232)..(232): n is a, c, g, or t
  misc_feature (246)..(246): n is a, c, g, or t
  misc_feature (255)..(255): n is a, c, g, or t
  misc_feature (300)..(300): n is a, c, g, or t
  misc_feature (315)..(315): n is a, c, g, or t
  misc_feature (365)..(365): n is a, c, g, or t
  misc_feature (385)..(385): n is a, c, g, or t
ctcccaaaagcccggtgtgggggcgggccacgggggagatcccaagctcagtccccncaaagttcagggccggtcggaggcaggggcaggtccgggtccaaaggcctccaacttcagggggttgggtaaggggggccgcctcccttccgcacctccatccagcaaggacnccncagtttttnngantccagcagcagctccagcgatttggacccggatgtgaagtcccccnctgctggctccaancagcacganagcatcccgggcaaggccaaaaagcccaaagttaaaaaaaagganaagggcaaaaagganaagggcaaaaaaaaggaggctcccccctgaagggccctggacagggctcnttaaaccttcctttttgccnta

SEQ ID NO: 614790 - DNA, 344 bp, Homo sapiens
  misc_feature (137)..(137): n is a, c, g, or t
  misc_feature (145)..(145): n is a, c, g, or t
  misc_feature (161)..(161): n is a, c, g, or t
  misc_feature (227)..(227): n is a, c, g, or t
  misc_feature (250)..(250): n is a, c, g, or t
  misc_feature (269)..(269): n is a, c, g, or t
  misc_feature (276)..(276): n is a, c, g, or t
  misc_feature (300)..(301): n is a, c, g, or t
  misc_feature (317)..(317): n is a, c, g, or t
tattatgcatagctggtcttgaactcctgggctcaagcgatcctcctgcctcagctacccaaagtactgggattacaggtgtgagccagtgtgcctggccctgttacctcctttcatcctctgagcagaaaacagtnactaggtngttcatgacatctatngggtactccctactgtgtgccagctgctgggctcacctgcttacacgtgttacactgttgtaggcngtcagctattctataagtaggtnctattattatccccgtttnctagatngggaatctggaatctccagagagnncggatggaacccccanaccccagtgttgggctgcgtaaaagtg

SEQ ID NO: 614791 - DNA, 450 bp, Homo sapiens
  misc_feature (54)..(54): n is a, c, g, or t
  misc_feature (84)..(84): n is a, c, g, or t
  misc_feature (293)..(293): n is a, c, g, or t
  misc_feature (314)..(314): n is a, c, g, or t
  misc_feature (444)..(444): n is a, c, g, or t
aagtttgtggtggaggacccagaaagtggtcaggtggtgcaaagtaatcaaatnttttgcatttgtgtgctgtgggtttgactnttgtgctttttctcctaccacaaagggcagctgacacagttaaagctggcaccccataggttttggtcactgcatgtttagtcctgcagtcatcactccaggcacaattgttcctacacatgttggggcttgggttgttggttttcccacaacaggacaccaggcacatagttaggctaacaatgttcatcctccacagagggccccantcctaccacccagtaccaganagcccttccctacagcactctccactggccctgcacttgacaacacaaagagtcacagccaccgtcctcccaccacaaacgtgggatccgtgcacgttaacgattactaggactatgcgaaaaccttcgngtacta

SEQ ID NO: 614792 - DNA, 328 bp, Homo sapiens
  misc_feature (57)..(57): n is a, c, g, or t
  misc_feature (111)..(111): n is a, c, g, or t
  misc_feature (114)..(114): n is a, c, g, or t
  misc_feature (123)..(124): n is a, c, g, or t
  misc_feature (127)..(127): n is a, c, g, or t
  misc_feature (173)..(173): n is a, c, g, or t
  misc_feature (187)..(187): n is a, c, g, or t
  misc_feature (196)..(196): n is a, c, g, or t
  misc_feature (241)..(241): n is a, c, g, or t
  misc_feature (256)..(256): n is a, c, g, or t
  misc_feature (306)..(306): n is a, c, g, or t
  misc_feature (326)..(326): n is a, c, g, or t
ctcccaaaagcccggtgtgggggcgggccacgggggagatcccaagctcagtccccncaaagttcagggccggtcggaggcaggggcaggtccgggtccaaagcaaggacnccncagtttttnngantccagcagcagctccagcgatttggacccggatgtgaagtcccccnctgctggctccaancagcacganagcatcccgggcaaggccaaaaagcccaaagttaaaaaaaagganaagggcaaaaagganaagggcaaaaaaaaggaggctcccccctgaagggccctggacagggctcnttaaaccttcctttttgccnta

SEQ ID NO: 614793 - DNA, 495 bp, Homo sapiens
tgcatccttcttttatacaaagtcctgtgttagttgtgggaatggagagaagagaatgtatctaaggaggcagagcagacagattttggcaactgattagatatgagggatctgggagaggtcaaagttagctagcgggtttgatccggagtgtgggactctagttgtgccagtacagaaatgggcagacagtcattggaacagttttgagaagaaagatgcccatataggaaagagcccatagaatggttataaaatatgcctggatttgtggaaccagttctaaagctggcattactttcagattcttagtatcttagaggtgggtgtgatcttgtagatcctgtttcagtctcctcagaagcggggaaaattggtatcatttgtaggctattgtttaggttggggcaaaaaaaaatataatggggggagacattatatataaaggtgatatttacttcttagacttgagagaagctggctttcttaagccta

SEQ ID NO: 614794 - DNA, 258 bp, Homo sapiens
cacgaggggcggtgcaaggcggcaaggggattcgtggcgacggttgttgcatggacagcaggatcattggtgctgtcaacgcggccgtcggtttacatgggagacccgtggtcggagctaatagaatctgtccctccacctggtcctgaggaatctgattcaacaacgggtgaaaatgacgacgacattcactttgttagtgcatgaccattactacctgttcttgaatacattgatctggtcagcagtgatggatga

SEQ ID NO: 614795 - DNA, 932 bp, Homo sapiens
  misc_feature (380)..(380): n is a, c, g, or t
tagcgaaggatcgatagtccatcgacaattcctgatatcagtacctcgcataatatcactgtatgcaatgatgttagctagcctagagtagcattagtcaaccgcacgatggtccccgtatgtgcaacacaccttgccttggacgttgagactggtaatcgataggatacaacaagacttcacaaaagctaagttagacacgcattggaaaagtactcgtgacgtactcttcagtacacgaactatctagtgcatgacgttgtcatggaacgcctttgttaacctatagggctacattatgcaacgttcgcaaggtcacgtgcattcaccctagtacacacttgggcactagagtaccgatgttagaatggctcgcaggnaacgagaggaactccgcgtattatgaaatctagaaggtgccaggcgatgacataatcagtccctactctggtcctatgaagactaggagaaactacatgtgtccaacaagggacaaggggggagagtgctgcttgtagtttcgcccataaggtgttcgctaggtcaagtctcgccatgaagtaatggtagtgttgcgcgatagctagaggtagttcactcgttggacaagagttgcattggatgtcgcttccgcatgtgtgctgagggagtacattgaagagcgtatgttcatagccggtttcatgccatgtccttggcctcccaagaacacgtggctctctatgattaggtgaatgagagggtatgggccaccgctagtggtgagaaagtgggagtagtcgcatcttagcatcccagccaaattaataacatcatccattacaaaccattgattggcggtccacttgctttgagtcgtccagccatgagtgactcatgagttggcccgggtccccacccacaacgtgcctttcacgaacacggcatcccgt

SEQ ID NO: 614796 - DNA, 1736 bp, Homo sapiens
gacaaggctctatgcatcctgtcagaacaatggggtcgcagcagcgtcggaccatgacggccgtctgtcgccacgaagcaagatgaccacgggaccacgtgcgcacggagcgattggctaacctggacccacattacgtgtgcaaatcgagcgaaagacaatgcattggtggcatgtagagcacatggcatcggtcgcacaccgacaagcctacctggtacgctctgctcgtcgcttgctacactgcggatgccgcactagacgaggaactatctcacgagcgccctccactcaaactcgctcaatcgttgctccaggaagccacggtgcgtacttgctgctaaccacgttgcattgtggggaatattggacaggccgtagacgaatggccgtgccttaactgaagctaagacgaaacacccaggaacgagaacaccacagatcccacgcttggaggacaatgcccacgcgaccggatagcttggatgaagagatcacatagacgtgcatttcagcgatctcgatcggggtcccagacacgaatcactatcacaagaggagatccacagagggatggatggagaatacctgaggaaatagatacaacaaggacccgaatggatgcatggtggatgattgaatgatgagtgaatgatagatgaatgctggttgagtagatagtagatagatagatgagtaagcgaaagatagaatgccagaaagaagcgacgatcgaatgagaacgagaatgaaagaaaggacatgaaaaaggaaaggcgcagccgagtaggtcgctaagacaggagccacacaacacacgacaggtaggcaacgcagcaagcgcgacgcaacaccgacccgcaacgcaagctcggacccgacaggcgccaagcacaaccacagaaacaagacacgagcaaagcggcacacacacaacacgccaaacacacagccacacgcgcccagacgcgagagaagaaacagaaaaaaccccaagcaagaccagacacagaacgacgagaggacacaacacagcaaacgacgccagcaaagcgactacggcaccgccgacaccacgaacgaggcgcaccaagcaaaaccgagcaccacacagaagcagcaagggctaccaggcagaaacacagaaaaagagagaaacaccccaccaacaaaggagacacagcaacaagacgggcggaggagacggcagaaagacaacacaacggaagaaacccaagaggagcacgcagacaacaagagaaaacaaggacgaacaagcagacaacagaaggaacaaggacgaaccacacacagagacgaaccaaccgaagagggcaccaacaaacacaaacagacagagacacaacaagcgagacacacaagaagagaaagaggagcaaagattgcgcagcgaccgcacacagcgcatacgatcacgccaacgcagtgccggcgcacggcccaagagacaaagcgcacaccaacacacaggaaggccaaagcagccacaacacaagaagagcaacaggaggaagacgagacagcaccgagcagagcgaagaagacacaccgcagacacagaggacgaacgagcgagacgatgcaagagcaagcagacagccaacacacgcaagacacgaagacaacagcaaacacaagagaggcgacgcgccagatgcaggagagacgaagacaaaacgacaagacaaaagaacagacaaagacaagagagagaa

SEQ ID NO: 614797 - DNA, 423 bp, Homo sapiens
  misc_feature (5)..(5): n is a, c, g, or t
  misc_feature (13)..(13): n is a, c, g, or t
  misc_feature (415)..(415): n is a, c, g, or t
acggnaaaacccnaaacactgcattgtagaagagcccagcaaagggattgtgacccaactcagcattccccactgagacctatatggatcaaaacagcaaaactgtttatccatgaaatgcaggatgtgggcaaactaacatctgctcccagctgcccagaaggtttgctgaaggcaatcactcccctggtgcccatgcctcccttagggttatcctactgggacatcctagagcctattcgcagaatgcagtcttgcaagcctgctgtgaatcaaactgctgactgacaatcacccccaccttctcgttatctcttttacctaataaatacagagggctgaaaaagctcagggcccttgttcactagaaacaaggagccccctgaccccttcttccaaatatactcttttgtcnttatcttt

SEQ ID NO: 614798 - DNA, 510 bp, Homo sapiens
  misc_feature (84)..(84): n is a, c, g, or t
aggcaagcttatagtcatatatatccccagacataaagaaaaagacccattttttaggaaatgtttttaataaaagaaaattcnaaaaaaaatttttaaagacccctaaccctttgtgtgctctccattttgctccttccccatagttgcccccatttttgaggtgcactgggaggctccccttctatttggggcttgatgactttctttttgtagctggggctttgatgttccttccagtgtcatttttcatccccataccctgacctggccccctcagtgttgtcaccagatttgatttgtaaccccctgagaggacaaaaaaaaataagtgccctttcccccccttttcctactggtctttttatgcctttttacagttttgttttttttaccctggcccctttcccttgggttttgatgaaaaattgctgactgtagctttggaagtttagcttttagaaccgtaaatgatttcagttttaggaaaataaaacccgttgtttttta

SEQ ID NO: 614799 - DNA, 518 bp, Homo sapiens
gttttttctctttttaattattcttactagaagtttatcaattttattactctttccaaagaacaagcttttggctttgctaattttctctatatttacttgttttaaaaaatgtattggtttctgctcttatctttattatgtttttcttctacttagtattaatttagtttgttcttttcctagcctcttaaggtagaaacttagataattgattttaagccttcctttactatatgggcacttgaaaagctatacatttccctctgaacactaccttcatttgctacaaacatttgctacattcaacaaatatttgaatgtgtgtgttttaattttcattcatcacaaacccgtggtcccagctattcaggggactaatgtgggaggatcacttgagcccaggaggttgaggctgcagcaagccatgattgtgccactacattttggcctgggcaacagagtgagaccctgtctcaaaaaacaacaacaacaacaacaacaacaacaaaaaaaaa

SEQ ID NO: 614800 - DNA, 401 bp, Homo sapiens
gacccgagggcgaggaaaacggccaggcctatgtggtgctgtacaaggccatcgaccaggtgcgccagtgcgtcgacaccatcatcaaggatccgggtagccgcggattctgttccatggctggaactgtgcgcacgtggatgaaatggcgttgcgccgtgtcatttgctgtatcagttccatccgaatgtggagaccaaggagatttccctgaccctctacatccgttcgaatgatctggggttgggcacgccgttcaacctgaccgaagcgcggcactgctgagcctgatcgggcgcttgaccggttatacgccgcgctggttcacctatttcatcggcgatgccatgtgtatgaaaaccacctggacatgctcaacgaacagctgacccgcgagccgt

SEQ ID NO: 614801 - DNA, 848 bp, Homo sapiens
  misc_feature (340)..(340): n is a, c, g, or t
gctcttacagcactacttgcagatgatagcaagtttggattcagtgtaatagatggtagttggtgcactttcttggcacactccaaggaaacacaagagaagtcctgcactagaattcactgtggatctcccgaaagaaaacacggtagaggaggtcacgtcagcccttgcggttgttgcgccgtttaatgatatggaatagagcgacagtaactatgtccggaaagtagcagagactgctgtgcaggctgtgtatgttctggggacaattagtgaatgtggctggtctagtttaagctggatccgctgactttaaaatctgaactaatgtcaatctgantgtgttgtgatcgagaggttaacaagtgcaaaagtttgaaaattagttgatatatccgtatggtggtgaaaatggattcaagcaagctatggagttatctactgaagtcctctccaaggtgaaattcattcaagagaagaaattaataggacgatactttgatgaaatcagccaggacacgggcaagtactgttatggcgttgaagatacactagaggcttaggaaagtgtggagctgtagaaattctagatagtctatgaccaatctggatatagtgagatatgttccttcattgccaaggcacagaagaggagactgttctcgtatcgtaacgtccagagccagagcacggatcaattctcattgtcacagacccatagagaccggacaggatcatgagcttatcgagagcatggcccctgtggaactgggttggtaacagacgtatagtgaaatttggagctacgtttggaaatttgtcccgataatcaccaagaacgggtctca

SEQ ID NO: 614802 - DNA, 181 bp, Homo sapiens
tttgagttcccagagaacggaaagaaaagaggcatgttatactacccagagaaagtagtttgacttcccatttaaacattcccccttgcatcttgatgaacttgatccatcttaggttccagcatagctgtttctcgttcatttttatttctatgttgtgggtactggccagtagtgggga

SEQ ID NO: 614803 - DNA, 108 bp, Homo sapiens
gttggtggtgaccagcgctttctatctaccctggcgctctgcagccagcattctccaaccatttcattgtagtctgttcttttgttgaggcttagtaaggccctccgt

SEQ ID NO: 614804 - DNA, 1642 bp, Homo sapiens
  misc_feature (1)..(1): n is a, c, g, or t
  misc_feature (317)..(317): n is a, c, g, or t
  misc_feature (856)..(856): n is a, c, g, or t
  misc_feature (1071)..(1072): n is a, c, g, or t
  misc_feature (1125)..(1125): n is a, c, g, or t
  misc_feature (1149)..(1149): n is a, c, g, or t
  misc_feature (1151)..(1151): n is a, c, g, or t
nacacatatactctacttgttgtatagtggtgtcacgatatacataccccagtttggttgctagacacacacgatgccgtggtttttgcggtctcacctagttattgataggtcttcggggaggggagtccccaccaacgagggttggttgacacacaaaaaataccgcgagggcttgtttgttaaatacctggctcggcgctcctctgtgttaattttaattactcccggcgttcttcataaaaaggggtatcctgaaaggccccttttgggggttgccccaataattttctcgcctaatagaggggttaacacancaaagaatggggggaactatgctgtctcccctttggggtgattaaaagaaaacatgctccccgctcccccctctgggggaatattttttaataggggaaaaactgtttgtgttgcgcaccgccagttgatgagaggacgtttgttgtgtgtgaaaaaagccgcaggtgataaattatcctccttgggggtacgtttatacctaaggatagacgagaggttgggcccgcccccataaccaagctggcctactagatcctcctcctcccgggcgagtttttaggaagatgtttctcctcttcttgggggggccccttctcccggtgcttgcgcgtggaccccttgggaggaccttgtcgccccaaagagatgggaagaaagatggcttgggagagatattcccaatgtggcacagaaagagtctctcaagaaaaaaaggaaagagacgccccctctcggttggaccattgggggccctcgcgccacacagaggttcccatagggggagagcctccgcgcagagatagagagagcccctctntggggaaatagcgctctttggggagatgcctcttgctcttgcacaacgctttgagagggctctcgagaagcccccccgggcgcgttgagaaacgcacacgagagatctcccccgcacatgggaagaaatttgtgagagaatagaaagcgcctgtcgtgttcttttggggccccctggggagagctctgtggagatgaacaacaatgtgagagttnntgagaggctggctggacaccttcggggaattagagaggagaaggagagaattntttgtgagagagatttccctcggntntccacgagagatgtgccacatgtgagacctctttgggggccacagagatataccacaccacgagagatgtcccgcgcttccacgagtgtcccttcaagaacctcttgaccggtgcccacactaattggtgcctcggtgggtgaacacacccacgggccacaactttcgctggccacaactcttgggtggccactctggtgtttctttctagggttgagagtgagagatgttgtgagtattgcgtaatcacattcgccacgtaattctttgtcgccctcgtggtgagaggctgtaaagcctcacagagttcctctttctataaacaccacgctatgtctaagagagagagccaccaatcctcgttgagctgagaaagtggcacatgccaagataaaatattatttgctgttccttgtttactgctttttttcccccttgtgggctgtcaaattttggtatccagaaatataaccattggaattgccaagtga

SEQ ID NO: 614805 - DNA, 159 bp, Homo sapiens
gcagacgatgacctcaatttttctctgcctgacatccgattagaggagggggccatggaagacgaagagcatgaccaacctgaactggctgcacgagagcaagaacttgctaaagagctttggggactccgtcctgacaggactcccggacagcgggct

SEQ ID NO: 614806 - DNA, 1059 bp, Homo sapiens
  misc_feature (134)..(134): n is a, c, g, or t
  misc_feature (564)..(564): n is a, c, g, or t
  misc_feature (666)..(666): n is a, c, g, or t
gcagcgagagcgcgcggatctcagcgcgggagcagtgcttctgcgggcaggagcccgtggacaagcccacttgctgagctctgaactaggagccaacctcctagtggacttggccaggcttgctctggtctganaccttctggctgtgcaagtcttgggcaaccttggcccttgagggaagggaagctggtccagccaggggaagaaagcgaaggaaacagcccaatcaccagtggaacaacccaagcgtcacaccatgccttccaaaggaacaggatcaacaaaaaggcttgattcttgtggcttttaattctcttcctttctaattggcctttgggagcttccgttgggtggggacaaccggccctttggctttccacccgagttggccacacttctttctcttccaactttggacaccgggtcccaaccgttccgaagggtttcatttattccgcagccggcagaaagccgcggccgctttgtgggaaaacccaatttcgttctcccccccaaaggacaatttgggttggctccccgcttcttgtggagttcccaaccgtntggcagttgggacaatcgtgtggatcgggcacaacggcgggagcgtgggcgcacccaaagagcgctgagtttccacaggggcccagagacgcaccgtcggcnagtgagacaacgccgcactgtttgacgcctgtatggaatgacgccgtgaggaacagacgagttcctctttcctattcgacgtggtgtggggcgcataagttccgtgttacaaaaagccaaaaatgtgggtccgaagttttgaaaggcacgccctttaatatgtttggcaccacattagccttggggcacagcagtggtcgttggggataacattattccagacgcccttacaccagttccaaagagcttccccgttttcccccgttggcccaatatccaatggaaaaggggaagttccacgccgacagaggatacgacgagtataccaggtggaatatcccttggtgggaccatggaccattgggtgtgggggcgcacattctcttagactgg

SEQ ID NO: 614807 - DNA, 943 bp, Homo sapiens
gctgggatactagtgacacagatacagagactatgcaaacatatgttcccaggtgcctggagaactctcttgcatgccagtgtatgacaaaaatactttcatccaagcactttcatattcactttgtaattattgtgaatgtgtagatatgctagtttgccctaatatggtttattaagttggcctccccatctaaactgtaattttctctgagactgagaagatcggttgatatctttatccttttcccattgcccttgcatgattactattcaatcattgctgaattaaacaacactttcctttgtttaggaagatgctggatgctaaacacctgtcttactcaggcttcttattgacatagcaaattctaaacgtgttacatatacatgtgttccttttctgctttaaataaaactgatgggtatttatttctcccattgtgtaatgtagtctgtggaaatagtagccagtgtaggatgcctcagatatatccagctctgcaggcaaagctcagcttttaaagcggcgattcccagttatttgttaaatggatgttaagtcatccctgggttggagtttagacttttattgaaaagctttctactaatcaccagttaatgatgaataaaattcacactttgggcctcttcatggttttatgtccaacacatgctttctcagggagagaattactggaagtcggggtcttccacattaggaagtctgacaaatagggcaatctatttccatatttcagcgcgatttccagaagttgcattatacacgccaagggatgcaaaagccagttagcactatttggaacagaaaggcattctttctcagtaacccattacgtgtggctgtgcctcagtttaaaaacagggaacaccgagggtcttttggggacaccaacccgcggctcttaaacaccaacagcgag

SEQ ID NO: 614808 - DNA, 94 bp, Homo sapiens
gtggaggatcagtactccaggtatggtgcatcaagacatgcaggaacctcttcttaggggtcttaacaagtcacaacatgaagttcaactgcac

SEQ ID NO: 614809 - DNA, 371 bp, Homo sapiens
atatcgcagtacatacctacgagtgacacaatatcataaaatcgctgtgaactgatataacattagccaggtgagttggtgctggtagcagacccagggcgtatgtataataaaaggtagctggaatggtgatcacacagaagatgtttcccatcatggaagcgtcagcatgggtgaatacatataccagcagttggaggaagggcaccaatggtgaagcctgtatgcagtaaaagtccatgggctggcctcccccacccagactgaaacaggaaatataaccactaaggatccttaacaatcttccaagaaggtgcttaaatttccagagtggggattatcaccccaaaatatgttcctctttggcttag

SEQ ID NO: 614810 - DNA, 212 bp, Homo sapiens
tgaaaccctgaaaggaggggacccaccgccagtgaggggtacttcaggtctactcactatccaggagtgagtttgcccaatcgcgaagagctctgtgccaaagctccgcctcctgtgttctacaacaagcctccacagatcgacatcacatgctgggattcagatcccagttccataaccaggaggaggcgctttcacgctgcttcttgttg

SEQ ID NO: 614811 - DNA, 111 bp, Homo sapiens
cagttctaccgaacatttctgtaactgctttagtggctcctcctggggaggagaaacatacaaaaccaaaccctattgctgcgatcaccctcactctttcgattgggttct

SEQ ID NO: 614812 - DNA, 558 bp, Homo sapiens
gctagttcctcagcctcagtgctatgaaggtgacagcgtgaggtgacccatctggcccggcgcgatggctggcaacacggagggtggtcgggtggtcgcttcccgtgcggtacgagatatccaagaaagacctcatttggctcgctgagaggatgaagaccggattttcacacaatctgtatcgggtcgctcattgactgagagtgctgataacgtgtgccgctgagttcgaggtgactgtgctatccgagagcatcagaaggagcatcctgctgaaagggtgcccgatctggatcctgggacgagtatcaaagatccactcggcgtttcgagtgggcccgtggacggcgcgtgtgtctttccgccgagcatgtgacttcctcaataggtgtgagctttcatgaactaaagctcctcagaatggctaaggcccgagtatctggtggtgaacgctggacgatggggggaggctcggggtcacctgcaaggaccgtggagatcttacgccatgatcctcacaagctgctggaagtgctgcctggtggggggccgggccat

SEQ ID NO: 614813 - DNA, 707 bp, Homo sapiens
  misc_feature (501)..(501): n is a, c, g, or t
  misc_feature (539)..(539): n is a, c, g, or t
  misc_feature (670)..(670): n is a, c, g, or t
  misc_feature (693)..(693): n is a, c, g, or t
gcaggaattgcacgagctttttttctttattagtcctgctagcagtgtatcaattttgttgatcctttcataaaaccagctcctggattcattaattttttgaagcgtttttttgttgctatttccttcagttctgctctgattttagttatttcttgccttctgctagcttttgaatgtgtttgctcttgcttttctagttcttttaattgtgatgttagggtgtcaattttggatctttcctgctttcccttgtgggcatttaatgctataaatttccctgtacacactgctttgaatgtgtcccagagattccggtatgttgtgtctttgttctcgttggtttcaaagaacatctttatttctgccttcattttattatgtacccagtagtcattcaggagcaggttgttcagtttccatgtagttgagcagttttgagtgagtttcttaatgccgagttctagtttgattgcactgtggtctgagagacagtttaanttctggtcttttacatttgctgaagagggctttacttncaagtatgtggtctttggaataggtgtggtgtggtgcttgaatgtatatttctgtgatttggtgtggagaagtctgtagatgctattagggtcacttggtgcagggcttgagtcaattccttgtaatcctnggaactttctggctttgatctgnctattggtgcgggg

SEQ ID NO: 614814 - DNA, 204 bp, Homo sapiens
  misc_feature (17)..(17): n is a, c, g, or t
  misc_feature (105)..(105): n is a, c, g, or t
  misc_feature (114)..(114): n is a, c, g, or t
ctgttattaagaaaganaatgaaacagcagcgactacctgggcgaatgagtcagcacgtactatggttgtggttaagggtgagtatttcctgttgttgataccgnttttttcangggtcctttatgtatggtgccactcgtgatgtctttgagactttgaattatcaggaccaacaagatcgtggtttctcgtgtttgtgattt

SEQ ID NO: 614815 - DNA, 473 bp, Homo sapiens
  misc_feature (2)..(2): n is a, c, g, or t
gntcgctggctacggcatctgccaccacgcctggtaattttggtactgtagtagagatggggtttcgccatgtgggccaggctggtctcaaattcctgacctcaggcgatccacccgcctcggccacccaaagtgctggggttataggcgtgagccactgcgcctggtcgacatcctatttttatagatggtttccgatgggtggtaatcttccaaaatgtggatggtgtttcctgtggaatggtataacacctgagtgaacagattaatgcagtaagttaatcttgatgggatcctggactggaagagatgcaatatttggggtaaattaggggaaattttagtatagactaatatattcaggggtcagtgatctttttctgaaagagccagataataaatacttgggattttgcagaccttatggtcttggatttatctactgacctgttacagcgacagggagggggtac

SEQ ID NO: 614816 - DNA, 152 bp, Homo sapiens
gcggaggcgttcagctgcttcaagatgaagctgaacatcttctttccagccacttgctgccagaaacttatttaagttgacgatgaacgcgaaacttcgtactttctattaaaagcgctattgcccaaaaagttcctctctcaaagctctct

SEQ ID NO: 614817 - DNA, 1411 bp, Homo sapiens
caaaccttcgtgcccggcccgtcctcgcccccgcctccgtcaccgactcggcccgcagagcttgcccactctccacccgcagacatgtccgagtccaagagcgagcccgagatatgcatacgtaaattcgccgaacatgggacgcctacggcacgaacatgggactaacagacgccctgaggacagactgccaatacgcacagaccaagcagcggataccgagcatatgcggacaagtactaggacatagcagagccaggacgcacgatcataagaaagtaccatacatacccagtaggacaatggcataggcaatcatacaagcacaacaacgagcctagagtggaggcaagtcctacatacgcacaaaaacaccaaggaaatgacgcgacatcgaggcacatctaacacacagaagcatatcgctgcacaaagcgtagagacaagccaagggactaggaaagcacgatagaggacctacgatgcccgagccatagagcaaaggaccaaggcataatagcacaatacaggaaattcagaagccagaggacctcctatgagcagataagaaagggacacaaacgaggaacacaacagcagagaccccacgaacctaacataccggtaaggcgcaaataagaaacccatagaaataccagacaagtccgataacagacggaaaggcggtagcaacggcgccaaactacacagggagcatccaactcaggagcgcgaccaaacaaatccatagcgtcgcgagcaacaaaggttaaggaacgcccgatcttatcgcggaggaacccacaaagcaaggacacagacgtagcagcgtatgtgacgtgttagagcacgagagccaaacatcaacaatcccttcgattatccacccggcaaccccaggacgaaaggcacgatggacaaacaaagttacgcgaacaaggtgaaactcaggacgatccccccgaggagaaaaatacgacacaacggaacaataagcagaaccacagacactaaaggagacaaaaaaaacatagagaaccacaaagaacatgcgcctcagaaaaaacacgcgacagaagacgacaacaacaaaaaaaagacaacaagacagatccacaaagcaaaaaaacaacaaaaaaaaccaaagacgcaaaacaacgcgaagtatgggacaggtagtaagagacgatagccagcacggcgggtagaggccaacatgcaaagaagagaaggaaagagaacgaggaagagcaagtggtaagaatagaaggagaagagaggaacgagagagaatcaaataggggcgattaacggagttgggggaagccacgaagggagaacagaagcaccgcgaggctaaaaagagcgagaaggaggatacacgaggggcaagacaagggcgagagcgcga

SEQ ID NO: 614818 - DNA, 669 bp, Homo sapiens
  misc_feature (571)..(571): n is a, c, g, or t
ataaggtcgactctgattcacagttttgtatgaagatggtttgacgtagacttttgtattgtccctgccgcagcgaattgtgggagaatggaaaccgcctgcacatagcggcagacttgctaaggccccagctagctggcctcgggctgggcgggtgcgaattccacctgagaacaagtgccgcagaccgatgtcggaaggacattggacttttatttttgcatttaatcgacaagaatgtaaaggggacagctcaggcttgttttggagcctgttgactttgtatatatggctgtgagatagttttgtaaatgaagacttcatgatcaaccaggacgaagctgagaaggaaaacaccaaatgctctggttattagaggtcaataagcaacgctctgatacacataggcggttgagatgcacaaagttctttcgattgctaaaccctggagaaacatatgcctcagcctagacgagctgtcttcaattttatggacttaagacccgacagtatgagcgatctctgcgctcttataaggcgggcatgcttgctttggactgtgatgtacagngcaaactcgagtgactgtaaatagcctggcgtgttaaacgctttgagggatgcagagggtattatgaagagacccttaatccatgggctctgatcttg

SEQ ID NO: 614819 - DNA, 101 bp, Homo sapiens
attcccaccgggagctgcccttgacaacgatagctgaaaaaaactctgtattcccaccgggatctgcattcccaccgggacctgtcacccaccgggacctg

SEQ ID NO: 614820 - DNA, 982 bp, Homo sapiens
accttcggctacgtacgaggccctgtggttcacgacgttgacatgccggacatccgcctccgccatgtcgtgtcctgcagcagccagtgactcgactcactgtgcagaaaatcttctcaaggcagacacttacctgaaaatgtgcgggcagccaaggcaggcgagaagaccatctctgtggtcctacagttggagaaggagtgagcagatacacatgtgtgtgacatttgtggaatgatgtgctcagactttctgtggagtgtgcttggttgtgggcagttcagcatggatgcgctgctggtggagcaagactatagagtgtccttcattggtcaccatcatactattcatgtaccccatatccgaggagccgacagatggctcaaacacccaaacactgctgattctgcagttgtatatgtggcactgacaaatgcttggtcccgagagccaagcctgacagaagaaaagcagcctatgtgaccatgaggtcaaaaaattatgttaatgacagccatgcccctaacatagcaaagtgaacatcacaccatatatgagaattgagttatattgtaccagggttatacaataatgccccagcccaatgaacaacaagattgacggcagaagagcccagatacccagaaagtgttgacacgatgacacacagcttgggccaagataccagatgctgaagggaggaagggattgagatgcgccaaaaatcatcattgaagtggatggggggagatcaatattatcgttacaagcccgagaaatccaaacaaaatgaacaatcccccaagtaaacaagacatgatgaacactaggaaggacacataagctaaatacatcatggtagcacttacaaggaatacatagtagattgccacatcaaacacacatccaagatatcaaggggcatagcgagaactacaaaccacaggagattccaaagagaacagtttggttttggcagaca

SEQ ID NO: 614821 - DNA, 902 bp, Homo sapiens
  misc_feature (33)..(33): n is a, c, g, or t
  misc_feature (41)..(41): n is a, c, g, or t
ccgggatcggctgagccgggttggggcccgggntgggccgnccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaaggtaataataaacatcagacatagtaacc

SEQ ID NO: 614822 - DNA, 1038 bp, Homo sapiens
  misc_feature (33)..(33): n is a, c, g, or t
  misc_feature (41)..(41): n is a, c, g, or t
  misc_feature (1036)..(1036): n is a, c, g, or t
ccgggatcggctgagccgggttggggcccgggntgggccgnccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaaggacattaagaagacatacgcacacactccccattccagtgaagtttaataatagccaatcaaaggcgtatgtggtagacttcagtacttgtacctcaggaagttctaaggaggtttgtggtggaccagagtttcacatgttagtgagaatttgtgtttctgtccttgagaaatggaaaagatacagactagatgaatgaaatgcccaaatttcatcttttataaaagctcaggatggatattgagatattatagataactagcagactgttagaagctcttatcattacaggcatgatggctcgcgcctgtaatctcaacactttggaaggctgaggcaggagaatggcatgaacccgggaggtggaggttgcagtgagcccagatcacgccactgcactccagcctggcgacagagtaagactccgtctcaatgaaagagaattggctggatgtggtggtgtgcgcctgtggtcctagctgccttgtagtcctagctacttgggngg

SEQ ID NO: 614823 - DNA, 3178 bp, Homo sapiens
  misc_feature (33)..(33): n is a, c, g, or t
  misc_feature (41)..(41): n is a, c, g, or t
  misc_feature (958)..(958): n is a, c, g, or t
  misc_feature (2665)..(2665): n is a, c, g, or t
  misc_feature (2690)..(2690): n is a, c, g, or t
  misc_feature (2695)..(2695): n is a, c, g, or t
  misc_feature (2705)..(2705): n is a, c, g, or t
  misc_feature (2730)..(2730): n is a, c, g, or t
  misc_feature (2746)..(2747): n is a, c, g, or t
  misc_feature (2755)..(2755): n is a, c, g, or t
  misc_feature (2770)..(2770): n is a, c, g, or t
  misc_feature (2772)..(2772): n is a, c, g, or t
  misc_feature (2774)..(2774): n is a, c, g, or t
  misc_feature (2777)..(2777): n is a, c, g, or t
ccgggatcggctgagccgggttggggcccgggntgggccgnccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccangtttggagagtgctgcttccagacaggtgatgtgaaattaaccatgggaactgggacattttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggtttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataacactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgaactagaaagaatattgatttttaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtatttnattgttcctggtcttttgatgttgntcagnctactatccntggagatgtgtggggacagctgatngaaggaggagaggtgnntatctcangattgcccttaccantnancanagatccacagggagcaacaaggacagtttcacatgcttagactttcttggaagaaacagtgaggaggagtaagtcgtgagtagtgtcaagctggatgtagaatcgtccttagtgcaggtggacccaacattccaaaatggttttcacttttaatttgcccatcccctagattgggttaggttccattcgaataggcaggcataaggatttattctctctggcaggatggccataaatcctttattttgaaacagctattagtactacgagtaccaagggaggatataacaatggctgcggcattatgcttggacacgttgctgcgcaatagtgactgaggcagaaacaaataaatatcgggggtcatagtaactcatggcaacactgaaacagtaactcgc

SEQ ID NO: 614824 - DNA, 728 bp, Homo sapiens
gctgggaaggggacccacccgagggtcagccaccatgccccctcactactagcggccaccccggcagcggcggcatgcatgcatgcagcgacgcatgctggcgacagctcagagcagggagtgccgcgccaccttgcgggccggccggagcgggcagacccatgtgccccctccccagggcacccgcgttcatgcaatgtctggtggcctgggacccagcatgtctccaccctgaccgccgactgtcgtcttgactttatatccatggaaggctggccaacttcctacttacgaggtcggaacctgcatttggcctgacttgcggtaccggggcgagcaagcgtgctgggcccacactgacgggcatctcacacctacagactatgccacagcaaaccagcgagcaagcgaaggcaacacacacacacccacctcacaagaagtcggtggggaccgacagcaacatcgcaagggaaaagacaaaaagtcatgtgaggtagagcgagaagtatagaacgacagaaacaaggaaccgagcataacacaataagcgtagctagcaaagaaatacagacgcgcagagcgcaaccagagaaagaagccacccataggacaggacacaaggactaagcaaacgagatcaaacacggcggaaccacaacccaacgtcaagcagcggaacaaagggaagacagagaggacaatagaaagagcaacaagtaatacaa

SEQ ID NO: 614825 - DNA, 486 bp, Homo sapiens
ctagagatccctggcaggctctctacctgaacatctcactaaatggtaccggtcttcttctcggtttaaatcatgttctgggttcagcaggggagatctggcagtcacaaaatagagaaggaaataaccctatgcctggatgggtttcaccttcccaccagttaggatcacggccatcaagaacggtaataatttctccagcttaaaaagtaagttcatggtcttcagcagcttcaaagtcatatatagcacgaactttccggccttcaggtggggggtaagtaaagagacgggatgtgctgggatacaaaggggaaggggtggtggactggtgccttggttcctggagagacaattcaggggctagaaaacaaggagtttttaaagacccaaaaggttattatatccaacagtctgaagaagtagaaaaagacttcaagataaagggtatccttccttcaatagtatagttagaaactagaacat

SEQ ID NO: 614826 - DNA, 559 bp, Homo sapiens
aatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacaggtgcgagactccatctcaaaaaaaaaaaaaaaaattccaaattctttcagctggggctgcggggggcctcatgtgcctgtggtaattcctatagcactttgtgggaggcttgaaggcggggcagattcacttggcgaggttaggggttcaaaaccagccggtgaccaacattagttaaaacccgggtcccttacaaaaattaaaaaaattaaaaaaaattaagccagggtggtggagggtgtgggcacctgggtgatctctcgaggcttaacgtgtgggaggagggcgtggaggcccgagggagaaaatctcctctgtgtgagaaccttagagggagggccgagagaggtgtgtgcccgagtggggagcccacagagacttgggggtcgccaagcccgtggggcggaacagaggg

SEQ ID NO: 614827 - DNA, 3124 bp, Homo sapiens
  misc_feature (33)..(33): n is a, c, g, or t
  misc_feature (41)..(41): n is a, c, g, or t
  misc_feature (958)..(958): n is a, c, g, or t
  misc_feature (2611)..(2611): n is a, c, g, or t
  misc_feature (2636)..(2636): n is a, c, g, or t
  misc_feature (2641)..(2641): n is a, c, g, or t
  misc_feature (2651)..(2651): n is a, c, g, or t
  misc_feature (2676)..(2676): n is a, c, g, or t
  misc_feature (2692)..(2693): n is a, c, g, or t
  misc_feature (2701)..(2701): n is a, c, g, or t
  misc_feature (2716)..(2716): n is a, c, g, or t
  misc_feature (2718)..(2718): n is a, c, g, or t
  misc_feature (2720)..(2720): n is a, c, g, or t
  misc_feature (2723)..(2723): n is a, c, g, or t
ccgggatcggctgagccgggttggggcccgggntgggccgnccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccangtttggagagtgctgcttccagacaggtgatgtgaaattaaccatgggaactgggacattttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggtttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataacactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgaactagaaagaatattgatttttaagaaacagaaaaatactacttattttccttctcaaataacgtttctttcatcttgttctttatctttctttgttatttagatgcttgtataaatgtcttttgtttttattaagtgcctaattgacagagcttaatttgaagaagtgccctaatttattgaccacttaagaattgcctttattggggtatttnattgttcctggtcttttgatgttgntcagnctactatccntggagatgtgtggggacagctgatngaaggaggagaggtgnntatctcangattgcccttaccantnancanagatccacagggagcaacaaggacagtttcacatgcttagactttcttggaagaaacagtgaggaggagtaagtcgtgagtagtgtcaagctggatgtagaatcgtccttagtgcaggtggacccaacattccaaaatggttttcacttttaatttgcccatcccctagattgggttaggttccattcgaataggcaggcataaggatttattctctctggcaggatggccataaatcctttattttgaaacagctattagtactacgagtaccaagggaggatataacaatggctgcggcattatgcttggacacgttgctgcgcaatagtgactgaggcagaaacaaataaatatcgggggtcatagtaactcatggcaacactgaaacagtaactcgc

SEQ ID NO: 614828 - DNA, 349 bp, Homo sapiens
gagacgaagtcttgctctattgtgcaggctggagtgagccgagatcgcgccactgcagtccagactggggggcagagcaagactccgtctcaaagaaaaaaaaaaaaaagagatgctcttctacccctttgatgagacgtcgagctgtatatgaactcagcctgggcaacagagcgagactccatcttaatttaaaaaattagccaggcatggtggcatgggcctgtagtcccagctactcaggaggctgagacaggagaatcacttgaacctgggaggcagaggttgcagtgagctgagattgcaccactgcactgcagcctgggtgacagagcaagactccatctca

SEQ ID NO: 614829 - DNA, 1701 bp, Homo sapiens
  misc_feature (33)..(33): n is a, c, g, or t
  misc_feature (41)..(41): n is a, c, g, or t
  misc_feature (958)..(958): n is a, c, g, or t
ccgggatcggctgagccgggttggggcccgggntgggccgnccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccangtttggagagtgctgcttccagacaggtgatgtgaaattaaccatgggaactgggacattttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttggtatgtgtgaaatttataagaatgagagttttcttgcaaactcttccttacagatagcatttctcctctcaaattacaaaattctagagagtctggaaagccttggcgtccattaaactccatacacatatgcatattactc

SEQ ID NO: 614830 - DNA, 194 bp, Homo sapiens
atctattctcaagttggatgtcgataggggtgccataaggagctccggggcgaagggccaggtgaggtgggtaggggtcgtagggtagcgaggtggtgggtacaagtcaggcccatattggaggcctggtaaggtggacctaagtctgggccgtactcgtaagggggagtccaaaagccacctggtcgcagggg

SEQ ID NO: 614831 - DNA, 339 bp, Homo sapiens
  misc_feature (62)..(62): n is a, c, g, or t
  misc_feature (67)..(67): n is a, c, g, or t
cccagcatggccccaaccatggtgaaaaccccccatctgtacctaaaaatacaaaaatttanccccngtgtggtggtcctgtgccctgtacctcctcagatactcgggaggctgaggcgggagaattgcttgaacttgggaggtagaggttggagtgagccaagatcatgcgatcgcactgcagcctaggtgacaagagtgagactttgtctcagaaaaaaaaaaaaaaggaaggaaggaagaaagaaagaaagaaagattggctgataccaggcaggaggatctctcaagcccaggagttcaagaccagcctgggcaacatagtgagactttaaaaac

SEQ ID NO: 614832 - DNA, 1031 bp, Homo sapiens
aggtctcctgacctcctcacgggtcttcgccggcgctctcctggctcgcttctgccccagctcggtatcgccggggggggcagcagcagtgcgattgcagaattggtggcacctctgtctagcagatggattaccggaaccatctccagacatcgagggatgagactcaaaggcgtggacgtgtcgatcgcccttgactagcacggcgagtaggccccttgtgagtgagtagtgcgtggagagatgacctgtgaggaccaaggcaggatcgtatgcttcgctctccctggtagaagtatgagtgaccaacataccggtgcacactcatgcgtcaacagaaagcaaagacggtgcgtcatgcaaactagaccaagattgaaggctctattccactagatgatggaagcaggccagttgatggactttagaaacatgaaaagcctagttagcttccttgcaccctatggactgactgggggggtactccactctgcataggtccaaacacacattagcacccatggtgagtgcgctggagtagaacggggccgcgattactacagggttactcgcgactgaatgccttgaagaagataacttggccttaccagggaaatagctaaaataagactagagctgacatgacgttgtacccacttttggagaccagactgaccaagtgggcgaacctataccagactgatccttagggatgtaacaaggatggagaccttggcgggaatagggcttacgctccggggcgacaggggagacttcacaatggcaaggaggacaggacccctgcaaggcatgtacggatgagcctgccacattagatggccccgggggccggggcagcaaaacaccagagcaggacgatgagccagaggagagaaccgcgacgaacgaaccacgagagcaggaagacgaacaaggccaacacatgacgaaggatacggacaagaagagccgaaaaaacgggacaaacacaaaaaaacacgagaccagaaacacagcacgcaatacatcgg

SEQ ID NO: 614833 - DNA, 320 bp, Homo sapiens
ccttaaatagtttggaaactgctggggcctgaatgtttgggtcccccaaaaattggtatattgaactctcatccctaaggtcaccagtttagggaagcgattaggtcctggggactctgccctcttgcatagaattagggcttttataaaaaaggcccgagggagcttttttgcccctcctgccatgtggggacccagttagaagctcccttttgtgaaccaggaagcccccctccccagaccctgaatttgcgggagccccctttttgggcttcccagcccccagagctgtgagaaataaatgcctgttgtttaagcta

SEQ ID NO: 614834 - DNA, 126 bp, Homo sapiens
ggacctgtccaactaagacactactactctacagtatactgctaaatccaccttcgacccttaagttacataagggctatcgtagtatatctaggaggtagaacaatgtagcccattatcttgcca

SEQ ID NO: 614835 - DNA, 766 bp, Homo sapiens
ggctgtcctccctattcatcccatagtccataacccctatccacttctctctctcgatcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaacagactctcaaactcacacggccactgctctcttaaactttctcgctatcaaagggtatagggtctccccctccaaggcccaactctccatctccatgatgacttacttaggaattcaactttcccctggggaccaggctatgactccatgccagggccagcattagtagaaaatctacccgcagcctcctccagtagcgaagtcctttccttccccgggctagcaggcttctttagagtatggatttccagctttggccctcctagtctcagtcccctctagtgatcgtggcccgatggccctcccgttggtttcctcgtatggcccgttcagcgttacttactcctcccagcttccacgcgttctgctacactggctcctcgtcactgcggtcaggctccgttcgcttcttgggtgttctccccgaccgtg

SEQ ID NO: 614836 - DNA, 866 bp, Homo sapiens
gagctgggtatgggtgtatatccttatgtgtgagtgtgtgttggatactgactgagtacttacatcgtccaaaatgtattagccgtgtctctcaattcataggtaccctgtaattggatcgcatgatttatctattggatagagtaccagacggtccatgtgactacggtgctctggcagaatgatgaagctgctggagatccggcaagtagtacgcttcgatctgcgcagcagtcaagagctggaccgcaaaggaagatatggcagtatatcattccgaacaattgtgggtggagcgaaagtccagtgatgactcatgccttgggtaaccaagtgtgagacgcgaaattcggtgaatggaccacagtgacatggacaagtgcacaccttcatgtggacagaaaagcatttcccatgttccctgagcattcccaagcgtgaccgaacgattccactagattcggaagattttaagccccgtgaaactcaacacgatgcaccgtgaaggctctgcgaactgtgtgtgacccaaacattcaggatacacaacattcatactgaacttgcgtccaaagtgttggacgaacacaagtggcgatggggacgatggatgcgtgtcgtaaggcagcacatcatatgtagggtccaatagtgccaagaacctcggggcgcgttccccagcggtgtgacaagaccgataatcacgcctgtccctccattccctcgcccaacagtgaggcatcgagtaaccacacttggtcaagaagctacatatcagagcggtccacggttcactatgtgggacatacagttactcttagacgcaccacggtaatcaacccattgataggccgagaataaggcct

SEQ ID NO: 614837 - DNA, 1509 bp, Homo sapiens
  misc_feature (714)..(714): n is a, c, g, or t
ccgctgcgtcgagtggtcgtcccttggactgatcactgatgctgcatctgctttcatcgtctcttctccttcttatgatgtgtttattgggtggctctactctcctccgacgatgtgcttctgtgtgctcgcctcataccacaccactggctgctgttttgtgcggggcggcgcaccaccccccccccgtgttgttcctccctggcgacctattttttctgcatgccacgatggttgtccttcttagttcgtggttgttctccttccttgtcgcccctggtggataccccccgcttgctccccgcctcttggtgtggtcttctcctcgctgacgtatcttgtggtgtgctcccttctcctcctgtgggtgcgctcccacctatatgttcttctccccgcttcgtgttggaatatcttcggccgcggctcgctcctataataatctctcttggggtgactctcatccttggtgtcccaccaccaccctttgtcctcaacagcacccgaaatagttggggggggtatatctcctccaccacgctcccgcgggtggtttttttttcgttcatgatggtttcttcctgggggccccctcttccttaattttggcgtgcccccccccggccgcacaaagggcgtttttatatagggcgcggggcttaattatagcgtctatattgttggcgccgggtaacacacccccctgtttgtgtngggcccccaatacccttatacattgggcgcccgagcagtaccacacacacagattagtgaattttgtcgcacacaggcgccctatatataatgtgctgtttgttgttgtgtctgttttctgctttgtgtgtgttatctttgtttgttttttgggcctctgagacttctcacgcgagatttcttaagagacactcgggagacacgcgctgtaaagagggttgacacacaccacagctctcgcgcttttggagagcgcgcagagtcactctcccccccacaaggtttcaccacacatggtggtcccgcagaggacacttgtgtgatgtggcaccacatctgtgttggttcttgtttaagatatagtgcacattctccacaatattgagagagatgccacttttgtttacacacggagaattccccgctgccactctctataaaagccccccccaccttttcttcaaaggaggaatatggcccacgtctctttctccacaagtcacacacacacacaggggagaggtgaatatcgcccttgcttttctgtgtaaaattaatgtaaatcgcgcacaaatttttttaattttcgcccctaaaactctttttaatttgttgttaattttgaaatgagtgaggccttcgtgcccccccttcccccctttttgtccccccaacttgagagagatgtatatgagaaggcttattggttctcccctgggagtgggtggaggcccacccggggttaccctgtacactgacttgagacccagttgaattaaagtgccacacccttta

SEQ ID NO: 614838 - DNA, 411 bp, Homo sapiens
ggtagcatcgataaacctacatatgctacaaagtggacgatacgacatgggatcatatcgacggctcgggatcttataggaaaggttcatggagcacgtggtacatttaaatatcttcgagctgaacctgaggaccattattatttacatcggggtcactatctccttcctgctgtactcagtgaccagacagcaactcccactcaatacaccagaacaacagagcgtatcttgcagacaaattatgtttgaatcatttaacgtaccaggactctacattgcagttcaggcagtgctggcctatggaggacatctaggacatctcgacaagtgggtgcacgtacgtaaacggggataggcattgacagcggaaatggagtcacccatataatcccagtgaaggttatgtaa

SEQ ID NO: 614839 - DNA, 242 bp, Homo sapiens
agctgtggctgggctgggagacagtcacccttgaggttgaactgcaactgtccagtagtttgaccttgtccttgaattactactgtcaaaccttgattgccaccgtgtgcctgtgtaaactaagtaagttgagccatggtgagcttcacttgtccttggatgggggcgaggttggttgtgattgctgaagacgtgtatattttgaatttggactgttgctgaatgttaagctttatcttgcc

SEQ ID NO: 614840 - DNA, 998 bp, Homo sapiens
aagggctgcgcccacctccttcctgcctcggaaagcccgggcctgagggcaggcccaaccgcggaggagcaggagagggcggagtgcggggggccatgcccttgggtccgtccctggtggcgcccttccttttgggagacctgtcctgggctggtgctgggaaccggccggccttcttgctccgaacctgggcaccggatctgtgggggccgcctgtcaaagatatgcgcttcgagagagccagcataccttgtggggccggcagctttgttggcttggcgcctgttgggcccttggcctccttggcgcttgcagttcttcaagcttgggcatctgctggcgcgcttgacacctgctcggccctgggaagggggtaccgcaagccccccgagagccgggaagacaggggcggcgagcgtgacaaccctccggtgcaagcgggggataccgctgggacccaggggggcggagcaaggcacgctggggggaacagggggccatcgctggcgtggtggccagcaaggaagggagagcctacgtgaagtgggaatgtggacccaaagcgcccggatatcgcatgggaccggaacattacagcatttgcgggcggctcctcgaaaacgcgtcctggggcaccgggaccccaagaaggctacacgctgggggcaggggccaacaattcgcagaccaagtgggacgggctgaagtatataccaggtaaaacggggcccacctgtggtcaccacaggggtggcctatacctcctaaaccacaggggttgggactcgtggcacatcccgtcctgggacttcgcgtgggagcctgggcgcaactacacgcggggcttgggaacatgcataccctacaaagccgcacgggccagggccccccggaccacttcgtgggacctgctgtggtgggcggacctcggagggccggtctcagccctcccaataggcacgccagagcgggagaaggccgtcgtaggcaatacgcgc

SEQ ID NO: 614841 - DNA, 870 bp, Homo sapiens
gcaacttgtccggagccctggtagtggcccgggttttccccgggagtcaatctcgccgggtggggggggcccacaccgcacagggttgtgggccgcatctccgggggggccactccctcagagggccccttggtggggtcacttttgtggggagggcctgggtgtttcactcccctgagtcgccgctgggaagggttgcccccccgccgccccgccacccgtgggtggggggcaccatttttgtctcccccccccctgttccccttatgggggggatataatcatgcgccgcgtggtgttctctctgtggagactggttgttcgccgtggagcagcgttggtgctcgcctcttttatgatgttgggtggaggagaggccccacccgttctttcttcttgaagaggaggggtgctattttcttccggggggggccagcaagcgtcgaccactggtcccccgggctgcttgtgtttgttttgttccccacggctgttgaagatgtggtgggcacaccaccccctttcttggtggatgtagagagcacaagcattgttgtctgccccctcccctgttcggcgctttgatgagcccccgcagctgtgtttttcccgcaggagaccccaggaggatggttgtgttgttgccgagtcggcgatattgttgaagaggggggtggggcaccacaccacccccccccagctgatcccccacggacgctcttttccccccgagcgctgctgggtcctccccacccgtgttttttttttttcaaaaagagggggggggggaggtttcccctttttttttcattttttggggcccggggggatattttttttttcccttttaaattagagaacccggggtta

SEQ ID NO: 614842 - DNA, 779 bp, Homo sapiens
agcgggaggctgccccgcggagccgccggtatgagcgcccctcggcaccccgtgttcccaggcccggcctttctgacaatgagctaggacttcgggctccttgacggatattcagttttgtagtgtctgaatatcctctcacctatgttcatgcataaagtaccacttcttaattgattatcctcagcaagacaggtgtgagagggttgctgctgtatctgcaatcagtggtgcagacataccagtccccagtgagggtgtccaaagtacccctttgaattagttatggctgcctatgaaacggaggttccctacagtgtcctttgattccgatgctcgtgggcagtgacacgtgtgaatgaattcaatgagccgaagatggggctattctgtgtcacttgacaatggcgctgcaagttgcatgtaggatgcacccatgactggctgaacgaagacttgcaccggacgttgaccttatgtcctatttagtccagcacccaactcagctgaagttctcgggaacgtacttagcaccattcgcgggcttattcatgaagacgttgttccaatcgggtcatcattaatgagcattgcttgctacaccgcttcagacctgcaaaatgaggattgggccctgtttagaaccatgtctgcaatgtttagactcttacctcttccgttggatttgaacagttactgtggaacaattgccatgcagcaattatccagaacctttacacactgaagggactctctcttctacttcgccacttagacga

SEQ ID NO: 614843 - DNA, 732 bp, Homo sapiens
  misc_feature (31)..(31): n is a, c, g, or t
  misc_feature (728)..(728): n is a, c, g, or t
tcggccattatggccggggccccgcatctgntccccgagggtgagggcgcctccaataaaccccatcatcactgcatgaaaactcttctgtgctaactgtgcagatgctagctatggactgcaaaaccaagaattcacctccttattctaaatcgacaaacaactgtaaggctatttcccaattgaaatgttcttgacagggggaaacacccatctatgaaaaaatttgaaatgacggatgactggattatccaatgagaacgataacagggcatgtcgccagatggaaatacgagcctatgtgacaaaaactgtggaaatcatcgatgggaacatatcctctcaaggcctcttctatggaaatatgactttaaatttctaaatacataagccaggatgatatactcagactatcttatgattctaaggctctcataagaaaagtgcattgaatacagaaccggcattccattatatcttgacctcacgccaggcttaacggtgattacctgtaatcactgacggattacatttttctgcctggagctgcattaatgtcaatacaactttgatttgacaacaaatgaatgtgtaattgggtacatgcttacaataaagagtcggcacccaaaagttgccggccaaggccctagaattataaactcaacaatcttttgaaaaggggccgaatttacgctatattggcccctttggcgcctaatagagtngtta

SEQ ID NO: 614844 - DNA, 275 bp, Homo sapiens
gattgagaacaataatgaacagttattgtatgaacaattgttagagacagctaatcacaaacaacctgcgggcacaaatgacctcattccacacgtagcacccttcagcaggaccctataaaactttcctccagaccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 614845 - DNA, 442 bp, Homo sapiens
  misc_feature (23)..(23): n is a, c, g, or t
  misc_feature (67)..(67): n is a, c, g, or t
  misc_feature (97)..(97): n is a, c, g, or t
  misc_feature (103)..(103): n is a, c, g, or t
  misc_feature (105)..(106): n is a, c, g, or t
  misc_feature (109)..(109): n is a, c, g, or t
  misc_feature (112)..(112): n is a, c, g, or t
  misc_feature (121)..(121): n is a, c, g, or t
  misc_feature (129)..(129): n is a, c, g, or t
  misc_feature (135)..(135): n is a, c, g, or t
  misc_feature (144)..(144): n is a, c, g, or t
  misc_feature (157)..(157): n is a, c, g, or t
  misc_feature (189)..(189): n is a, c, g, or t
  misc_feature (191)..(191): n is a, c, g, or t
  misc_feature (248)..(248): n is a, c, g, or t
  misc_feature (251)..(251): n is a, c, g, or t
  misc_feature (261)..(261): n is a, c, g, or t
  misc_feature (266)..(266): n is a, c, g, or t
  misc_feature (268)..(268): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (329)..(330): n is a, c, g, or t
  misc_feature (366)..(367): n is a, c, g, or t
  misc_feature (372)..(372): n is a, c, g, or t
  misc_feature (375)..(375): n is a, c, g, or t
  misc_feature (417)..(417): n is a, c, g, or t
ggcctgcagctagctctcctctncacctgcaccgccgggatgcttgatggtgtcgtaagcgccggtnatgagcgcgatgaagaggctgagcaccatntagatnannatnctnatgaagganttaaggtngatctnggagatganccacaccaggctnctgcggccctgctgcgccttcacatgataggntnccagcacgatccagcctacagaagcagtagcccaggtagatgacatctatgcagtantanaaaaagcatnatcgntngagtangntcanccgcagtgtggcgatgaggatattttagttgtggaagaaggtcaggtannggatcaccccacgcacaccagcagcgtcgaggtgcnnaggangangctgcagacgtcgtagctcgccaagttcttggcctcgatgcngatcttcatgatggtgcccgacatg

SEQ ID NO: 614846 - DNA, 852 bp, Homo sapiens
aaccacaaagacatatggaacactatacctataattcggcgcatgagctggagtcctaggcacagctctaagcctccttattcgagccgagctagggccagccaggcaaccttctaggtaacgcccacactactacaacgtacatccgtcacagcccatgcataccgctcactaatactatcttcatagtaatacccatcataatcggaggctttggcaactgactagttcccctaataatcggtgcccccgacactaggccgctaccccccgcataaacaacataaagcttctgactctatacccccctactctcctactccctagctcgcatactgcctatagtggcaggccggcacccagcacaccaggctccgaaccacgtcttaccctaccctatagcagggaactactcccaccctggagcctccgtagacctaaacatcttctcctaaacaccttagcaggtatctcctctatcttaggggccatcaatttcatcacaacaattatcaatatacaaccccctgccataatccactaccaacacgcccctcttcgtctgatccgtcctactctctgtcgtcctacttctcctcactctctccccgctcctagctgctggcctccctatactactctttgtatcgcctctcgctccaccttcttcgcctcccgtcggcaggacgtcgatccctttctttctctcttccctacttctgctcctcggcccccctgacgtcctactcttttcctaccagccttcgccctctcccccttctcgccctccccccccgcccccccccctccccttcctcgatactcgccccgctctccggctccacctctccc

SEQ ID NO: 614847 - DNA, 877 bp, Homo sapiens
gggaacgctccgggctaggccctcacggaataggggcttccaggctgcggcgtgggagatcccagcaccaccgtcagcccctctgcctggcacggctgacctacgctcacgtgaaggcagcaaaacccacccagacctctccccagggacaggtactcaccaaggccccgtctcaggacagacccccttgcatgctggaagacggcgcagtatggacacatgtacaggtatgccgttgacacccaccagtggaagtcccatggggcaacacatgttaagggtggtactctcaccccgagtgtagagggatcagacaaaccaaaacaagacaacaatatggggacattgcataggcagtgttggcaacttacaaggttggaatccggaagaccacactgaaacacatcgaccataactcaatgagacacactgaatacatgcacaatgggcgatgcgcacaagggatggcacacatcgagcacatccgagaacacctcacacggagtgaccaaacacaagagagaacacagaatcgtcgaacacaaaacaactttccacctggcacttcatatgagtccatatgagatcccaacagaaaagagcaacgcgatccggctactagccgaccacatacgggatcacaacacacgcgtccttggacggacgaaagtccccacgaccgcacagccaagagcccacaccaacgaagaattggaatcgcgacacgagtacaccgaagcgaaacgaacaccatccatgaatatgggacacacaagaggacacggaggggtcaacagcacccctggacccggcagacaacggcacacatggcacccatcacaatggaccacgacccaaggcacaccacacgacacac

SEQ ID NO: 614848 - DNA, 434 bp, Homo sapiens
ccgaacgcaacccccaaatcatggacgcacctgtggggagcaccacatctgcacctgcggcctgacatctacccactcctcctttttgtacgtaaaacaagattctttgtacgtggtttacgcaactttaaactggaacagccttaatggaagaccaaatggctttttatatgtgtatgtacaaagttttctattaacgctgcccgcctcccttataacctggacgtgagctgtcagagcagaagccactaggccactgcgcgtctgaggctcagaccctgctgaggtaggcttgaggtggccaatgggctgggaccctccatgagagacctggacactagggtcacctgacccgcgcctctgtgacacatgtctccggggggcagcccccatggcaatgtgcataatatgccgtgctggaaccatccatggga

SEQ ID NO: 614849 - DNA, 146 bp, Homo sapiens
accatcgtggtcagtggttacaaaacgactaggaacatgaggttgcagttcgatccctggcttgctcagtgggttaaggatccagcattgccgtgagctgtggtataagttgcagacatggctcagatcccgtgttgctgtggctc

SEQ ID NO: 614850 - DNA, 877 bp, Homo sapiens
catggtggctcacacctgtaatcccagcactttgagaggccgagggaggtggatcacttgaagccaggagtttaagaccagcctggccaatgtggcaaaaccccatctctattaaaactaaaaaaattagccaggcatggtggcagatgcctgtaatcccagctactcggggggctgaggcaggagaatcacttgaacccaggaagcagggttgcagtgagctgagatagcaccactgccctccagcatgggtgaaagagtgcaactctgtctcaataaataaataaataaataaataaataaataaataagcatctctaaatgtttgagtgccaacatgatactcaaaggagatgcacattgtagcatttttgattttggatttagaaggctgaacaggtaagtataaaacaaatattctaaaatttgaaccaattctaaatccaaaatactcctggtcccaagcattttaaataagggatgctcaacctgtaatatcaaatgttgatgaggatgtggagcaactagaactctcatagatgctggtgggactgtaaattgatacactactttaaaaactgggaataggctactaatcctggagtgttagaccctatggacaacaaagatttgtattttcaccgcaagacatctattaactgttcctgccgaatacatttatggtcaaatgggacaaccgtctacaggcaatcaatattgggttttcatccaggaatcgtgcccgttacatggccacttcactaatgcgggggaggggtctccacatatggcttcaagagggcaacatcggcggtcgcttggagttacagcactgtgtaggaggggggggcccacaccagggggggccgggacaacg

SEQ ID NO: 614851 - DNA, 424 bp, Homo sapiens
caacaaagtttggtaagaagaagcagttgtttctctcttttcccccccatttcaaggaggggttaaagatcatggctggccgtgatgtacccatgggctgattttcattttttcagtttcaaagctgagaaattcagctttgttttagttgaatcctcatattggaaagcagccattgaaagttttcttttctatttttgttatgaatggggtatggccccttttggagacttttattgggtaatattctatgtgaaagaaggaaacttgggattaaatgttgtgggaaataaaaatgatgataataataaagtaaaagcggccatgggggcccgccaatccaattgcttgggagaagaaaatttattcaaatcccccgataaaaaattaatttttttttgaataaacaggatgttcccccata

SEQ ID NO: 614852 - DNA, 137 bp, Homo sapiens
gagatagcgcagatcccggaagggggatgtggggcaagagcagggaccaccaggagccaggtacaggccccaagggccccggggcgggaagccagcaacgtgaaaaacccgcgggcgcccgcgcctcgagcgcccca

SEQ ID NO: 614853 - DNA, 217 bp, Homo sapiens
agtgccggagcatgtcatggtaatgcctgtactagcaggcagcatggagaataatttgggacccttgatggtctggtttctgttcttgtgcaaaaggacaatctatatgctaccccttgcatgtatcttcctccaacagataccatttgattttcgaaaacataacacatggttagtcctctacttcatggctggaggaggtatacaggataacaaa

SEQ ID NO: 614854 - DNA, 782 bp, Homo sapiens
  misc_feature (254)..(254): n is a, c, g, or t
caattttggttacgtgttgccccattaaaaaaaaagaaaaattgttattaatagatccccaatcttgggacaaaaaatggggtccatgatggtggtcgcctggttatcccccagtgggtaatcactggagcgttttttaaggccaggatttattacttgatgaaaaggcaatttttctcggtcttgttcacaagcacaagaacatctctggtgggtgccggcctattgcttcttacagcagtgccacaaaagcnggtggtgctttcttaccacaaatgatctggtttggtgtgggggacatggggtccacactacatccccgagtcaatgagggacctctcttgaatttggtaggactatgactggctttgcaactataggtccattattagagtcgcgtatgacgacaaataggggttccctaggtaatggcatagctagcatatgtcatgggttccccgatgtgatcagtatggactatgtgttattttcatcttccacttgttcataagcttgggcttccaggctagttcttagaccaatatttttgcgtggccatgtaaacatcatttagacagccctctatgaatttcagtgtgaaaacaaccttaactttctctttacccttagctgaaatgtttacacagcttatggtgaaatcctttcatgaattgatatctcttacaatggtgatggaggtaacccctcaccaaggttagctttgatctgttgctatctattaaagaccatgtcattttggtcaattaaaataattgtgtgca

SEQ ID NO: 614855 - DNA, 164 bp, Homo sapiens
gaggatcccgtctctcaccaccaggacagacagagctctgctggagcgggtgtccatctgactgcatgttccggtcgcccccagggtacttctgttgctcgactctctagtgggtgattgcgttcccagaatgtatacatcccagggtgggtggaggagcgggg

SEQ ID NO: 614856 - DNA, 875 bp, Homo sapiens
atggcacatgcagcgcaagtaggtctacaagacgctacttcccctatcatagaagagcttatcacctttcatgatcaccgcgccgtcgataatcaatttgtccgttatcttgcctgcctagttcgctgtagtgccctttttcgcgtagttacgtcgacaatcgatagagacgtagacttaaatacttgaaacattcatgcagaacggctcatggaaattagggaatacccggatctagataactattccatcgcctcgcgcgagtcaatctcatagatcgcctcgatcagcccgtgcgcgcatccgcgtagcgcgatccgtgttacgataaacagagcagacggtcaaacgactcgcacctccacattattccatccagaatcaaatgtggccaatcgcgaaagtgggtacgtgaaccgctagcgacgtacaccggatcgtaccggcggaacgtagagtctgtcagatcgtgcctacgatatcttcctcacctttatgtcctaggaacgcatggcgagctagcgaactccgttgatcgttcgaccaattcgtagtacgtacctcccagacttggaagaccgaccgttcgtgatagtagagttatcatcacgaagacggtctgtgcactctatgagactgtccccagcatttatggcttataatacgagatgctaattcccggacgtctaagacgcaaaccactttcaccgctacacgaccgggggtatactacggtcaatgctctgaaatctgtggagcagaccacagtttcatgcccatcgtcctagaattaattcccctaaaaaatcttgaaatagggcccgtatttaccctatagacacccctctacccctctagagttcaaaaacaaacag

SEQ ID NO: 614857 - DNA, 110 bp, Homo sapiens
  misc_feature (33)..(33): n is a, c, g, or t
  misc_feature (69)..(69): n is a, c, g, or t
ccgctgaccagttgcggtccatagtcgctgacnaccatgtcgtcgggttgctggcgatcgtgccgggcnccgtggaatggatcgtcggtgcggaagtgcacgaggggatt

SEQ ID NO: 614858 - DNA, 395 bp, Homo sapiens
gaaaatgttctctcatggttttggaattatcttcattttggcagatacaggcacatgtgctacacacttctcattcttgcacccagggcagacatcactaatcgatcacagccctctttcccactgggaacagatggagcctgtcaatatttctcagcggtcctccaggcagctactactaatcaatcagaattggcatgcaagattaaatgcccttgccattcagggcaataatcacagaaaatgacaatcacacagatgtgagtccctggggtagccaaaattccaaaacctaatataattgcctcttcaaaatgtgattaaatatcctctttccctccatcacaagcaaaaagaataaagtcatgcaaagtaggtttggtttgggaggaaaa

SEQ ID NO: 614859 - DNA, 892 bp, Homo sapiens
gattcctgaagctgacagcattcgggaagatgatgtctcgctccgtggccttagctgtgctcgcgctgactctctctttctgggcctggaggctatccagcgtactccagaagcatttcgaggtttactcacgtcggtccagcgagagaatggaaagtcccatttcctgaattgctatagtgtctgggtttcatccatccgacattgaagttgacttactgaagaatggagagagacttgaagaagtggagcattcgagacttgtcgtttcagcaaggactggatcttctctatactcttgtactacactgaattcacccccagtgaaaaagatgagtatgccatgccgtgtgaaccatgtgactttgtcactagcccaagatcacgttaagtgggcatcgaggacatgtcaagcagcatcatggcaggttcgacagatgccgcattgggcattgggatgaacttccaaattctgcttgcttgctttgttattcattgatatgcttatactacttacactttatgcacaaaatgtatgggttataagtaatgttaacatggacatgatcttctttataattctactttgagtgctgtctccatgtttgatgtatctgagcaggttgctccacaggtagctctaggagggctggcaaacttagaggtggggagcagagaattctcttatccaacatcaacatcttggtccagatttgaaacgtcttcaatctcttgcactcaaagcttgttaagatagttaagcgtgcattagttaacttccaatttacatactctgcttagaatttgggcgcacacattacgcccccttccttgacacgattcttggccactctgtctcctcgcatgaaccatttgcctctagatcccattt

SEQ ID NO: 614860 - DNA, 504 bp, Homo sapiens
acagtgaaatgcttacttacaggctctaaccaatagtgcaaaaaggtattaagtgaacaataggtaagtaaagaaataaaacaacagtaaaaagacaggctatatacagtagcgaggctaaaatagtagagaggctacatacagacaccggttagtcgggctgatcgaggtagtatgtacatgtagatatggttaaaatgactatacatatatgatgaacagagagtagcagtagtgtaaaagaggggttggctggtggtgggtggcgggacacaatgcagatagcccggttagccaatgtgcaggagcactgattggtcggcccaattgaggtagtatgtacatgaatgtatagttaaagtgactatgcatatatgaaaaacagagcgtagcatcagtgtaaaacaaaaggggttggggtgggcacacaatgcaaatagtccaggtagccatttgattacctgttcaggagtcctgtggcttgggggtaaaaactgtcgacgc

SEQ ID NO: 614861 - DNA, 123 bp, Homo sapiens
atgaccccaaagagtcctagatatcctcagcgctattaattgtttatgtttgtgtgttcttgcatgtagaaccatgaaaagtatggtaagtgaaatggtcttggatagatgggatgttccatg

SEQ ID NO: 614862 - DNA, 1644 bp, Homo sapiens
  misc_feature (653)..(653): n is a, c, g, or t
  misc_feature (774)..(774): n is a, c, g, or t
  misc_feature (788)..(788): n is a, c, g, or t
  misc_feature (791)..(791): n is a, c, g, or t
  misc_feature (878)..(878): n is a, c, g, or t
taaaaggggggcaaactttattttattggcctcactggtaaatagagaaatatctggtcctttcttctcgaaccaatatgcccaaagagggttaataacaagaaagttataactttagcctccaattgtggaggattgtgttcactataaaaatttataaacgtctccaccttggggtgtttttttctcaagaactaagtgtggtgaatcaccagcgttagagggcattctcacagtgtgtcataaaaattaaaattctcttacccatatatttttatatgtgtgtaaaaaatgtgtgcgtgacacgcgtgtgtggtgtggtgtctctgtgggcacgcgcgtgtgtgggcgtggtagattatatgtgcgagacccagtatatacacagagtagattctcacacacgctggtggcgctgtggaaagagcctatagagatctctctacagcgtctctcacgaggggagatctcgaggggcgacgagtctcccgagacccgccggtggcgcgtgccccaacaaagagggggggtgggtgggtatcatctcgagagtgctctacccaccctatagagacacccgtgtggcgccaccacttttttatagacacgtgtgcaacccctgtgtggtgtgtggggatcctccccacacgggngctgtgtgtggtgcacacccgatgtgtgttatttcttcaacaccccagcagaaagatttttttcataccacccacattatacaagaccacaacaatgtcgtggcgtttctaacaagaagangagatatcattccngtngaggagcacaccaggaggggcgactattatagacgcgagagcctcctatattctcccccaatatgtcgtggagagtggtctcacctnttcatccacacctcgttgtggttgttgtttctaaaaaaaccattattaatagacgagcacaacacgggtctcccctgtgtggcgtggtggacaacacccggagggggagacaccccgtggttgttccggcaccaaaatgtggtgcggcccccggtggtggtgttgacaacactctcgggggggtggggcacacccagacgagaaggcagcacaaggtggtggcgccgccccgggggagccccaggatggggtggttactccccccgaggggggggccgcggcccaaccgtgtgttagtaaaaacgccccacccccggggttgataaacaaaaggggggccgcaccacttggaatcgccaccgtcctcccctgttggtgatgcaccccacccgccggggtggtggcggcatattttctcgcccggcgcgtgtaaaagaccgcggttgcccgccgcgggggcgaacataacaccactcttaccaaaagagggggggagacgcacatcttcgacggtctgccccaacaaacggggcacaaccatatcttctctaatcttccccgcacgagagagaaaaccaccccggggtggggggcaccccagggcgacagagagacaagggagacggcgcccccccctatctgcggcgccccacagacgggtgagggtgggggagcctcaatcatcaccccagggagaggaggcacatccacccgggagaaactaacgaggagggagatatataaaacaacgaacaacacggcgcgg

SEQ ID NO: 614863 - DNA, 147 bp, Homo sapiens
  misc_feature (31)..(31): n is a, c, g, or t
  misc_feature (92)..(92): n is a, c, g, or t
  misc_feature (109)..(109): n is a, c, g, or t
aaattcgcggccgcgtcgactacggactgangagaagacgacagaaggggggagaccaaggcgggtggatcacgaggtcaggagtttgagancagcctggccaatatgntgaaaccccgtctctactaaaatacattgctgggtgtg

SEQ ID NO: 614864 - DNA, 1161 bp, Homo sapiens
gacgtccgctaggtggcccggtatggagggcccacagtcataccgcgcaaaaggcgcagcaccagtaggagagacgcctagatcgtagctcatgaccaggtgccagggctagtcggtgccgtgcggaggaacgtgcgagggtccgagacctgcagactgtccctgtatccgtcctgctcgcgctcatgcgaacccacgcattcggcgcatcacgtcgagacctctccgcatctgtccaagacgcgccgactgtaccgatcattcgtccggggactggggtgcgtctcgtgagagcgtcaccgtgcgacggtcgcggcgatcgagcgggtcttgacggagagatgggggggcatgatgatgccgctcatcggggggcgccagttgtcacgtttggcgcagacgaagctgtcacgcgcgcgcccggcctggtccatcatcgcaggcgcgcgttgggcagccccagggttggtatgttgcgtctgtccactggccccatgtctgccgtgctcgccgcgcaagaccccggggacaccgcgcgaggggaccggtcccaggggccgcgcacggtgttgcgcggcactcgttggtgactcgactggacctggaggacagcgccattgcgaccgacttctttgcagggactcccgagcgggttcgtcatggctgtcaaaccgcggtggaagaaggcggaatggcaccaggggcagagtggaagcccctgaggccgtggcgcatatccccaggtagttgcgagaggtttcccgaacaatctctctataacctatggcgatatgggtaactgtggtgtcaccattaactgtaccatggcccagatacaaggcgctacaccctacaacccctgatttgtccatggtatcgataggctctcgattagggcacaacacccttgtcgatgggcccggagagagcaaaagcacttgcctggtgttgcccctttcaatgtggggcacccctactccagtcgtaagcgtaccggataggacccaactggaataacaggtatcctggggatccaacctaactgtcgtttgcagaaaaccgttgcatcgtgtgacagccacagtgggacccacggataaagaaattcacaattataaaaccacatgggaggtaaacactagtggataccattacatcaaa

SEQ ID NO: 614865 - DNA, 285 bp, Homo sapiens
  misc_feature (197)..(197): n is a, c, g, or t
gtcaagccagtcttcaggcttgtgggtggggggcaggtcgtgtccgtgggcacacacttctgtctttttttctccccagtgatgtcacatccacttttcagtggcccaacaccccagcatttgtcactgttttattttgttctcacacgtgctcacaccccattcgtcttcccaccgtggtttcacagtgctcaccntattggccacacaagcgcaactaaaggctggctccgtttctcaccacacacaacacacacacacacacacaccccacaacacacacac

SEQ ID NO: 614866 - DNA, 210 bp, Homo sapiens
aacgcgctggaggcctcctgccgagtctgcagacgtgtccctgcacaggaccccccctgtctgtcacacatagtgcccctgacccattccgagggggcctgcgctacataacacccgcgtccagcggaggagatgggcccttgccacggctcgctccgtgtcactgcacaggagccggtggaactgatgtcacgagcgaaccaagcagct

SEQ ID NO: 614867 - DNA, 100 bp, Homo sapiens
cttatgtggaaagcgacgttggaggacgggagagcgagctcagtccaaccctgccgctctgtgggggcatctgcttgagccgtcggcagctccggcaccc

SEQ ID NO: 614868 - DNA, 468 bp, Homo sapiens
gaaatgatctgctgcagtgctctgagccctaggattcatctttctttgcaccgttaggtgggcctgactggcatgtattagcaaactcatcactagacatcgtactacacgacacgtatctacgttgtacgctcacttccactatgtcctatcaataggagctgtatttgccatcataggaggcttcgttcactgattgcccctatgctcaggctacgacctctagaccgaaacctacgccataatccatttcactatcatattcatcggcggtaaatctaacgtttctgtgcccagcaacacgttgtctcgggctatccggaatgccccaactaaatactaccgtatggaccaccataattaccccgatactgccttacactatgcctcatcaccgcaactaaaaatattaaacgacaaactaccacctacctcccgtcaccaagagcccataaaatgtaaaaaagg

SEQ ID NO: 614869 - DNA, 145 bp, Homo sapiens
agttttatgtcagatagactggtgagtggctctcgagtgatgttgggcagatggaccaaatgtggtgtgtctctacagctatcccgttgctgggccagcctggatagacaggaagggagaggtatagcctaaaggtgggtctggc

SEQ ID NO: 614870 - DNA, 122 bp, Homo sapiens
tatattcagtcctcgccgtttacctgatcagtcagtcaaccctcgtccgtgggatcccaggtcattatcagcattacgccaggatatcgctcatcatcagcgcctcctcgcctcgtgcgccc

SEQ ID NO: 614871 - DNA, 724 bp, Homo sapiens
atgagccgtcctggggaggtgtgctcggctctgcaacctcgtgccgagtctctccagaagcacctaggagagctgaatcaccagaagcagctggagtccaatagagatcccagagctcggcacatgagctggagagtggtggtcccgcttcactggccgaacaatcctctcatccatcctctactcctcaaggcacggtcccacgcaagcgaagcactcgcaagcccaagaggtagtaatgtggagtacgatttagtcgcgaggaaactgcatttcatggatggatgcatctagtacaatctcagtactcgcttggtgactggaccgaaacttccgagccgtgttgatcacatcggccgtttggatgagcacacatctgtcgaaacggagagtaggatgtgacgcgaccgtgaggcgcccgtgggccataggcctgcacagtcatgcgaagcaatcgtagtaatccacgtcatgtctaatgtcatcatagaagtctggctagatcccctaggatgactgagtggctacagtagcgacggcatgcacagcaaagcgcctagagcgaagcattctccgttgcagctaaggttatgcaggttcctgtaggatccgaggtcgcaaaagaagatcgcctcattgcgatgagctcgaggcggtccgcacgacaccacataggttgggacctgccacacgaaaatcggttcagtccgctggaccctcggga

SEQ ID NO: 614872 - DNA, 659 bp, Homo sapiens
ggacaattccattaccccaaaatgtaatcaccacaaatccaccctcgctgtgcacctttgtcctcaatccaccctcatcccaacccctggctaccactgatctattatctttccttacagctttgcctttcctagaatgtcatataaatgattcaagctgtatgtagccttttcagtcttgcttcattcacccaacacaatacatgttgaggccgagagtggtggctcacgcctggaatcccagcactttggaaggcagcagttgacagatcacctgaagtcagtaattcaaaaaccagtctggccaacatggcataaccccatctgtactaaaaatacatacattaaccggacatggttgcagactcactataatcccagctgctcggtagactgaggcaggagaatcgcttgaacctctgagacggcagttgcagtgagccatgatcgagccattgccctgcagactgggtgacaagcgtgcaacttcgtctcaaaaagcagtcgccagttaagaaagctatctcgaggaacagccccgtcctccattagtcctatagtgagtcgcatcctgcactgcacgtcgatttactgactgactgacccctgcgggacccagcttcatcgacttgtagtacatccccctttctcagctaggt

SEQ ID NO: 614873 - DNA, 181 bp, Homo sapiens
cagtgatgtcccaatctgtaaaaattacaagttatggtactatgttagccccataatttttttttttcccttattaaaacacttccataatcgggactcctcggtccaggcactgttgcccagcctccaagctccatctccactccagatttttaacagctgcctgcagtagggcgcccaa

SEQ ID NO: 614874 - DNA, 110 bp, Homo sapiens
taaaatttggggttttccccctttctttaacccttttaagggggcaaaaccccctttccccattcaatcccccggttcccccttttgtttctgaaggggggtttaaagcc

SEQ ID NO: 614875 - DNA, 225 bp, Homo sapiens
gctagctgactctagaggatacacatacattgactgatgacaataaggttgattaaaataatcttcgagtagatagagtctattataaatgatagatttgagaacagcttttactactggcaagtgaggagaagtagataaactggaaggatttttttttaatgattaatggtaatttggggggttttttgttgatatttttcttcactcatctaacaaacattt

SEQ ID NO: 614876 - DNA, 306 bp, Homo sapiens
aaactttcagtacatgagactacactccagcctgggcaacagagcgagactccctctgaaaaaacaaaacaaaacaaacaacagagagcagtgaactgagtatccagccagctgcacgaaagagcagcagagtcaaaggaagtggcaggaaaaaattaatgggcaaggcaaaaatgatgaataaaattccaggagcacataagtattacaacccaaggttggtcttaaaatgtccaaattgccagcctctgtatataggtgccacagaaagaggggaggtgagaggagaaggagaggagaaagtgt

SEQ ID NO: 614877 - DNA, 371 bp, Homo sapiens
  misc_feature (11)..(11): n is a, c, g, or t
  misc_feature (44)..(44): n is a, c, g, or t
  misc_feature (51)..(51): n is a, c, g, or t
  misc_feature (99)..(99): n is a, c, g, or t
  misc_feature (104)..(104): n is a, c, g, or t
  misc_feature (112)..(112): n is a, c, g, or t
  misc_feature (118)..(118): n is a, c, g, or t
  misc_feature (143)..(143): n is a, c, g, or t
  misc_feature (320)..(320): n is a, c, g, or t
  misc_feature (338)..(338): n is a, c, g, or t
atttcggcacnaggggctgactaggttttcggaccgcggcgccnggcgaangagagactgcggcgggagggccaggccgtgggagagacgcgggaaagnaaggnttcaaagnctcttnaccaccccgccctaggccgacccgnggacccggcgtctggtcccaggtctccccgctgcgctgcttgaggctcagcatggccagcagagagccctgccccagagcaaggagacgctgctgcagtcctacaacaagcggctgaaggacgacattaagtccatcatggacaacttcaccgagatcatcaagaccgccaagattnaaggacgagacgcaggtntcacgggccactcaagggttgaacaaggacaat

SEQ ID NO: 614878 - DNA, 1300 bp, Homo sapiens
ggcagatggacttcttgcagaagtaccctctcccgctgatccccccgacgaggggaggtgaacgcgggcgacgcctatcgacattgggcttccttcgagtgaggaggacactagaaaggaatcagagttactgggacaggtgagtcaggagctctaccggagacgttccccctcatgcactctcggaagcggtgggcgaggcaggaggtcggctacgatgacttgtcatgtcgatcaccttatcataacgtctgcacgtaccacgacctgagcgtcggtacggctccgctgcatgcacaagcccgcatgaacaatgcagcgtgaggctcgatggatggaaaggactcacggcctctgtggacgaaggaatctggagtccaatggcactgggcgtacattggtccgaatgcactgggggctaagtcacgcgttccgtgagcccgaggtgtggcagtcggcagggttacatgtcgtagcacttgtgacacccccgaagccgtcgcgtcggagttgggcagaggggcgcggatggtggcggagtggctcacacggcaggggagacgcgtgtacgtgcgaaccgagtgcggaagagacgcattcacgagatacgagttgggcaagcgtagcaccgctaggattcaagagggaagacggacacaggatgagcgcatgcgattcgcaatcgagcaggaacatcacggcccgccggatgtggtagaaaagtagccagggatatgcaactcagagtatggccaaggatggccaggtatgtacgactgggagcccctgtgtgaggctctagggatgccatgggtgggcccaggtgaaagggaaaggcattggcggcctgaagcgcgtcccagtagcgccggccggaaggggagtggacccattgtgcacgctcagttggggataggccaaagacggggcgacatgaccccaggaaggcgcagtcgacaatgaaaacgaaaggtcccagcaaggcacacaggacgcccaggtaggcgcagtggcggccagtgaaagacaaagggggcatggccacggaagacagaagcccgaaggtgggacagaggcaggcgaaggcccacagacagggggacatacacgtggacgcgccgaggtgcccaagatgcaccgggccccttagtggaattacgagccaccgccaataaagctcgaaaaaggtgcgagccagaagatcatatcacccataagtatcgaggatacagccgccacgctcgcacagcggcgggaacccaacaggggacgacaatagataggacgaaagcccacgcgg

SEQ ID NO: 614879 - DNA, 118 bp, Homo sapiens
agaggatcccccatcaaaaaaactgtgagaatgttcattgcatataccacagacgatctttcatgggtcctcatagataacttatggaggatgctttgatatcctagttcttggatac

SEQ ID NO: 614880 - DNA, 324 bp, Homo sapiens
aggagaaaaaggagaaaagggaaaaccagaaaggaaaaaaaggaagagagaggaagggaaaagggaaaggaatgaattgaggaagtgaaagaaggcaaggaggtaggaaaaaagggaggaggaaaggaaggaaaaaatccctcaggtttcagcccttacctgggttttcagggcaaacataaatgtaaaaaccctgatttattttgttactagatcaggttttagggtcctgcaaaaggctagctgggcactacactagggaatttgctcctgttttgtcccttgtcatggttttttttggtattaaaggcccccatttgccca

SEQ ID NO: 614881 - DNA, 999 bp, Homo sapiens
  misc_feature (516)..(516): n is a, c, g, or t
  misc_feature (650)..(650): n is a, c, g, or t
agcggggggtgttggctttctccagcagaagggcgcacttgcatactaatgtggggtatcacgtagagctgaagacgaagagaagggggagaaaacctagcaagatccaccagtgtgctaatgggaagtgtgcgcgtatgcaatcggacatgcatcatggatggggctcgcccatcctgctgcgatgctggctgaagtagtttctgcatttacttgtccatgatggggaaaactaaagatatgccgtctcgaaaacctaccatcagagcagcttcagtgtggttctatttctaggcaatcgataggagagtaggcgcatgctgatgtctcctgccaaggcaattgagtgcgttcaattgtggcgtgtaaccacggagtgaccatgctggtaggactgactgatggacccagatgaaaagatgttggcaagagagagtggtgtcgatgactttcattcttgctatccggctagcttcgtcagtttggataattgcatgggatcatgggcgtacgtgntggtcacttcgtaggtaaggccattggacgtttaggcaaggagaaggaagcaccataatatcatttcgaagttcccatcgcgcacatggtggcaacctactaccgttgtgacacgagcatctgatgaggccagntcaccgtatgcgtaaggataagccttggcgaacattgtgtccgacgtgtgcactgaaaacccaaagtcaccattcgtgagaactgggaactggctattctcgtgatattatctgattccctcttggggctctttgggtgggaagtctgagattccattcgttggtagttctgtattgcagagttacataaccatggcagtcgctctgggagcgcactcatgtcgcgcttttgggcttgctcgtcgacccaacaggccaatgatagacttggttaacacagaaagccaaccacagggaacagagaccagcaaatccttccctctaagtttccatcgtgtaactctatcaa

SEQ ID NO: 614882 - DNA, 187 bp, Homo sapiens
ttctctgatcgctcttacattgggataccacacatcccattgaaccatcctgtatgttctgtgcggaagacagatggatcttggagggatgacactagattaagtttaacctggtggtgtttctaattgcagacattgtgccagattgttgtttaaatgcttgaactggtgctatacagctattgat

SEQ ID NO: 614883 - DNA, 641 bp, Homo sapiens
  misc_feature (635)..(636): n is a, c, g, or t
agcaaactctggcaaaactttatgtaaaggaagaactttctcctcttctctccccatatcatcatagcagctacatcctacaaacacacagcggctgttatcagaaatcaacttgtgaaagtcacctctacccatagatgaggttgtgatggtttcatccaaatgattttatggcctgtgaagcagtcatttggatcaaggttaacaaattcttggtatcagaggtgctactgaggactccacataccgataccaataaataatgtccatacaacgaaggtggtgttggttgatacggtttggatctgtgtccccacccaaatcgcatgttgaattgtaatcccccagtattggaggtggggcctggtgggaggtaactggatcatggggttggatttccctattgctgttctcatgatagtgagtgagttgtcatgagatctggttgtttaaaagtgtgtaatacctcccactcaccttcctcctgctgtggccatggaagatgtgcctccttcaccttccaccatgactgtgtttcctgaggccttcccagaaactgagcagatgccaccatgcttcctgtacaatctacagaaccttgagccaattaaaccttttttttataaattaaaaannaaaaa

SEQ ID NO: 614884 - DNA, 1247 bp, Homo sapiens
  misc_feature (601)..(601): n is a, c, g, or t
  misc_feature (767)..(767): n is a, c, g, or t
tcccgcgggggggtgttatcaacacctcgcccacatatcattgattttgggggcgtatatgtacaccaccacttattaagtggtgttagttaatcaaaccctgccctaatagtatcatgaatgtttcctgtggagacaccacaacacatactaaggcggggtactactaacatattttgttccaaggtgagtttttttaagcacagactatgttgttgtatccaactccactatagggggtagttttgtgcgactaaattttgtgggcgctccaacagccattatgcggaggccccatcatactgcgtgggggtgagaacacaatttgtggggacccacatatgattttgtgtctcatggggggggcacaaaaactaaccccttttgtagcacttcaggactcctctcctctcggtaggtggggggctcaaaacaaggctgttgtgatcccctcctttaataggagagttctataatatctacctacatgtcgggggcgtctcacagtggagattagatgacagactatatatatagagatttttctcgcagtcggggctgcgccacacttttgtctgtcgttaatatgtgtgtggagcantttcttatatcgcgaaatattttgtggggctctgtgagagatgtaccgtgtgagattttgtgggcgcacccacacacacagggggtttccctaaggcgcacttgtttatatggtgtcaccatgcaggggggagctcttgcccacacactttttctacacactagtngtaggggtagagcaacaacaacacgtctcagatatgtctatacacactacacgcattgcacccaaattgtgtgcacagaaaaacacagtgtgggtcaaaaatatgttgtgtcaagaattctccaggaatatatccacacaaagacacactgtgttgttgtgtgcgccacacgtcgtagaattgtgtgggtgcgcaaaatttctaaaaatggtggtgagccctgggataggagattatgataaaagtggtgttttttgaaaatttattcaagaggagagatggtgtagttagagaggggatattgggttcccctggagattcaggcgagtctccttggagggatatagaacagagaagatataacacaccacccacctctcaccaccacccccacacataccccccacacacaggtttccatcccctctcccccccccctacacagactggttctcttattagggtgggcattttatttta

SEQ ID NO: 614885 - DNA, 316 bp, Homo sapiens
ccgggatttttttacccccggggtcccccccgggggggggggaggggggccccccccctgggccccccccttgggccccccggggccgggggccccccccttttttttttgggggggggcccccgtttttttccccttttttttccccccggccgggggggggtttgggggcccccccccctttccaaaaccccgggtttttttggcccccccccccttgggggcccggggggcccggggccgtttttccgggggggggggggtccccctttttgggtttttttgggggaaaaaaccctgtttttttttcccccca

SEQ ID NO: 614886 - DNA, 670 bp, Homo sapiens
  misc_feature (91)..(91): n is a, c, g, or t
gccggaacgccttgggttgcccacggcgccgggtcccacaggcgattctttcttctcgaaggagttccgcgcccaagattggccacgaaantttatgaggcacgaaggaagatagtcggagccccttttccgccaagtgttcaccgctattccgccgcggcgctggagacctccgagaccacgcgctgtctggagacacatgttcctattcgggccacgcctgaatgcacgcctgtaccacgctggcggcgcccacaccgggcgcgccgcgctgaaaccgcgggggccttcgcgccggaagcacgccacactctccctcgctgaaaggcgccctcggcgccccaggcccacagaaggagggccccgccccctggaggagaagccggagaagtggtgaaagaacgcaccccgccgggaacactgagtcaatcctaacccgcaagaatggtgggcacccactggtgggcgtttaacacaccggccagacacttctaacccaggtggagatcaagacccgagatgatcggcccactacactgggcgagattttcccatcccactacaagcccgttaagcatggccggcccggcatcggggcccacaccaccatcctcccgcttctatccctctcaagtaatggctcagctaataaaggcgcacatgactccca

SEQ ID NO: 614887 - DNA, 218 bp, Homo sapiens
ggatcaagaagtggcaggcctgtgggatgccaagggtggcacaggccaggagcagccgtgagcagccctggcgctgaggaagcttacgtgggcagaagagccaggtatgctgctgggtgtggagagagttgaccacatgacaggactccctaacaggggaaaactgacgacggaacggtggactgctgaacttgtggactaggggtgtggataactgc

SEQ ID NO: 614888 - DNA, 1019 bp, Homo sapiens
  misc_feature (87)..(87): n is a, c, g, or t
agcgggcggacccacgagccgaggcctcctgcagtgttccacgacaacatacgagcacgtggctgaagccagtggtatcacgtccangcgcatccatgcatgtgaagcgactggacagcgaggcgaagcaggcggccgactgcccggagaaggctgactgtcctggaccaactggaggctcgcgtaatcacagctagggcaggacgacaacttcaatcgtatcattagcacgtcacgggcgcacccttgctgccccccctttcgtaagtgccatcagatgtgggtttgtgcatcctggactgaagagtgagttgcatccttcgactcagatagattcatagaattcacgtcgacgatcaagtgtgtagcactagcccattgtgcgaaacgcttcgccagacatgcagggcctaccttgttagtacgggtctagaagccagttgcatcaatttaaccgcaaacataacttcccaaatgggagggcctgagttactcgtcggaggcgagtcattacgcggaaaacgcggtacctgaacgtgcacccgattcggaccaattggaccgctgattgccgtcctcaaccttggtccggagcttgggtagcctagtgccgagcggtgacagagccgatgacgccccatgtgttcgctgtgggaaccacccgtcgggttggcgcttaatggactaagcttcattccagttcaataactaaacgagggcccataggacttgtgctgaaacccattggagtcaaggttccatacccgtctcatagcgaagaacattcagaattcataccgcacgacacttgctctgcgtaccattattccaactttcgacgcgggggaaattcccacacaagtgtacttttgtgctttctactcaaagcccctcgttgtcagattccctacgcaaaggctgctaaagagattggggaacccaacgacacctctgtgccggggcagccgcactaaatccgtggatataggagcaaccctgggggaactctcctgtgttcc

SEQ ID NO: 614889 - DNA, 877 bp, Homo sapiens
gctgagttgctcgtgactctcttttgagctttattttggaaaaacccggtagactatgtggggcgcatttctgtcgaaaaatatcgagtgatctaaagctgagtgattgtttcagcaaggaatttggaattgtggctccctcgacgcgagttaatatgtcatccttggctgccttgtgatgtgcatcgtctgcgcagcatggtgttgccgaatcttagataagcatcctgtggctcgcaattgggcgtgcgctgcgtcatcatgaaggtccacgcctgtggccacccgaaccacgcttaacctgctctggcacacgggcgctccgttctccggaggcctacttctcctggaacggatgcaattctggggaagcacggctactcacctacactaaacgcccgcttacacaactccacgcgatactgttgccgcctggcgttctgagccccacggtacacgccgcaccttctcctcttcggacccatcacgtaaagaaccattccacgaccggaccatagcgctccacgccctgtgcattacacacaccctctcattgcatccgacccgcgttcttcccttatccccaccacagagttcaatcgccattccacttcaccgtccacacaccatctttgcgccacaagctgtactatcccacatttgcacaccacattcggggccaccatggcgtctcagcacgcacaccctcgactgggcgccatcggcacgtcgcgcctcagcacatcctgactgccgatattggtccaacgaggcgcttcactactcgcccacacgcatcatcgcggcacccccttttccgggctaattgtccaagtgcggctacccccagcatccatctcaccccttctcccgccct

SEQ ID NO: 614890 - DNA, 998 bp, Homo sapiens
gcggaagtatctggcagaggctgaatgagtacatgagttaaatgaagaaataggataactcctggctaaagccgaacagtctaggggctgaaggtaatgtggatgaatcccgagaagattcttatggaagtggaaaagagtgttcgtgtccgaacgaaaaaagaagctgaggaagaatacgatgaaattccatgccatgcatccagtatatacagcagcaaaatgctgcgtgtctgcgaggtctgttcagcctaccttggtctctcttgacgaagtgaccgtcgcctggcagaccacttcggtggcgaagttactactatggggtgcagttcacgactccgacgagaagcttgatcagtcgaggaaaacctgtcgctgtaacaagcaggagaaggagaaatcatggatcgcttgaggaggatgcagacggagagaggaacgggaggagcgtctgagcaggaggtcgggatcaagaaccagagatcgcaggaggtcactgctcccgggatcggcgtcggaggctggtcaagatcgtactcccgagagcgacggaaattgtcccggatcccggtcccgagatagacatcggagcacacgcgagccgtcccggagccacagacggggacatcgtacgggcttcccgggaccgacagggcgaaactacaagtctccagaaagcgggcatccagagaggagtcctgggagagcgggcggagcgagcgagggcccccggactgaggctagagagctccaagggaagatggcttcacggaggtcagaagagaaggacgccggcgagatctgaacccgtttccccggggtgctggtaaactagtctgagttaacgttcacaccggtctaaaaataacccctttaatatttgctggaatacaatcatctttggtagttcacacttctatggtttaggaagctagctgtcagtttctagaagtgacagaagttgcctgtgtcccgagtcaatgtggaataggactaaa

SEQ ID NO: 614891 - DNA, 722 bp, Homo sapiens
  misc_feature (38)..(38): n is a, c, g, or t
  misc_feature (65)..(74): n is a, c, g, or t
  misc_feature (77)..(83): n is a, c, g, or t
  misc_feature (86)..(86): n is a, c, g, or t
  misc_feature (89)..(89): n is a, c, g, or t
  misc_feature (217)..(217): n is a, c, g, or t
  misc_feature (233)..(233): n is a, c, g, or t
  misc_feature (290)..(290): n is a, c, g, or t
  misc_feature (309)..(309): n is a, c, g, or t
  misc_feature (487)..(487): n is a, c, g, or t
  misc_feature (523)..(523): n is a, c, g, or t
  misc_feature (596)..(596): n is a, c, g, or t
gaacgaacagctgtagggggaaaaaattctcagttgtnaaaaaaaaaaaaaactaatctaaaaannnnnnnnnnccnnnnnnnttnttncctacattaacctccatcaaataccaattccaggaaaaactcttctcattcaaaaaggaattattcaaaagtaatcaaaaccacaaatgcatttggtttttgggccagcaattccacttctaggaatntacatactcacacatntacaaaataatgaacatacaaaagtattcattaatgcagcgtttgtaaaaacaaaanattggaagctgtttaaatnacaccatatcagggttctggttccctaaattttggtatattcatacagcctactcctgggtagacaacaatgaataaataaggagaacttggaaaccatttatttagttatttgggataaccttcattttattttattaggtaggaaaaataaggttgaggacagttactgccatttntatataaaaaggagaaaaatggtaagtacataattntgaattcataatttatctctggaaagagacatgagaacctggtaaccctgattaccttgggaggggaaggggnagtggtggctggggggatggaattgagagggagacaactgtatcctttcatagcttttgaaaatgtgggtgtactatgtactatgtggatgtactaccttttcaaaaataaaacatttaaaaagct

SEQ ID NO: 614892 - DNA, 222 bp, Homo sapiens
  misc_feature (42)..(42): n is a, c, g, or t
  misc_feature (160)..(160): n is a, c, g, or t
ggatcctggaatgtgtggtgtatgggaattacaagtgtcttngatacagatacccttaaatatgccatctgaaatcaaactcactatcgaacatggacaagtgcatgaagatccttaccaaagtgttaaaattggaagaatagagtgacttttattttancgtactagacatgcttcatgggaaccctgacggaaggtctatattcataacaccacacaatt

SEQ ID NO: 614893 - DNA, 668 bp, Homo sapiens
  misc_feature (6)..(6): n is a, c, g, or t
  misc_feature (50)..(50): n is a, c, g, or t
  misc_feature (60)..(60): n is a, c, g, or t
  misc_feature (92)..(92): n is a, c, g, or t
  misc_feature (111)..(111): n is a, c, g, or t
  misc_feature (116)..(116): n is a, c, g, or t
  misc_feature (121)..(121): n is a, c, g, or t
  misc_feature (124)..(124): n is a, c, g, or t
  misc_feature (151)..(151): n is a, c, g, or t
  misc_feature (241)..(241): n is a, c, g, or t
  misc_feature (445)..(445): n is a, c, g, or t
  misc_feature (479)..(479): n is a, c, g, or t
  misc_feature (523)..(523): n is a, c, g, or t
  misc_feature (525)..(525): n is a, c, g, or t
  misc_feature (542)..(542): n is a, c, g, or t
  misc_feature (546)..(546): n is a, c, g, or t
  misc_feature (563)..(563): n is a, c, g, or t
  misc_feature (569)..(569): n is a, c, g, or t
gggggnggggggggggggtggggggggggggggggggtggggtgtggggngggggggggnggggggggggggggggggggtgggggggaggngggggggtggggggggggnggggnggggnggnggggggggggggggggggggggggggngggggggggggggggggggggggggggggggggggaggggggggaggggggggggggggggggggggggggggggggaggggggaggggngggggagggggggggggggggggggggggggggggggggggggggggggggggggggggggggggggggggggggggggggggggggggggggggggggggggggggggggggggggggggggggagggggggggggggggggggggggggggggggggggggggggggggggggggggggggggggggggggggggggggggngggggggggggggtgagggggcgtgcggggccgnggcgggggctgcgtcggcggggcctaggaggtccgcctcaatcncnctactccccatatctancaangtaaaaataaaatggcngtttgnacagacaaaacccaccccattcctccccacactcatggcccttaccacgctactcctacctatctccccttttatactaataatcttataaaaaaaaaa

SEQ ID NO: 614894 - DNA, 620 bp, Homo sapiens
  misc_feature (6)..(6): n is a, c, g, or t
  misc_feature (50)..(50): n is a, c, g, or t
  misc_feature (60)..(60): n is a, c, g, or t
  misc_feature (92)..(92): n is a, c, g, or t
  misc_feature (111)..(111): n is a, c, g, or t
  misc_feature (116)..(116): n is a, c, g, or t
  misc_feature (121)..(121): n is a, c, g, or t
  misc_feature (124)..(124): n is a, c, g, or t
  misc_feature (151)..(151): n is a, c, g, or t
  misc_feature (241)..(241): n is a, c, g, or t
  misc_feature (445)..(445): n is a, c, g, or t
  misc_feature (464)..(464): n is a, c, g, or t
  misc_feature (467)..(467): n is a, c, g, or t
  misc_feature (485)..(485): n is a, c, g, or t
  misc_feature (487)..(487): n is a, c, g, or t
  misc_feature (495)..(496): n is a, c, g, or t
  misc_feature (506)..(506): n is a, c, g, or t
  misc_feature (510)..(510): n is a, c, g, or t
  misc_feature (514)..(514): n is a, c, g, or t
  misc_feature (523)..(523): n is a, c, g, or t
  misc_feature (529)..(530): n is a, c, g, or t
gggggnggggggggggggtggggggggggggggggggtggggtgtggggngggggggggnggggggggggggggggggggtgggggggaggngggggggtggggggggggnggggnggggnggnggggggggggggggggggggggggggngggggggggggggggggggggggggggggggggggaggggggggaggggggggggggggggggggggggggggggggaggggggaggggngggggagggggggggggggggggggggggggggggggggggggggggggggggggggggggggggggggggggggggggggggggggggggggggggggggggggggggggggggggggggggggagggggggggggggggggggggggggggggggggggggggggggggggggggggggggggggggggggggggggggggngggggggggggggaggganggngcggcagggggggggggncnaggggganngggggagagngggngggnggggggggnggcggnngcccaccccattcctccccacactcatggcccttaccacgctactcctacctatctccccttttatactaataatcttataaaaaaaaaa

SEQ ID NO: 614895 - DNA, 510 bp, Homo sapiens
  misc_feature (24)..(24): n is a, c, g, or t
gagattgcattttgcaactacaanaatagcaaagattgtagtgaaaacagacactctcatccactgatggaggttatggccttttgtagggaaataaagtgatgtttatcagaagctataaaatgctcatactctctgaccctgtaaaaatatgtctaggagtttgtcctaaggaaataatctgagatgaacgaaaacatttttgtagaaggctgttcttcatggcccattttatgatagggaaaaaaaaaatcttagtggcaagctaactgcaacagcagggaattggttaaatcaaccacgtgacaaccataaatagaatagctcacaggacatttctgcagacagaatgaatctgtgaagtcagatgtcagaacagtgtttatgccctttgtagggtgtgagtgacatagatgtgttcagtttttgaaaattcacacagtacgcttatattttattcacttttctgcccccatatttgatgtcaataaaatgttttttagaagataa

SEQ ID NO: 614896 - DNA, 390 bp, Homo sapiens
ttgcctctatggcctttggcaaattacttaatgtccctgtaattcattttttttttcatctttaagtgaaaataatgctattacctacagcaaaaactttgtggggtttttggtgagaattaatatatgtaaatgcttaggaaaatacctgctgcataataaacgtggaataatgccctcttcctgttctcctccttctccttcttcctctccctatctctcttcctctgcctatcaccctcgctccctcctcttcttccttatcctccttttcctacttgtacttctcttcctcctatacttgctcttaccatcccctctcgactacattttcttcttcttgaactacattttcttctccttcttcttatataccttgtacatcctttt

SEQ ID NO: 614897 - DNA, 267 bp, Homo sapiens
ggggccctttcccaaatgggaataaaagggcccaccctttttaagaaaaaatacccaacctataacccgggacagttgcaagcaaggaacttcaagcctgttaatccttaagaggtgaccacagctatgttagcacttgtccctcccttgactgacaaacctttaggaaggagtcccagttatggtatgagcttttgaaccagtgctacatcaggctactatctcgtcaagcaaggaaccaagggggcaaagacattacctccagaa

SEQ ID NO: 614898 - DNA, 187 bp, Homo sapiens
agtcgttccgggcccaggggatcacgggagccaggtcgggagatgggggcagtaggggtccttggggccaaagtggcatgatttcagggaaggatctgtccttgacgtccattcacattgcttttggagaagttgaatttggggaaacggatgtggttctttatgaaaatggtgaagtcttcggaca

SEQ ID NO: 614899 - DNA, 165 bp, Homo sapiens
acgaattacggcttcgttcctatttatagttctatcgcaggtgttgacacttttccctaaggtgtccacactttaagattcatagggttcagatggttcagtctaggttcacacagtttaacactagtgtcataaggttaagcatacaattcaataggttcaaca

SEQ ID NO: 614900 - DNA, 416 bp, Homo sapiens
tgggcgaccactagagaacacctggagatgggatggctcctatttggagagcccctggctagaggggctgtgctgaaggcagaccccagataggactctgggctcatacagattccactatcattatctgacggggtgtcttcctcctttatgcactgagggatcatggccacacgtaagcagtgtcacgtctggcttcctcatctccttcagtgatctccacttcactgccctagctctaaactacaggaatgatctggagtgcaggaccggacccctgcgggacggggcaagcaggttgtaaccaaggtgaagggggcaacctggtcgggttttgttaaactttctgggagatggcccattgggttcaccgtctgtgggggctgcttattagtctcctggactaggggggccca

SEQ ID NO: 614901 - DNA, 310 bp, Homo sapiens
agacctcgggaccttatagcaccgtggtagcgtggcatttgtagtcccagctgctcgggaggctgaggcaggagaatcgcttggacctaggaggcggaggttgcagtgagccaagactgcaccattgcattccagcctgggagacagagcaagactccatttcaaaaaaaaaaaaccaaaattccttataactcagaaacaaaaagcaaacgaccgtgattttttaatgtggcacgggactttattagacttttccccaaagaagacattacacttggccaacaggcttgtgaaaggatgcccaatatca

SEQ ID NO: 614902 - DNA, 261 bp, Homo sapiens
aggccgagtgtacatatggagacaggggggacacagtcaagagggaagccaagcatatgcctacctccttgtggggcaggtccgaaaatacagacggacggtgtcatgactctgaatcaccctcaagcctgcgacgtggcccacacccaaagacagcaccattaataacctaccacgtacttaggattcctcccaatacagtactcagcagccacacccgccaaataaatccatgatgagacatctgccatccttgcctta

SEQ ID NO: 614903 - DNA, 221 bp, Homo sapiens
agtccaggtctagatctgcctctgaagtaactgtccgagcccacaaagtgggtccaagatttagccataagtcacaggtctttatcataacttacccattaaagtcattatgaagtctcatgttgtccaggctcacgtccagtggtgatatcgaggctcactgcatatagtccatcgcgcgtatagtcagttctgagccagagcctcacacgaagctggcg

SEQ ID NO: 614904 - DNA, 384 bp, Homo sapiens
tcctggatgcccagagcccctggcctggagctgcctcatctgtgtgtgtgtggtactcagtgccccacccctccctctttatgagttcagttgccttgctcagcccctcccctgtatctcagcgtctatcagacctctgacagagacgacgatgtcgtgtgtctccctgtgtggcccactggtgtgtctcacgggtcatggtgtgtgggatatgccgggaactcggggagcccactggctgcgccactctgacctggcagctgaagcctgggagagtcctgcgtggtgtacttggactcagccgctaacctgtgccgacgcaccagtgttatcatacttgacacagtgtcatacatcacgaaaacaatgcctctcactatatgc

SEQ ID NO: 614905 - DNA, 773 bp, Homo sapiens
  misc_feature (482)..(482): n is a, c, g, or t
gggggtgtgagaggttttgtcgctctagggagattcttcgacgcaatcgcttatgtcaagagaacacaggtgtttcgccttccttcatatgaggaagatcagggatctgatagactgattccgaatagagcgtaagagatggacatccacttcgtaacccggtatgggaatagcggagtgtattgtagctagttgattgcattatggagttatatataactgacagagacagagggaagatactaaaatgtccagttacactctgatgcgacatgcagtgtggcatgggcaaggactttgattgtagagagcaagtgatctgtgggtactgagtgctattccgatgatattcgggaatttctgtgagctaaataggcataagacctgtaagaagaacgagatagctgtactatggtcttgatagtgaggagcttgtcgttttagtttgagaatgtgctttagttgattcaaatgtgtacctnattattggtcggaaagtaaactaagtatagtagtgggttgaggatgggtaacagggggatttgaatagtcggcgtatcactgtatcttgcagggcttgatgtgagtcttggtcgatgcgaattgactatgtgactaggttgactaactacggtcattcatagggaagtcgggagttagactgaaagcagtgtcacgctaaatgcacttgatgggtgttgaaatgtgcagcgttcttgaaatttttgtaagatgaacttagttctggaagaagatagcagggctaattctga

SEQ ID NO: 614906 - DNA, 579 bp, Homo sapiens
  misc_feature (462)..(462): n is a, c, g, or t
  misc_feature (503)..(503): n is a, c, g, or t
  misc_feature (516)..(516): n is a, c, g, or t
  misc_feature (559)..(559): n is a, c, g, or t
aggtatctaggaaactacagtcccacaacatacagagactctaatccaagccaagggtgcttgtcactgccaaagagaaggctatgagcccccgcacacctctggagccctgatttccagatgtcctgaaaacagcatcatgcctctgcgtccactcagctcccgctctgcatttgctttggcttgagtctttcctgtttctgagatgccctcctcccagagtcggtcagctcacttcctgtgcttccagaagcttggttgttttccacactgtttcatccccatagaagacccaggtctctcggtgccattgacatctgtgagagtcataggtttactgaaatagtcaacgtgttgttaagctgataaaggctctgagtaacgaacgggtgctgcctcccacagtagagccaggctaatgtaatggtccccgttccataaatgggaaaacaggaaactgangctctgagaattggatagtgtccaggattccagcagcaagngcctcaatgcctnaaagtttttattgagctgaacaggaccttcagtacctcctganggtgaacccagaaatgcatt

SEQ ID NO: 614907 - DNA, 305 bp, Homo sapiens
cccatcgccaactaatcgtacgaacaccacaccgtgatcggcttggggccgttatggccggcaaaacaccgcgcattggggaaagcccctttgttgcgcaggatgtcgataatgacgcgataacgcccttcgacatgcaggcgatcgatcgcctgcgcgaaaatccgggagtactcgaccccgggatgcggtgagtctacgtccatgtccgcccactacccccgccaagcgccgatttccagcggctttccccgatctacgtgatcatacctatcggttatagaatatccagccgcgcagagttt

SEQ ID NO: 614908 - DNA, 923 bp, Homo sapiens
  misc_feature (193)..(193): n is a, c, g, or t
atacagaatattaagaaaatgaagtaactgattttctaaaaaaaaaaaaaaaaaaaaatttctactttttaacccaaagtttgtcccattggcaggtttggcaaggttggggggtaaagaccgaaaattttttccgtaaccaatattgtcgtggacctcttcaacgatggctaataggggcctggacctggangtggctggctatcttggaattgtggcacagcgtccacttaccctttttttttttttttttttaaagtgttttcccccttccgggaaaccaccctttggtggctctgtgtcccctcagggggacccaattgtgtctgtgcgcgtccccccttgtgggggtttaaccgcgccctttaaattttttcctacccttctcacaaaagggggggggggggacaaactagcgggcctctgggcacacaatagctttgtaagaaaagccttcttcccctttaaaaaacgggtcctttactttcaacttatcaccctataaaccccggggttcgaaatttcccaggggttacctgcacccttttttccaaccacttcttgaagaagattgtcatccctggtgtggagcgacaaacaaatgcgctttaattagttcgcgcaggggggacttttcttgcccccaaattttttgagcccaaccaccagtgaggaaacgggctgggagaaaaaaaatttatgcccggggtttggaaagggccaatatccctataaaataactggggtcacaaaaggggggggacgcgatattacggtccggacccaatttttgtggaatccccgtgtttatggtccttacaccctaatggctcggacacattcacacgaatacagaccggggaaccgaccccaggattgagtaccccacgttttgacctgtggtcgacgaagggtcacaaatt

SEQ ID NO: 614909 - DNA, 144 bp, Homo sapiens
gtaccggtgttatcgatgcacacaactaagtaaaacattacattctagacccccttacaactagatatggccggctagatgcagtggctcacgcctgtaatcccagcacttgggaggctccctcagtggtggcatcgataaaca

SEQ ID NO: 614910 - DNA, 686 bp, Homo sapiens
ggcttaatcactttttttttttggaggtggagtctcgctctgtcgcccaagctggagtgcaagggtgcgatttgggctcactgcaacctccacctcccgggttcaagcgattctccggcctcagcctcctaagtagctgggattacaggggtgtgccatcacgcctggctaattttggtatttttagtagagatggggtttcaccatgtgggttaggcgggttttaaactcctgacctcgtgatctgcccgcctcggcctcccaaagtgtggggattacaggcgtgagccagggcgcccgaccagggcttaatcactttatatatttatggtaatttcaattggtatttttggagatggagtctggctctgtgtgcccaggctggagtatagtggtgtgatctcagctcaatgaacctccgcctcctggttcaagtgattctcctgcctcagccttccaagtagctggacctacgggcgtgtgccaccacaagtgctaatttggtatttcagtcaaagatggggtttcccatgtgggccacggctgtcttggaactcctggaccttaagaaatccaccaactgcggcctccaaagtgctggcattcccggggtgaccaacaaatccaggcctttatttttttatacttagtggaaaccgatattcttcaagaacatggacgggctg

SEQ ID NO: 614911 - DNA, 407 bp, Homo sapiens
ccccccccccccctttggggggaagggttaaaaccccttgccacttttaaacccaggtaaaagcaattttgccgggtttcctgaaaacacaggggcttttcaaaaaaccgggttgggttatttaccttaaacaacttatttaattaactaaatggatatcccaagcattccatgtttatcctgttgctcagtgaatcctcaaatcgttaatttggtagattctcttttttgtcttcatactattatttcttttagcttttaaaaaaattgtgtactgcctacaggtctttatggaagtttcacctttctttgtgtcgcactggcatcggctgtataatttttgcagctagaccacattttaaaaaaatctacatttttggaactagtaaaagatacttatttgtgtt

SEQ ID NO: 614912 - DNA, 1235 bp, Homo sapiens
cgtcatctactctaccatctttgcaggtcacactcatcacagcgtctaagctcgcatctgattatttcacctgagataggcctaggaaattgaaacatgctaggcttgttattcacacgttacgtaactcaataagaaataaacactctcgtatccacagaatgcatgctcatcaaagtatttcctcagcagcaacgtcaaccgcataccataatccttctaactagcatatcgctcttgcaacaaatagtactctccggacaatggaagcgcataaccaatcactaccaaatcaattactcatcattaataatcataatggcgtagtagcagataaaactaggaatagccccctttcactttctgagtcccatgaggttacccaatggcgacctcctctgacaatctcggcctgcttcttcgtcacatgagcagaaagactagcccctcatcgtcaatcatatagccagatctctccgcgtacactaaaacagtaaagcctatctcctcacgtctactcagatactggagtcgcatcatagcagggcacggtcgacggtggattccagtagccagaacccagactagcgcacaaagtcttagcgatacttccatctaattacccactatacgggatcgacttcaatatcgcgggttcctaccctgtaacacactccttagacaatacacccattactttacctttctaactcattatattatttaatcctaaactaatcacccgcatttgccctaacttaactcaaacttaaacctccaaggcgacgccaagaaaaccttaataacttaattctcggcaccttgtagatacagtctaatgcttgcactaaagcaccctttaaatttcaagatccagcccaatccttctcccttaagtagtgccatgaccccgggctaagcgcggcataatggccaaatgggtgcaatcatcggaacaaggttttctctacatagcgaagtgccattaaaatccccacccattatttgcaacaccagttcaccccgcgtttcagtcgtcattttagcccattgccccatcattattcgccctgcatcactaacgacccgaattgtagagccgaaaacacaggcggtgagtatcccataccacccctcggcaagaggaacaatagcgacatacgcacatcctcccttcagtctctatagcaacacgggggtgacccaccttacggactcactctctggctatgcaa

SEQ ID NO: 614913 - DNA, 299 bp, Homo sapiens
  misc_feature (144)..(144): n is a, c, g, or t
gatgaaggtaagagtgtcacactctgagaatgtacgccacaagaaggtcgtgtgacagatgctactgagacacgatacattagtggaaacaagatgagacgatcactggttcaagttgatgcgtcagcaatggccagactcaancagagaacatcaagcagatgtaagaagctacaccatcacaggtttacaaacaggcactgactacaagatctatcttgtacaccttgaatgacaatgctcggagctcccctgttggtcatcgacgcctccactcccattgatgcaccatccaacct

SEQ ID NO: 614914 - DNA, 122 bp, Homo sapiens
cctgggtgtatttaaaaaaaactaaggcagaaggctttggaagagttagaagaattggaaggccttaaatatagtagcttagttgaaaaatgtgaaggactttcgtaacggaagtatgtagt

SEQ ID NO: 614915 - DNA, 262 bp, Homo sapiens
ctcgtgcttgatgcaggtgctgccttcctgacttcttctctgtgaaagtctttgtaatttgttaagtatatagtagggagatacttttgacataagatcaaactttcagttatctctactatctcaactttaatcagagttcaatttgcttatttatgtcatgattggctcagtggtttccccagttaatccggttgattgttacccttgtgtcaggactttatttgatgttcatcatctcaggtttgcccctgagagcccc

SEQ ID NO: 614916 - DNA, 7045 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 614917 - DNA, 4541 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcac

SEQ ID NO: 614918 - DNA, 289 bp, Homo sapiens
  misc_feature (9)..(9): n is a, c, g, or t
  misc_feature (101)..(101): n is a, c, g, or t
ggcgctcantggatccaatacaccagactcccgggagcgaaacgcccgcaggtgctcaaagaacttaaaacagaactgccattagaccccacaatctcatnaaggatgttatagatatatccaaaagaaaataaatcattcttcaaaaagacacatacactaacacgttcatggagcactattcacacagcaaagactcgatcaactcacacactcatgaatgcggatcgaaatagaagatgtggtatgcatacaccacgaaatactacgagccataaaaggcgaaatc

SEQ ID NO: 614919 - DNA, 285 bp, Homo sapiens
gatgcggtacataaagagactcatcacatgctcagacaaaaaggaagtagttatggaagagcacaaagacgattgaggacatatatttatcgaatttatccaaaataaatttctagaatgaagaaaactttttttttttttttaaagggaaagccacccaaagattagggagtaagcctttatttaaaatgtctcaattttaagttttggtcaagccgtaggcaaaattagaggacggcatttttcttagaggtggtggcacttgattggttacgggggatcccg

SEQ ID NO: 614920 - DNA, 525 bp, Homo sapiens
  misc_feature (29)..(29): n is a, c, g, or t
  misc_feature (67)..(67): n is a, c, g, or t
ggcaggtgcctgaggtcccagctactcgngaggctgaggcagaagaatcgcttgagctagggaggcngaggttgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaaca

SEQ ID NO: 614921 - DNA, 7921 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggaagagacatccttgtgttgggcattaactgcggtcttggtgccaagcccagtgctctgtggggtccttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaatttcttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtcgctgccttgagcgacacggtggcgatggaaggctttctgggaaaggtagaggttgagctaaggaaagaaagtattttaataggtaggaggacccttcatggagctgcccttccattaaggtctagcctggtcaccgtgcctgggtctgaggccctccctccacaggctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 614922 - DNA, 7513 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggaagagacatccttgtgttgggcattaactgcggtcttggtgccaagcccagtgctctgtggggtccttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaatttcttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtcgctgccttgagcgacacggtggcgatggaaggctttctgggaaaggtagaggttgagctaaggaaagaaagtattttaataggtaggaggacccttcatggagctgcccttccattaaggtctagcctggtcaccgtgcctgggtctgaggccctccctccacaggctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaaca

SEQ ID NO: 614923 - DNA, 5417 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggaagagacatccttgtgttgggcattaactgcggtcttggtgccaagcccagtgctctgtggggtccttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaatttcttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtcgctgccttgagcgacacggtggcgatggaaggctttctgggaaaggtagaggttgagctaaggaaagaaagtattttaataggtaggaggacccttcatggagctgcccttccattaaggtctagcctggtcaccgtgcctgggtctgaggccctccctccacaggctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcac

SEQ ID NO: 614924 - DNA, 281 bp, Homo sapiens
cgctctgtcacccaggctggagtacagtgcagcgatcatggccttgacctcctgggctcaagtgatcctcccacctcagcctcctgagtagctaatttttgtttttagtggagacgaggttttaccatgttagccaggctggtctcgaattcctggcctcaggtgatctgcccatctcggggggcctcccagagtgctaggattacaggcgtgggccactgtgtccagccaacaaggtttttttgagtagtgagtgagaagagaataatttacttttagtt

SEQ ID NO: 614925 - DNA, 7774 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagtgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggaagagacatccttgtgttgggcattaactgcggtcttggtgccaagcccagtgctctgtggggtccttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaatttcttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtcgctgccttgagcgacacggtggcgatggaaggctttctgggaaaggtagaggttgagctaaggaaagaaagtattttaataggtaggaggacccttcatggagctgcccttccattaaggtctagcctggtcaccgtgcctgggtctgaggccctccctccacaggctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 614926 - DNA, 208 bp, Homo sapiens
gaagcacatgatcaggagatgacggcatgaagcactcacagtgccgtgcatggagctggcggagcactggagcagacgaagcgggtcttgaggcgatgtgatacctgcccagtgttctgaatgtcagagtgaagaaattccttgatgcgcgtgtaatcgggcgaaagtaaactatgactctcttaatgtgtagccaaattgcctcggt

SEQ ID NO: 614927 - DNA, 5235 bp, Homo sapiens
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 614928 - DNA, 3898 bp, Homo sapiens
cacgaggtcttctaagacgcacagggtgggtcttacaagacccattttacagatgaggaaaataaagcacagagcagttaactaacctttctggggtcacacagcaagtcagctgcagaaccataaaggaatctcgggcctcctaggcttctccttttccccatgacccacaccggtcggtatcttgccaggggaaaagtccccaacgttctaggctgggtggaaggagggatttgggggcagctgtcactggggccccaggccgccctctctcctctaacctggctctgagtcccatccccccttgcaggatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 614929 - DNA, 212 bp, Homo sapiens
  misc_feature (4)..(4): n is a, c, g, or t
  misc_feature (158)..(158): n is a, c, g, or t
cttncactaccacccaagagcaaatgagtgtggctctttaggttcttgggccaaagccctgggtcctcctgtgttgcccagaggagatgggaacccacaggccactgctgaagggtcttcagcggtgttaggatgtccttggagggagcagggaattncaggggacaaatgcttggtgtcattccgagggtgggtgcacagggcccccagca

SEQ ID NO: 614930 - DNA, 3051 bp, Homo sapiens
ccagtcttgctcccatcaggagcactcacctcatctacagagcaaacacttgtttgattggcacatctttattttatttatttatttatttatttatttatttattgagatggagttgggtttcagccaggatggctggatctcctgacctcgtgatctgcccgccttggcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 614931 - DNA, 558 bp, Homo sapiens
atctagaaaagctatggatctcgcttggtcgccaggagggagtgcaggggcgtgatctcggctcacggcaacctccacctcccaggttcaagtgattctccggccttagcctcccgagtagctgggattacaggcacgcgccaccacgcccagctaattttggtatttttagtagagacagggtttcatcatgtgggccaggatgatctctatctctggacctcgcgatctgcccgcctcggcctcccaaagggcggggattacaggcttgagccacggcgcccagctacaaattctattttcttttggttcctgggaaagcatcgcggggcatttatccggtcccagtattggagtgaaacttctcagcatttcagagcagggaccatgatacaccctttcctttccttctccttaggggaaactccgttctaacccagaggactggggctccaggacccagtaacggagccctggattggaccctaaaagggagtaaagacaacggtgaagttcagtccggggttcagggctgccaaagctcatagcgtggagctt

SEQ ID NO: 614932 - DNA, 390 bp, Homo sapiens
tcccgggttgtaatgtaaacgggattattccagtgacatcatcttatcaggtttacagtaaagaacacaatactaagctcccaactcataagaagtaattaggaacttcactggcctagtttctggacataaaggtacagattcaatagttgtaagtttcctctaaattcggccagttatttctagggatctgccttcatcaggttacatgtaaatacccattttaaacagagataattgctccatgaatatattaattcaaggtagattgtgaataatatgactgttcagcttcatttctatcgccaagttatgtatcagaaagaacatcacagcctatggagactgaactagattgaagattttggatctaaacatacagaataattt

SEQ ID NO: 614933 - DNA, 105 bp, Homo sapiens
gcgctctcaaatcacggtctttcacatattttaacaacataacccacctcaattttttggggtttatttcctatgttggcaagatattccatttttaaaaatggt

SEQ ID NO: 614934 - DNA, 313 bp, Homo sapiens
cccccccccttaccccaatggggggggggggggggcggggggggggttttttaaaccaagccccttttgtggacccgccggtggcccggggacccccccccccctgtttttgcccccctagaaggccccggggccggtcccccccccgggcttttgcctgggccccgggggggggtaccctttccccccggggacccctttgcccccttgggcccttttgggggcccccttgacccaggttgggccaaaaagccggggggggccgggcccggtttcccgggggtttggcgccccccggggcccccctcttcca

SEQ ID NO: 614935 - DNA, 357 bp, Homo sapiens
  misc_feature (27)..(27): n is a, c, g, or t
  misc_feature (134)..(134): n is a, c, g, or t
  misc_feature (139)..(139): n is a, c, g, or t
  misc_feature (143)..(143): n is a, c, g, or t
  misc_feature (174)..(174): n is a, c, g, or t
  misc_feature (178)..(178): n is a, c, g, or t
  misc_feature (331)..(331): n is a, c, g, or t
aagttaaagaaaagaatggaatgcctntagtttcagagcgataaatatttcaaaagaaatagaccttttgagctcaggaaaggtgttttagaggaacaggtgtgattgtaggttaatgagtgggctttgaccancagcnaccnggactgtaattggggtggggttaaaaaggtncatnaagtgggccaatttaatcctgggtcttttggaactgttttcatattagaaagccattaaacaaagagttcacttcgaaccttattatcagttttctaaagaaagattgggattgaaaaggcaagaaaattaaagcccagggccttcggcaggnagtggggaggggcacagttttctctt

SEQ ID NO: 614936 - DNA, 125 bp, Homo sapiens
  misc_feature (101)..(101): n is a, c, g, or t
tgaacatctgtacagccgccctctgcagagtggggcatgaagatgtcatggacttggctgggcacctaccaactacgaacttgtgtgtgtgtgggtgtacnctgatgctctgaattctgtaatca

SEQ ID NO: 614937 - DNA, 212 bp, Homo sapiens
ccccgcgatatttttacaagatactatccaagtgtttgtgttgatgtgtatttagatggcagaaaggagcaatctgtgagctgagagaggatcatgacagctggtaatttatttccagtttattaatgttttcctatatctttgaaaattatttgtttaggaggaattgagcacttaggtaaaattccctttgtagagctttgtagtcaatg

SEQ ID NO: 614938 - DNA, 720 bp, Homo sapiens
ctcttccactgaaggaagatccgccctgtcctggtggcagcttcatttcaaagcacctctgtcaagagcccccagactggggtccccaccctatacaggaaaggctggagcatgtccagagccgagtgaagagtctctgggtggaagagttccgcaaggaaaccaagtgggaaatgcccacggctttttagaagaatgggaatgtgggaagaaaccacctggccgaaaccaagaatcttaaggagagaccggccgatagagaagttaggaaggtcatagctttggagatcggagaatgagaatcttgtagacaaatggttgcagactccgatgaagatgattacagcttcctccacgaccatggtccaccaggaccccagtctctgaaatggctcgaggttttgttagaccacacctttgctgaagaattccctactcagatcaggaatccccggatgctggaactctgggagggagaactggtcaaagagctctctgtggaagaacccagataaagagcaaatcggtattatgatgaggatgaggattaagacgtcgaccaattgtccatcgatgctgggccttaaattcatgttagtcgttagcgacgcccctgccctttgtccaaatgtgatgcacattagccggtatccccccatgaaatgtaatttacttggaagttactttgggaaagaattccttttttaaaatccgaaacca

SEQ ID NO: 614939 - DNA, 468 bp, Homo sapiens
aggcagtctgtgtgtgtgtgtgtgtgttatgggattgggggagtaggcagtctgtgtgtgtgttacgggattgggggagtaggcagtctgcgtgtgtgtgtgtgtgttatgggattgggggagtaggctgagtgtgtgtgtgtgtgtgttacaggattgggggagtaggcagttagcttggttgcatgttggaagctactcatgcagttgatctcgcttatgactgacttgagttccatagctgttggctgcgtgctctttgatcccttctttattatcatgcgctttcagtagtgctctcagtctgatggtgtactgcgtgcttggagcatgcttgagtgccaggtctctatctcggtgctcgatgttacaggttgctatggctctctctgctgtgatgctacctggtcactgatacctttgttttgcctatgatatctgtctgtgcatcctgaaccacatgtgatt

SEQ ID NO: 614940 - DNA, 985 bp, Homo sapiens
ggggggcctcgcttgaaagagtgaggacaggctgcgggaggagctgcaggactgaggtacagaggccaaggggccatggagtgacccagcgtgggattgatccctgtggatcccatgtgaggcgcacacccctttcgtcaccgacccgagtgagcgcgtgcgcccttcgagatgagacctctgttttgctccccgtgtggcgagggccagaggcgaggcgcgtgggtctcgggtggaaggcccccgattggtggtggtggttgggtgcccccgttgaaaggagggaagcgccggtggggctgtgggggctggaatccccgcgttggcccgggttccgggcggtttccaaccttgtggggaacgcggcgggtgcccccggcgggggacgggccgcctggggggttgcgcccggacgcccttggtgcccgggacattggtttgcgcgccccggtggtgggcccccccaaagggcaggccaatttggttgggaccttcgcttgggttgggctggcaacaagttcccttggagggcggcgattgccctgcctgagaaagcggcagtgcctggggtgtgtgcacaggccgggtagccccgataacggtggggcaagagagctcgggtgcgcccttgttgggagggaccctggggggggccaagcaagagccctccccccggtatgtggttcgtcgagcgaccggggggttgcctgcgggtttgttcacgacgcgccctggggcgcccacatggtgtggaacggcggcgccatggagatttgatccctttaggcgaggccaccggccctggtggtggagggggccggtcgcttggggactcccagggcttgtggcgccttaagagaggtgaccgagtagcccctgtgggctggctcgcgcgctcacaagggcgggacattcttggccgttgtgggaattgctggaccagtctctgtgggcaccgggcctttgggagaccgcctcgcagtgg

SEQ ID NO: 614941 - DNA, 568 bp, Homo sapiens
tggaaagggagtctcgctctgtgtggcccaggcgggagtgcaggggccgatctcggtcacagaacctccacctcccgaggttcaagcgattctcctgcctcagcctccagaagtagtgggatcacaggcttgcttcaccacgccgggctaattgttggtattgtctacaaaagacagggtgttctccgggtggatcaggcgggtctcaaactccgtgatctcaggtgacaccacccgtctaggcctcccacaggtgcggggataacaggcgtgagccacacgcacccggcctgacgaactcttgagctcaggcaatctgcctgcctaagcctcccaaagatgctaggattacaggcggtgagtcaccaggcccggagggctcatggagtatttaaattggtaaaagtacaccccaaaaagttctttggattccaggagatggaatttctctcagtcatacacctctcttggtggaccagagcatgctaaacatcaataggtataatagaaggtgataatgacccctggacaagtgtacatctagataacactcccggttgagacactc

SEQ ID NO: 614942 - DNA, 745 bp, Homo sapiens
actggggtgaaagtggataaagcatcataaatggctgacagctatggacctagggctgaggagtatgagttgctaactccacttaaggagggtcccaaggtcatgctggtacgaggcacgtaccacaacaagagcttcttgaccgccgatgacatgcaagaccacctcagctgggagggggacctgtcaattaagaaggagtggccagaatgaatgcatccaccatatttccccaccctagacacataggaagaactgtcttaggcatagaacagcaaccatgcactctcctacctaaaacacagttgagtccatttacaacactgacacatcagcttatagaggcatttctttgccaccctgtcactgaacgtggtccatgaaacaagagactcagaaacgtgcttcgcccaacctgctccctctgatcctccatcagggccagatcttccacgtccccatctaagttcacattgatttaatatttgcctgtgttacccctattcaggcaactagagcgcacaacctggacaagagtctaataacaggtctttgcctaagtttcaaccgttgattctaatgactacattctgttaccgcagttactggcccaatgagacactagcatatcccagtgcgagagataggccaaaagtctcgaaagaaacttccttccaaacaggggaacaaccatgaaggaaaaacggaatgggaagcggctattaataagaaaaaatacgcgata

SEQ ID NO: 614943 - DNA, 926 bp, Homo sapiens
tgcacgcgcactgtgagcagcaggcaggccaaaccaccttttctgcccgcacgtggtgcgcatgtgtgttctcctctctccccacccccgccatggaggcggtgtggcatgtgtggcgtggcatggcatccacagtgaggacaagagaagagctccgttccctcaggaccccactgggtgccgctggcagcttccagatgacctgggcccctgtcctggggaagaaacagctcccgtccccggtgctgactgctgaggagggagcttccttctgtgcgggcttctccacagcgcgactgctccagcatttttccttcaaggttcatccatgtgttccaaatgagaaggacatgatttgcatgtggccgaggagtatgtgttgtgcggatatcccacagtttcctcatcccttcacctgtggatggtcaggttcaaccatgtggctcccgatgacatgatttcagtatctgtgtctggctgaagagtgttccattgtgaatggacactatggtttctgtatcccatcatctgtggatggatagggcaccctcatccagcatcggacggagcacctgctgcacagcaacatgaccagcggtgacatccttctgtgctacatcacggaaatcttggggccttacttcagggaggagagcctgctgtaaggcagatgacttctcgtgtgcaaagcggcagagatgcgctttgatgatggccagcagttcccctcaggtggatgactcaaggctgagcgtatcagggccatgggcgatgtgcagctcaccgaaaacggggggcatcatgccggggagtgacgacgctcacccgggtcggagccggaaccgacaagggcttgggacggggggaaccgtgtcccataacaggcggggaggggcccgaaacggccccccaaggaaagagacccg

SEQ ID NO: 614944 - DNA, 730 bp, Homo sapiens
tggaaacagtcttgctgtatggcccaggctggagtgtggtggcacaatcacagctcatggcatcctcaatcacccaggcctaagcaatcctcccaccttgtagctgggactacagctcacagcacaccttggctaaaattttttttttggtggagacgggattctctatgttggcccaggcgggtctcaggctccggggctcagatggtcctcctgcctcagcttccaaaggcacaggccaagttgtagcttggtcccttgccatacatgcccaacaagaggttctatacctttaatgaatggacttcataaatgggtatatgtgggggggcaagttcttaaagctggggaaattggtaaattcctcctgaaatggttttttcatgcagttaccatgaactattactacaataagggagggtctggggtgtcaaaaaaaaaaaaaaaaaaaaaaaaaaaaaaaaaaaaaaaaagaaaaaaaggaaaaaagaaaaaaaacacaacagaaaaaaccagaacagcaacccacgcaacaattaggaaaaagtaagcaggcgcacgacgaaaaccaccaacacaacacaaccatcacggacaagccaacacacacaaacaatgaggaggggcaacaaacacgaggacgccgggcgcacacacagaacgcagcagcgaaaatcagaacgcgaccagagagaagagaactaacacggggaagggaaaaacagcaaag

SEQ ID NO: 614945 - DNA, 214 bp, Homo sapiens
cacgaggaaggacaccgctgcccaagccttcctggctgaagcctcagtcatgacgcagctgcggcataacaacctggtgcagctcctgggcgtgatcgtggaggataagggcgggctctacatcgtcactgagtacatggccaaggggagccttgtggactacctgcggtctaagggtcggtcagtgctgggcggagactgtctcctcaagttc

SEQ ID NO: 614946 - DNA, 960 bp, Homo sapiens
taaaaaccccggggaccccctttcggggaaaagaaaaaaaagggaaaaaagggccaaaaggggggggaaaaaggggccggtgtcccaccccggcggggaaaggaatgagggcccgcaccccaacctcccctcggaggagcagccgcgttgtaataaaaaaaagtgctccccgcgggggggacgaccaaagaggcggtggtgacaacacatacccccgagggttcatagtcagggggggtagaagagagaacggcaaggaggaggagtggtggtacagcaggagtttctcgaaaacagtttcgccgagtcgtggtggggccctcacccaagaaggaaggccgacggggggttattacaacacagactggtggtgcagaacaagaagcggtggtgggctgccccccacccaacgcgcggggggtgggcgaacaacaagagtggtggtggtcccccacatagcgccgcaagacaatcctcacagcgctctccttacacacaaaaaccgcgacaaagtatctcacagcagggtggtaataatagaagcaaacacaacgaatgattggcagcaccacaacaaggacgttagttcgcggcaacacaaaagcaatgtggctccgtcgctaaccaaagcggccacaaattaaaaagagggggggggcaacacaacacggggggcaacaaccgacagcggacagtcaaacatcacgagcgccgacagacgggcgcgccaaacaagaaggtgttggcacacccccctcataaaatagataacaacccaggcggtggcctcccccccaaaaagagtgtgtgatacccaaacaaccaccaaataacaaacctcctcgttgaacccccaggggggatataacccccccaaaatagtgggcggccacaaaacaagcaagctgcatacaggtgggtcacacaacaaaacagccacccttctgtgggcagaccgaa

SEQ ID NO: 614947 - DNA, 152 bp, Homo sapiens
tggagaggaccatatactagccaggcagacttacactatggtggcatggacaccagctcttgaatcagggcaagaattggacactatacattctccgacagtagctagaggtttcacagacctctttgacctgctggaggctcggccttacc

SEQ ID NO: 614948 - DNA, 169 bp, Homo sapiens
gccgcagacaaggcaaagcgaaattggtcattctcgctaacaactgcccagctttaggaaatctgaatagagtctatctatttggctaaactggtgtcatcactacgtgcatatatgactggcagcatcgaatactacgagtgtgcacctgctatatgtcagtactctg

SEQ ID NO: 614949 - DNA, 135 bp, Homo sapiens
ggtatcccaccccaactaggaggaactctgttttcaacgagagatgctgtctgtgcttggatagtcaggcaattatttgtgtatgaaacaatgtacaaatccatgttttgggaaataatgatctccagactttct

SEQ ID NO: 614950 - DNA, 293 bp, Homo sapiens
tactactactaaattagcgccgctcgactttttttttctttgacagagtcttgctctgttggtaggtgatctcagctcactgcaacctctgcctcctgagttcaaacaattcccctgcctcagcctcccgagtagctgggaacataggcatgcgccaccatgcctgggtaattgtttttgtattttagtagagatggggtttcaccatgttggccaggatgctcgaatctcctgaacttgtgatctgcctgcctgggcctcctaaagtgctgggattacaggtgtgagccact

SEQ ID NO: 614951 - DNA, 301 bp, Homo sapiens
  misc_feature (184)..(184): n is a, c, g, or t
accctaactagttcttatgtcctgtggtaagcctgagcaatagcagaagtcataagaatggcaggaaatatctttcttccacttgagacccattgttcagcatgcggcatcagtgctatgtttctgtttaacatcacagtgagggttacttctgctagcacagcgaacggtgatccagcttggnttcatgtttataaagcattcttctagcagttcatggggaccctctaaggccaaatgccttcagtaaaattgcttaggcgtcgacgcggccgcgaatttagtagtagtaggcggccgc

SEQ ID NO: 614952 - DNA, 149 bp, Homo sapiens
caggaagtcggggtagcgaacctcgtcgttgagattgccgtgaaagacctcttcctcatcatcccctgggaatggggactcgcaaaccagcatctcgtagagcagcacacccagtccccaccagtccacagctcgcgtgtacgacgtgt

SEQ ID NO: 614953 - DNA, 270 bp, Homo sapiens
agaatagcttgaactgggaggctgaacctgggagcttgaacctgggaagttacagtgagccgagatcatgccactgcactccaggctgggcaacaagggcaaaacccctctctaccaaaaacacaaaatttagctgggcatagtagcatacatctgtaatcccagctactcaggaggctgaggtgggaggatcaccttaggtggcaagtcgaggctgcagtgagccaaggtcttgctactgcactgcagcctgggcggtggcagtaagac

SEQ ID NO: 614954 - DNA, 1112 bp, Homo sapiens
  misc_feature (90)..(90): n is a, c, g, or t
  misc_feature (220)..(220): n is a, c, g, or t
tccaggatcatgatgtgcggctgggagctcgcgtccacggtgcggtacactgtacggtggtgtgccatcttcgcgggtgccgtatgtccnatgaaggaggatggactgagcacgatgctcaacggtgcagaccgaagaacagctagcgtacgttcggtggagctggactcccgcaacaaggggagcgacggtccgggtgcgacattctccgccccgaggncgtgaacgatgtcggccaactttcactcgggctagacgacgcacgggcctagtccatggtaagctgattctaagtggcattctcgcgagtcaagttcacagtgcctagtgttcctggcgtctagagtgccttccgtgcactttggtactagcggggcgatgcggctacttgggaccgcacgcactgtgcacgattcctacccgcagaggcccgcaagaagcagaacattgataccgacgcgtgtgtcgtaccagacgcttaccaaggccaagtaacccacgtgaacgcctacgggccgaacggaaccaaaggggggacgttcggacgcgcagcgaggcatggggccgaagggacacgacggcagttatgaatgcacccccgccgacaacagtggctcagcgggaaaagccggcagtgccaggaaaagctgacgggggggtcggggacggagacttcccctgggggacgcataactctgggcacgtcggaacgggacaaggaagcaatgggtgctacttttagcgttgtgccgctggtggtctcctgggtgcttcttcacttgtttgcctggtccactttttttttttccttttttttgtacatatttgagtgaccattcacatggtaaccattttggagatattttcctcgagatttacttgtttggtaatgggctaaacattccacataaaacggtttgtggtccggaaatggtggttcctcttcttttcctctttccgtttttctcctttattaacggattttaatggttacttttctggaagcacatgggattggagattcttcctttaagaaaaagcacaggggtagggtaaaaggtcaatgaaattatccttagggatgggtaaatgaccaataagtagatggggaa

SEQ ID NO: 614955 - DNA, 334 bp, Homo sapiens
  misc_feature (262)..(262): n is a, c, g, or t
cattatcttctataagcaaatcgtagtacatgctttacaatattaattactctggaagtttttgaactctgtatagtatcagatctcctttcttgatagtttcttggtactggcagttcttgtcttatcaggtctgttgttgctactatttcattcactttatctattttgcagagtaagtctcccggcagctataaagctggacaggttcctgatcaatgaattccgataaacaagatcaaaagcttctgccatatagccnagggttaatgaactatatgataccagcagctgactgtatgcgtgaatactcatttctcttacatagtatcga

SEQ ID NO: 614956 - DNA, 539 bp, Homo sapiens
gccgctctcccaactccaaaccctcgccgactcagatccagctaccccgcgcgccgtcggcatgccgttcactccgggcccctactctggcgtcagcaccctcgcccttgtggcgagggcgtcggccttcagcgtcggtgtcgtctacgggagcatcaagctctcaatcctcaaggcaacaaaacctaaaaaggaggaagcacatgctcatgctcatcactaaggacgatgggctgctacatgttaattcatgtggaaggatgttataaattggcagtgcacccttttctccataggtgcaatttggtttatgatttgtggacctcttgtctgtaacacacctgctgagttaccttagttttgtgtcataataaattcttatcaaatgacttgaaatcagtaaggaaggggaaaagtcaaaagaacccactcttgttttgtgaggttgcaaagttaggacatggcctcttgaatatcggtcacgaggatctgccttcctgattctgttttgttgcgacgatgtgcaatggatggtttct

SEQ ID NO: 614957 - DNA, 172 bp, Homo sapiens
tgagagagttttgagaactcagtcgtggatactgtggcataagtaataacgattggtggcgtatgacgttctatagcaaaaatatatttcgaacttgcaagggtaggctggagctaggtggctgagcagatagttaaatatagaagacttctgtgagccagttattaaacta

SEQ ID NO: 614958 - DNA, 1232 bp, Homo sapiens
tctcaggggtcactggaggctttttattttggagcacaaagacccccggggatctagccgggggccacccgcggaaaatgaacacgagaggctcacagtgaactctaaaacactggggggaagagggggagggcgagaaaaaacaaggactggggccaattacagcgaacggcaaagctagaagcggccaacgagggcctccaggggacgcggggcttctcaggatgaagaagtctcataagggaacgcgggtcacagaacctccacgggcggggggggggcggcataactaacgcaggggacccctggcgaaggggtgggccgggggggcctccagaagctggcctgagagcgctggacaccagagggggagggggtcctcgggtgtgacccaaacaggtggagaccagaagggaggtttggctctggccccaaaggtttaatctggggggccaaggggtgtgtttctgagaatgttcccttgggccgggggaatatttttaaagctctgtggtgtggccacaaggtctctctcttacatatttctagagaaagagagagctgggtgtggccactgtggggcccaaaagcgcgctcaagagatccggagcacagggggggggcaccacaagtgcttggggatctcgtggccacgtgtggcgacaaagcccccccaaaaacccaggggccaccgcgagatggaagggggagaatctctttaaaggtatcttccccccccgggaaacgggagtgagaatgaacccatccctgatgtggagagggcccccaaaaaacacatttgggggtgccccggtgtgggcccaatatcttttgagcgaacgcgcctttggagaaaaaaaaagaaccttcgggtgtaccaccggggagggccaaatttcggggggtgccaggccttttgagaacgccagcggcaaggccgcaatgtttcgacaagggaaatactccacaggaaccacacagggggccttggggggagaacccaccattggggggatggggacccctgtctggaaagataaatcccccaaaataacgcggagagattccctagggaacgtgggctgtgagaaacactttcggcgcaaaggtcccccccaaaaaacacccgtgggggaccagggggaggtcctctcgggatagacaccccgcgggcgataacctagggaaaaaacaggcactgtcccacagggccacagcccaatctgggtcag

SEQ ID NO: 614959 - DNA, 106 bp, Homo sapiens
ggatttgctggtgcagtacaactaggcttaatagggctcgaattcgaggctgaattcaagcttttaacgttagaagcttgaattcgagcagtagtagtagtaggcg

SEQ ID NO: 614960 - DNA, 202 bp, Homo sapiens
gtcacatgaccagctaccagatcttttatgcagttcgacgtacaaggtgacatcaaggtacgacaaatgaagtccagtttggggcctccatctccctccccggagtcctgatccagggagtgccaaaaccagaaagagctggggtagggtgctcgatcatggggaaggctgtaggggttcgtccggcagatggtcgtgtgag

SEQ ID NO: 614961 - DNA, 1276 bp, Homo sapiens
tcctccatttaacctttttaaatggggtctccaaaattctgtgacaaattttgggccaattggttcccattaaaaagttacgtgattttaaaaactaattaacttaaaacgtgccacacgccaaaaaaaaaaaccaaagtgtggctccacaaaacatttcctccttttccttcgtaaaggtttacgatgcatttgttactcattacccagttcttttatacttacttaaactttaaatgtggccaattgtgaacacaaacagttctcgtgagacaccgttctctttccaccacgtgatttaaaaggtggggtgtgcgcaggtctatttaggggaattaattattctcacttttacccttttcgtggagccttttcgtgggggcaagaatttgtgggtgcaccttgtgccaagcctccaagcaagcccttttcttgtgttcccatgtgctttgggagtgaacaccccaacgcgaaacacgtggtcgtgctcctcaattatccacgaaaccgagcaaaagggagacccaaaagggcgtgggatatagttccgttgaaaaaaggcttcctcaaaccacacatgtgggcgcttgtgcccggaggaaccccttttttcaccccaatgtgcgccaggaatcttcaccacaaaacctcttcaaacagaaattttttagggggccaactctctccccacgctttgtcttcaccccacgacacggcggaaatccactcctttttttcctttacaggttctcagccaaacattttgggctttggcacttgtgttagaccccctgtgtcggggcaactccccattaaccggggggggcttttaacgcccgggggcttaattttggggcctgggcgattggtcccagggattaattcacccttggatgccagttgaaagcccaagcattgtctacccatagggggggcccacaactttatgagctggatcccccaccaatcgttgtgccccgcgaaaaaaaacacctgttagacgacacccatcttttgccaatttataagccccattgtcccccagaaagagcttctctcaaaagcgttcagggcgactttccaaccgaattatatctcgggaaaaccgtatcgtgggacatgtgtaccccacacccggggtggtaaaaccacagttcactgggcgagagaacatgccactaaccccatggtgaaacttcgcaaaagacacaaggagataagagagacgtacagggaaacccaaacaccgaggatcgcagtaagaccatgaacactc

SEQ ID NO: 614962 - DNA, 1804 bp, Homo sapiens
aactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagggcttcgtcatggtgctcaccgccgagggagacatggcttacctgtcggagaatgtcagcaatcacctgggcctcagtcagctggagctcattggacacagcatctttgatttcatccacccctgtgaccaagaggagcttcaggacgccctgaccccccacctcaacaccagctccctgctccccaagccccaaggaactgtctccttccttgccccctcatacccagtccccagatctttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgtgtgtgggcctgatctgcatgtgtggacaggtgtgtgtgtgtgtgtgtgtgtgtgtgtgtgtgcgtatgagcatgcatgtgtatcatgcataagtgtatgtgagggagtgtgcacgtgtacacatatgaggaatgtgtgtcaccatgtaaatgccggtgtgtgtgtctgcatggacacaggtatgtgtatgggtgtgtagactgttaattttttttttttttttttttttgcgtgaacctctgcttaagtggattgttaattcaaattagaaaggggtctttatttggcctggcatggtggctcatgcctgtaatcctagcactttgggaggctgaggtgggcggattgcctgagctcaggagttcgaaaccagcctgggcaacatgacgaaatgctgtttctactaataataccaaaaattagccgggtgtggtgacacatgcctgtaatcccagctactcgggaggctgaggcacgagaatcattagaacccaggtggtggaggctgcagtgagccgagattgcgtcagtgcactctggcctcggcaacagagcgagactctgtctcaaacaaacaaacaaacaaacaaaaggactctatattcaagttaaaataagaagtgtaacagaatcatggggtcttttttgctttttaaattttgatgtggctcacacctgtaaatcccagaactttgggaggccaggggaggaggattgctagagcctgggggttcaagaccagcctgggcaaagtggttaggacccattctc

SEQ ID NO: 614963 - DNA, 325 bp, Homo sapiens
ggaatttgggacagggtcaagaccccacacactttggacaaagtagagggcaccctctatatacagcctctttctctttagatcgacttattccacaggtgtgtgtctccgcgatacacacacaaatgagggtgttcaacggcacaaagaactctgagagagaaaagtcaaagagcctaggcttatggctttgtttgcttcctcacagtggcatttagagtgatgtcaatttgtgaggcagacccgtatctcgctgtggttccgctcctcttctgtggtttgcaaaccacagggcgggttaagcttgggcccacgacccggagtt

SEQ ID NO: 614964 - DNA, 192 bp, Homo sapiens
tgaatagtctcccttttaaactgtcagatgtagctaaagattcttcatatttatgttgatcttttcaatgaaccaacttataggttacattaaagagtcagctgtagtcagtaataacttttttagacccacacaatcaggtacacacagtaaaaaagcaagccagcttaagcagctgagaggaactggtct

SEQ ID NO: 614965 - DNA, 101 bp, Homo sapiens
cacttgcctccgaccaattcgtattgaaatttccaaagctgtccaaagtaaaatctccctcggactgcgaatcgttcccgaaaatgagcgtaatatatttt

SEQ ID NO: 614966 - DNA, 268 bp, Homo sapiens
cggctggaccgcgctgcaggcatccgcaggtggcggcaagatggaggtgacgggggtgtcggcacccacggtgagcgtacatcagcagtccctcggaaccgttccgctccgagaagcgatacaggcctgaagctcagccatcggtgaggttcaagtgtaacgtggagttgctggtgggcagccctgttcctgcatggaacgtggagctgtattggagttgacgacaaggttctacagcaagcttggatcaagaggatgcgctcctggg

SEQ ID NO: 614967 - DNA, 198 bp, Homo sapiens
gggctcggctgcccaagaatctagaccatgggaaaaatgtgaacgaaggagatgggtttgaatatttcaagtcagcaagttgccacacatccaaaaaacagtggggacggggagcaaaggccccaggagggaggccggataaccagggttggaaggtacggagggaatttttaggatcatccagggccatattccaca

SEQ ID NO: 614968 - DNA, 119 bp, Homo sapiens
ttagcttctgagtagctgggacacaggcatacaccgtgccagcataatttttgtatttttagtagagacggggtttagccatgttggacaggttgatctcaaactcctgacctcaggtg

SEQ ID NO: 614969 - DNA, 326 bp, Homo sapiens
  misc_feature (165)..(165): n is a, c, g, or t
tgagttaatactgtactacttcacttaaaaggtagaatcttcataatcatataccctcaccctattcctgatgccacagttgttgtatgtattatattaacaaaagtaataagcctcagcacacaattttaatatttgtgcttaaaatggttatatatatttganagacattaagaggaaaatattgaccttaacatttatccacatatttaccatttgtaatgccctttcctctctgatgatcagatatctatttgatactgttttcttcagcctctacaacagcctattatcattataggtatagggtctgtctgtggaaaaaa

SEQ ID NO: 614970 - DNA, 155 bp, Homo sapiens
gggtgatctattgctcatcattatgagaatactggtcttcctgccttaagttacattcgtgcttccgctcagattcggatcatggtccattagagagtgttcgcagacatcgtttctgaaagattagagaataatcccctcgccaagtagcctgt

SEQ ID NO: 614971 - DNA, 1441 bp, Homo sapiens
  misc_feature (878)..(878): n is a, c, g, or t
  misc_feature (891)..(891): n is a, c, g, or t
  misc_feature (1176)..(1176): n is a, c, g, or t
  misc_feature (1189)..(1189): n is a, c, g, or t
  misc_feature (1232)..(1233): n is a, c, g, or t
  misc_feature (1248)..(1248): n is a, c, g, or t
  misc_feature (1419)..(1419): n is a, c, g, or t
  misc_feature (1438)..(1438): n is a, c, g, or t
gattcgccagtgcgccactagttttggtccttcttaaggggagacaccccgaagtctattggcgaatttatctatcttgtataaaagtaaacaacttgtgggttccagtaattcaaccatggggcctttcagaggttgacgactgaaggggccaagtttttctgttgataagggtggcaatatgcctattcgcgtggtcgatttgtgccctgcgaaaagttgtgggggcccgtcacttggagtcgcacgcagtaagaggataatcttggcgctttcaggcaggagttaaacgccatttggtacccggtggaccatggagtgttagcccttggggtaaagatccgttggtaatttgtagaaaaaaggtacccaagaagggagtatgcagtgtagagctttcggaaggcttctcgagactgtgatgtaactacacggtgccgatagtgattgaagtgacacggaaaagtgggtgcacgagctgaagtgtggaaggggttcctaaggactgagggttgtatctgaaccctgttaccatcaacaagttctgcaatagccacatgtttgggagccccccccagagcgcccgggcctaacctgaatatcttctaatgagtttttgtgaatactgggttggtgaatataagtattgcagttagccaactgcacggtagcccggaatttggcaataatttggagagttgagcagcgcttagcacatttgctgaaacgtcagcccctcggttgagctccccttgagccaggttccaatctgaaatcggaatttgcaattcaaacagtttaaatgccaacccaagtaggtctgaactaaatgtataaaactcagcgccgccgccgccacccctaactttcaagggcanctgctcggggaanccggtttttttttttggccattttgcaaacaaaaccaacccacacccgttatcgcagagcacccaaggcccatggcaacttggttccacaagggagagccttccaaggccatattgtcagtctaattaatatgagctttttttttttttttcagtgctgcctatgtttccttgtgctggtagaagtggtggcattattaaggttgctgcaaaaaaaaaaaaataaaagaaaagaaaaaaagaaaatccgaaacacccctcccccgaaccacccccaatatgctgngtggaatgaatcngcatgttcctagagtttgtctcccttttttttcgtcatcatcnnttcggcaggagtcantcgtgtgagaggcctcagtgtagagtgcagcattgggaccttttgaaaaagaccaaaacggaagttttctgacttagagaaactggtgagtctgaaggagaggaagagtgacgaagctacaacgagaaatgacattcgcttggataatacacctttcatcacacaggtacngtttagcccccagaggccngcc

SEQ ID NO: 614972 - DNA, 412 bp, Homo sapiens
ctactactactaaattctgcggccgctcgacgggtgacacagcaaggctctgtctcccaggctggagtgcagtggtgcgatctcagctcactgcaacctccgcgcctacgggttcaagtgattctcctgcctcagcctcctgagtagctgggactacaagggtgcagcaccaccacgcccagctaattttttgtacttttagtagacacagggtttcaccgtgttagccaggatggtctcgatctcctgacctcatgatccacctgcctcggcctcccaaagtgctaggattacaggtgtgagctgccacgcccagcccagaaggttttcagtggactttgccagatctctcagaggaatcactatctatggcagctccagttaagtaatgtatttcgtcgacgcggccgcg

SEQ ID NO: 614973 - DNA, 124 bp, Homo sapiens
acatttcaacaatagcctggcgtagcctaaccgctaacattactgcaggccactactcatgcacctatatggaagcgccacctagcaatatcaaccattaaccttccctctacacttatcatct

SEQ ID NO: 614974 - DNA, 819 bp, Homo sapiens
  misc_feature (312)..(312): n is a, c, g, or t
  misc_feature (439)..(439): n is a, c, g, or t
ggcacattaagatcacagtacttcgggctgtgcaacggaggggatcaaggtacggtgccaccatgaatgaccttttgcggcagcacctgagtacctggcccccgaggtgctcggatggacaatagactatcggccgtagcagttggactgggtgtgtgcggctgggccgtggtcgatgtcactgtagactggatcgtgcgggtcgcctcgtgcccttcgtaccacaaccaggcacctagtgaggaagaccttcttcccgagctccatccgtcgaactgggagcgacgatccggcgttctccgcggctacgcntttggatccgcgtgaggcgcaagctccctatgacatcttgcacggggcatggcatcagaggatatggagctccctaatgcctaggtatggcctttgggccgtgtgtggcctcccgtagcgtagccgncctaaaggtagaaatccaatgtcagacgagtcaggcatatcctttcttgccctgggtatcggttggttggtccaagctagcagtggtaactacgcacacgaacgcgtcagactcgcgatcccttgctaagcgccccaggtctagcgtcggcacgacgtgacacgcaggtgatttttgagtgagcgcagttcgcggtcccagatgatcaccatcgacacctgctgaccaaggattgacttgccatggacgttgttgtcggcacagcgagcgcaggtccccactttcccccagggatctcctactccgggcattcgggacggctgaagcggcggtggactgtgcttggcgagaagcctgggggggttgggatgggggcttgt

SEQ ID NO: 614975 - DNA, 106 bp, Homo sapiens
cgtcaaaggttcattggtacatgctgacttcttgtatctatcggctacttccttcttgagatactgtagtgtgtcagctaattctatatggaacgagttggacagc

SEQ ID NO: 614976 - DNA, 274 bp, Homo sapiens
gtcgaccccacgggcttttaagtcttggaagcacccggtccatgactctacggattccgaggttgctacctgcattcccagcagttctcggtagccgtcgttgttgacacctgtagccaccagcacactggttttgaccacacgccccccttcgcgaactttcatcgtcagtgcgtcacaagacaggtagtaatacggacctgaatccagcggccgggtgcggaagtcttcgaccatggcgtcgagttctttggccatgtcagatacgtcgacg

SEQ ID NO: 614977 - DNA, 189 bp, Homo sapiens
attaagagatagctcactggaactcaacttcacgagctcaggaatcctcccattctgctcctgagtggttgggactgcaggcacacatgcaccaccatgcctggctaatttttgcattttttgtagagatggggtctcgccgtgttgcccaggctggtctcaaactcctgggctcaaccagactgcctg

SEQ ID NO: 614978 - DNA, 498 bp, Homo sapiens
gctggagaaactcacagtcatactgaatagccgtacttgacgcttctgaccacaaacttcaagggggcgctcagcttgcccagtaatcttactatatttctctactaaattcactgcgccactctccagataagtgtttcacatcttctccagccctcaacaccctcccttagtttctcgctgttagttaaagatcttgcttcttattttgctgagaaactaaatgtcatctgctggaacgtacgtgcctctcaccatcagatctcccagggtgcctgcatctatgcccgctgctacctttcttcctcacaatggatgcatgcatggatagatggatggatggatggatggacggaaggatagatgaacagacggacagatggatggatggatggatgggtggacagacggacggacggacagacggattgatggacagacagatggacagatggatagatggatggacagatggagggatggccttctcttgcatcc

SEQ ID NO: 614979 - DNA, 306 bp, Homo sapiens
agggagttgggagaccaactggccaatgtggtgaggacctgtctctacaaaaaatgaaaaaattagctggtgtggtggcaatcactgtgtcccagctacttgggaggctgaggtgaaggatcactcgagccctgcaggtcaaggctcacacttaccgttatacttctagagatgcaggaggtacaatcgttagctattctatatatcatatgaccactcttggattagcactagtttaaaatgctatattcctgtcatctattcataagaatgccagaattcctattagaactaacctaagacttc

SEQ ID NO: 614980 - DNA, 146 bp, Homo sapiens
gcgcggtgtctgagcgtgcatcatggtggctacacgcccggatattccatgtactgtggaggctgaggtgggagaattgcttgagcccaggaggtgcaggctgcactgagtcaagattgcaccattgcactccagccggggtgaca

SEQ ID NO: 614981 - DNA, 196 bp, Homo sapiens
gctggtacccggtagagcggtctcatcccctgtgtgtggttggggggtcagctggatggggaaagcagtccaaaagtcccagttagtaaagcagccgaccctgaagaaagcactttcctttctttgtgtccctttaagttttcatttcccttttgagaaagtggtcagttcttgagcgtctcatgattttcatgcc

SEQ ID NO: 614982 - DNA, 332 bp, Homo sapiens
  misc_feature (84)..(84): n is a, c, g, or t
  misc_feature (230)..(230): n is a, c, g, or t
  misc_feature (274)..(274): n is a, c, g, or t
tggagacgcatttcgctcgcacttgtcacccaggctggagtgcaatggcgctatctcggctcactgcaacctctgcctcccggnttcaagcaattctcctgcctcagcctcccaagtagctgggattacaggcacgtgccaccacgcccggctaatttttgtatttttaatagagacagggttttgtgtggggctggtctcaaactcccgacctcaggtgatccacccanctcgacctcccaaagtgctagaatacaggtgtgagccacctagnccagccgtaaattttaacttatataaattatatctcaatattttcaaaagggccacct

SEQ ID NO: 614983 - DNA, 1175 bp, Homo sapiens
gtgacatctcaggctgatttgtgctgtcctgattgttgcgtgctggtgttggtggaattgtgaagctggtatctccagatgaatggtgcaagaacccgagtagcatgccgctttcatgggcttacacacctgggctgtgaacatcagactaatctgtcggctgctttaatgaaaagtggattccactgagccacccatacagcacagaagtagatatgagggcagattgttcaacggcaagtccagcactttacgtgtataggaaagattggcctacaaccccgtacacatgttagcatattgtgcgcaatctttctgtgttggaaatggtgatcaatcaatgcctggaagcctaatgatgcttaacgattgctcttggtttcatagggagtggagaaggtcactccgtagaggatggctaatagctcgagctggaacacagctgctgcattgatggctctgggaactggtactcacttactcgaccaagcgtacgtccaagctgtacaaagcacctatgcgtcctgctctctccagtgatgtctactaaacattggtaggtattggtactgtgtcctgttggccgagtggagactgtgagttctcaagatccgggtatggtggtcacctttgctccagtcaacgttacaacgggagtcgaatctgtcgagatggaccatgaagctttgagtgaaggtcttcctggggacaatgtgggcttcaatgtccagaatgtgtctgtcacaggatgttcgtcgtggcaaggttgctggtgacagcaaaattgacacacaatggaagcagtggtttcactgctcagtgattatcctgaacatcaggcaaataagggccggtagcccgtttgggttgcccaggtccaattggttgcaattgtgaagcctagggaaaattagcgccgtctggtgaaaacggggaagaagggccgcaaatactcggaccggggagacgggccagtaggaacagtcacgggacccccatggttgcagtcagtcccaaaataacaccggcagcgacagtcagcatgtaaacacatgggggaggtaaaaagagcaaaaggtgcgagcactaagcgagaaaaaggagaaatagacacaaagacaaataggatagactaataggtcgcatgagtgtctgacatacatctatgatgcggc

SEQ ID NO: 614984 - DNA, 320 bp, Homo sapiens
gaatttgcccacagaaccctctaaatccccttgtaaatttagctgtttagttccaaaggggaaccagcctcttctggaacactaggaaaaaacccttgttagagagagtaaaaaatttagacacccattaggtaggcctaaaagacagccaccaattaagaaagcgttcaagctcaccacccactacctaaaaaatcccaaccatatacctgacctccgcacacccaattggaccatctatcaccctatagagggacctaatgttagtatatgtaccatgaaaccattctcctccccataagcctccgtcagattaaacc

SEQ ID NO: 614985 - DNA, 241 bp, Homo sapiens
ggcagggactgggaagagacaggctgagaggtagcaagggggatcatttaaggtctcactagcaattcgaattatagactttattctaagaataatacaaaccgaattaaaaagcaaatagttggtaacaacctataatagttaatatttgtaatacatcgagggtacacaaagtgaaaagaatagctcataaaacggacatacgattgacagtgagtgtcgcacaactggtcgacgactt

SEQ ID NO: 614986 - DNA, 90 bp, Homo sapiens
gggggggggggggggggggagccttcccggggcctccccttccctggtgaaggggttttggagagaaacaataaagagtttcccccccca

SEQ ID NO: 614987 - DNA, 1358 bp, Homo sapiens
ttgttttatgttatattgtttttggatggatatgaagatagattgtaattgttatagaagtattatttatggaattgtatatacttcatattcattaattgtatcttagttagtgtgttttttttgtgttgtgttgttttttgttttggttgggatgcgaggctattatttgtataatattaagtgtatatgtgtatttatatttctgtatagattatttttatttttggatgacgatataatgtagttttattaatttatatatttaagatttatattgtatgacttatatatataagtaagtgggtaaggtaatatgatagttattatgttttatttttgtttggagttggagtagttgtgttatggttggtgtctacttatgtatcttgtttgttgatggtattttttttcttgttttctcttttgttgtttgtttatgtgtattgtaatatttcttgttagtattatatatgtttattttgttgtgttgttaattaattttgttggtttgttgcgttgatagtatcatatattatgtgtgtgtctgtactatttattttatctagttgctcattggtatggagttaagatgatatttatgatcttatttttatttataagtattgaattagttgctcttgttcgtccttttgcgtttttctctcttctctttctcttgtctgtctttgtctcgcctcgcgctcactctgttttgtttgtgttctctctcgcgctctctcatttcttgtgtgttgtggagtagggggtgtggtgttgtcgctcctcctcctctctcttttattactcaattgttctatgtctctgtcgtctcctcgctctctctgtctgttcttgttatgtgtgtgtgtctcgtctctcgttctactgctctcctctgctctctcactacacacacacacacacataatagtatatgatgtagtatataaattataacacacagagactctcgctcgctctctcctctcctctctctgtggtgtcctgctgctgctctctctctctctctctcctcctctcctccctccgtccccgtcgacgatactgacacccgcccctctctctcctcccgcgccctctctctctctctctcctctcctctccttccacattacccacccctctcctcgtttggtgcagcaggcaggattctctttttctattatgggtgtgtgtgtggtgtgtgatgatatatatatatatactactactactacacacacatgccgcccgccccctcctttcttgtctctacaagatatattttttttttgtgttttttttatatataagaggcgcgcgccgcccctctctcttttttttttttgtggtga

SEQ ID NO: 614988 - DNA, 230 bp, Homo sapiens
  misc_feature (89)..(89): n is a, c, g, or t
  misc_feature (101)..(101): n is a, c, g, or t
  misc_feature (149)..(149): n is a, c, g, or t
  misc_feature (155)..(155): n is a, c, g, or t
catactgaagacagcaacagaagtcacgttcagggactggctcacacctgtaatcccagcactttgggagatggaggtaaaaggttctnttgagcccaggngttcaagaccagcttgggcaacatagcaagactccatctcttaaaaantaaaantagtaacattagccaggtgtagcagcacacatctgcagcagctactcaggaggctgaggtggaaagatcgcttgt

SEQ ID NO: 614989 - DNA, 1475 bp, Homo sapiens
  misc_feature (1015)..(1015): n is a, c, g, or t
  misc_feature (1023)..(1023): n is a, c, g, or t
gtgattgtgtgttacaaaaaagggaataatgtttttgtttcgtgcgcgcggggggcacaaaaaacagatgttgttgtctgggggggggaaaccacggccggcctacatataatgtgtggccccccccgccccccccaggtggggtagtaaacaccaacaccctgcgggttttttgtttcatcctcttgggttgttctacacgacgaggggtagttttgaatgtctcttgggttggacccccaccttcgtcctccacacgcggcgctctccatcaatatattagggtcgtctcccctgcgcgtcttttatagctcccccccccccggtgtgtatttttgtgggaatattcgcccccacccacacaacagggggggtgtctccaccacaagagtgcgcacaatagccctcacaagagtgttgtggtcgcgtgtggagaagcgcggtgagaagaggggatatatagaagagtagtggtgagtctctccccgcggttgttgtctcggcggggatgaaaaataaagactgctggatgatagagtagggcgcccccctcctctatataatgttcttcttctggagaatagtattctcggggggtagagtatagtctctggctccactctgctgtgtgagagtaatagtagagcggtgtgcgtcttctcggcgacacaacgggcatcacacagtgtggtgtgtgttgtgagagagagctttgtctctctcgagagactttactactcgcacaccctctctgtggggtgtcgtctctctgtgtgtctctgtgtgtctcgtgagagagtatagagagagacgactacacgacgacactactgtgtgtccgggggggggtgtgtgtcactctcacacagcagcacacagctggtggagacaccacagagagagagtgtgctgtgctgcggggagagagctgcgcgcgcatcacagagtgtcacacaccacacagtgtgctgctgcgctcccacagcagagagagagctctgcacagagagagagngatcatanaaaaggagagatatatatattattctctctcttatatacactctctgtcgcacacacgcgcacacgctgctgttagtatactacacaggtggggtgtgagagagagacacagggtctctcacagagaccactctgtgtgtgtgtgtgtgtcacacatgtggcgcacactgtatgagagtgtgtgagagtagagtataaaagagactgggtgataatgagagaaccacacagcacttggtaaacaccctcacagagaaggagaaagagagagagaatatttttggggagacccccttgggtttttctttttggcgcgggggcacgcttttataaggtatattatgttttttaaaatccgtgactttttataatgggaaaccacacttgagccccaaaatttgtcacccgagaattttgaggagaccccctttaaaaaagtttaaatgaggaaa

SEQ ID NO: 614990 - DNA, 106 bp, Homo sapiens
tctacaggatctctgtgctttgggacggcgcgagctcagtgataagaagcggcagagacggtcgcacccagttcaagatagagcctcctgcagcttgtggagatcc

SEQ ID NO: 614991 - DNA, 416 bp, Homo sapiens
  misc_feature (327)..(327): n is a, c, g, or t
  misc_feature (359)..(359): n is a, c, g, or t
  misc_feature (376)..(376): n is a, c, g, or t
  misc_feature (385)..(385): n is a, c, g, or t
  misc_feature (404)..(404): n is a, c, g, or t
cttgtgatagaagtagcatgttgctgccagaatacaagcattgcttcgggcaaattaaaatgcatgtcctttcttaatacactaggaaggagaaataaagtccacaagtccaagcctgcactttcaatactttttccatgcagagttgtgcacatgggagagggtatccggtttgtccagtgattgttctttagagagttggaccactatattgtgtgtttgctaatcattgactgtaagtcccaaaaaaagcctccgtggaaatgttaatgccctaatgtaacagcagagtaacattaaaaattaaaactaccattttaataaaanccattaataatggccttggtaacaatggcatncccatatttttaaggancagaatttnctacttttgaaaggctttngccgtttccccg

SEQ ID NO: 614992 - DNA, 816 bp, Homo sapiens
ggcggctctttgttgtcaccctcggcgtcggggcattaacaatatcttcgtcattcgcgctgcggcaggctcgcctctccgcttttttatttcgtgttgccacacttccggcaaaaccttttatcgggggccccctccgctcttaacaacgcatttcgggggggaccccccattgattgaagggagggactctcaagtgtgtggtgtcgcgctcgttattagtgggtgccacccgcaccacatagaggggtcttccgccacactgtgtgtggccccccgctacagcatttctctgcattctttcggacagttactttcctttatcaaagaatccccaagccgtctattggaagggacacaagagaactaatgggcggattctcttaggagagtaccgggcgaaggagtcttctcatacggtgcgctcacccggaattcgaggcgagctgtgcgagttaggagcgtagataccacacagatgcacgctacgatagtgggtggagacaaacaactatttacatgtctcctccgcacccttcttcagtgcgtcaaataaattggaggaacccgggaatcttttataaattagttctccacaatgcctacaaaaatgcagtcgtctttaacattcttcccccccccaactaatacgcaattaaatgttttacactgttctgtaacaacaactgggctgctcctctgattgtgctccatagcaccgctgtatatactccggtattatgtcaacatgttcccgctttttgccccacaaaaataaatccatgtttctatcagtactccaccccatcattaaca

SEQ ID NO: 614993 - DNA, 813 bp, Homo sapiens
  misc_feature (371)..(371): n is a, c, g, or t
atcataaagatcatttggataacaataataataacagatatatgtatgacacgtctacatcatctgaataatggtgaggcagaatgaccatctattatagaaattacttgactctgataatgcctgtggtcgatgtgaaagcgaattgacacctgacagaagtgactgtatgaagatttgagagagtgatgaatgattagagtctaggacatgctcaggaggttaccttgggtagtactttgaattctgaaaaacgagctcagtgtcgagggaatgtactaggcaaatgtgttctgacatgaaatgagagctgagaggatgcatggtgcttggtgaggttcccttggtgccagccctgcgtcccgaacaangcaatagaccttcaagtcgaggagtgccgttaggcggtcaaagaggggcgtccacggttccaagtctaggtctgctcctggatatcaaactctacttcaacacattcaacagcgaatgccatctcacatagaagctccaagattgacacgtaatcctgttgctaagcaccgggatattcactgcatttatccaatgaaagaatgtagagacattattcaattgtgtatgatgactatgattctgtatatcaacattcatacaatagtggcatggttggatttaagggatttctggaaaggatgtcaaacttgtgacatggtgagacgagagaagctgccgtaataagtgaaagccacaggttttgatgctctgagacgcatcaatgtgcagtaaagactgtgttgccagaggggaggtgcagtcagacacgagtcactgtga

SEQ ID NO: 614994 - DNA, 118 bp, Homo sapiens
tcatcaacccttaaaattgtgccatttaaaaagacaattagacccttcctcaactcatgttcacccaagtgcagaggaccagctctctctgcgcgcctcaatatgtcctggtagaggg

SEQ ID NO: 614995 - DNA, 294 bp, Homo sapiens
  misc_feature (191)..(191): n is a, c, g, or t
gctactcctaccgtacgtttgtgctccttatctcgtcaaactgaagagtatattgatagcacattgcttggtatgaagattacatacattatcatccacttaagtgcttatgatagtgcctgacatcttaggtctgtcgctcatagcctggctgagtaccgatgctcgaagttcatagctcgtggctacantatctttagcagtagatgctgaacaccctggtctttcagagaattggatgcggtcaaagcctgatcccggtcacatcaaggtcacactccacctttcatgtgc

SEQ ID NO: 614996 - DNA, 927 bp, Homo sapiens
gtggagctgtcgccatgaacgtcgagctgtgcagattttaggcgtggtacaagatctaccccgggacacgggaggctgctagcgctagcgtaccgacgggcaaggttattccagcttctcttaagtgcgaagatgcgagatcggcttatcctttccaagaggaatcctcggcaggataatacctgtgtacttgtccctctacgagaagggaagcacgaaaagagggacagtactggagaggatagagttcaagataggaaaatgaaccccgccgcagctagtcatggttccagacggggccattactggtgcatctcttgctgatataatgcgccaaggatggcacatcacgaaaactcggaaagttatgaaatggctcacacgagaactacgctatcaggggctgctagatggagagcatagataagagggctatatgcaaggcatctacatatatgacctcgtcgataggcattgcatgactaagggcagccctagcataaggcaggcagcctaatgcataaagattgtgaatgcctgtgaaaggtgttcagctgcccgagtggggtggagaaagcttaaactggcagtattagattatttagacagtaaatgattggagttagtaagctctatacactgaaactgtggattataattgcattgaaggggctggcgtcagaaatacattcttctcgctccgggggacctcaagtagttgcgttgaacgccggggtactacttgagtcagaagctggtacccgaaattctggggtcggtaacaacaagaagcattagagcccttgggccagagagtaaaaaaagccttgactgatgggcaacgtaacggagagtattgcgaaatgccttagcaatgggcccggtacctacgagggcggagcaagttgctggcactcgggtccctga

SEQ ID NO: 614997 - DNA, 342 bp, Homo sapiens
ttttttttaaggtatgatcttactctgtcacccaaggtaagagtgcagtggacaatcatgattcactgcagcctcaacctcctgggcttaagcaatccttccacctcagcttcccaagtagctgggaccacaggcatgcaccaccatgcccagctaattcaaaaaaatctttttgtgcagatgtggtctcctatgttgctcaagctggtcttgaactcttgggctcaagtgatcctcctaccttggcctcccaaagccaagacggaataccgccactggtgctagtgcgaactcattctaagcgaatcggcttttaacccgcgtcgataacggttggcccct

SEQ ID NO: 614998 - DNA, 949 bp, Homo sapiens
  misc_feature (282)..(282): n is a, c, g, or t
  misc_feature (891)..(891): n is a, c, g, or t
ctgagctcccctcctgcctcgagaagggcaggtcttctcagagtgcttggtgggaacaagaacggagggaggggatctgcgctgagatataaaagccggttttcggggctttatctaactcgctgtagtaattccagctgagagtgcagagtggagcgagctggggcaggccaggcatagtgagtgtgaagaagcctgggtgctgagacagagctgaagactgcgagagctgtccttgggagaagtggagatccaggagacgaaataggggagcttacagcnctcatggacccagccctcccagctgatccacccagacacagacgagtccgcaaataccattgacactgcaaatcacaacagaaaaacttttgcacccactagcaaacagtggctggtgcaacatatttgacactgtgaacttaacaacaccactgatgcaataggacatgctgacactctcccagaactgcggggtgggcaggagcatatatcatatgccgcaattttaggtgtgacaacatttccccctgacaaggaattgaccaagggaacacacagacatatacatactatgaaaagaagggctactaacactatgacaatgacttgacttaagaccggctcggatattaaatatacagggagtaaagattgggagaaaaaccagacaagaacttccccgcaagacgatagcgcacccttcgaacgataaagcatatcaaccaaacaaggaaactattgaacccttcgtataaacgaactacggatagaaagaccgatatatctaactagaggacgaaaggaggacgaaattatattaccagacaaaagaaggaagagacgagcttagaagaccccgggagcccagcagagggatattggaaaganatacgaagctgatgtgaagagaggacacttaaacccaaaaagacagacaagaatagac

SEQ ID NO: 614999 - DNA, 1355 bp, Homo sapiens
ggggggatatgatcggccggcgaaatcgtggttctcgttttcctccttggctgtctgcaagcatcagatcagcccatccatgcaacgacaccgtcaactatccgccactcagcacacagttccatgcaccttataccgcactcacttccagaggcaaaccacaatggtcaattagcatgatccctatccaccccagtggacaaggcgcacaagtagccatcacagcaccagcacacattccaggggcaccacaccactcagcccacacaccatgtacgaagcacacaaccgggcatggtcatctatatgtcatttgggattcaagcacactcaatattaaggataggttgcgccaagccaccacacttggcatctggggcacatgcattttcatgcaattccccatggcattcaatgtcaaaaggcacaaaattgcaaaccgcaaaccaatagcacttggcacagcaccctgtggaccctaggtacatagcagaacaggaacacacagcaaccctccaacagaacaacgccaacgcgcaccacgggacacacagcccaagaacaacaggccatggacacgaccaacgttcaacgggaggaaccgtcggccacaaagggccccacatggtcagggagcgcctgggaacaacaagacgccccgaccagggaggcacaacaaggggtggcatggacaaaaaaggcactggaccacgccatggtgggacccaacaatggatgagcacttaaataaccggagacagcacaccacatgaaacacacacacactaacacacaccacgacacgtggccgacacaacaacaacacaccgaacacaacacaagccacagcagaaaaacaaacaatgatactgacagaacacaagaggcccacaacgaagaaaagcgaatgaacagagaaacaaaacgtgaagagacagacaagggagcacaaagagagggaaaagaagaacaatgacacacacgcagcgtgtaacccaggagaaacaacgggagacaacaaccacacgaataagagaaaaaagaacacaacaaaaaacaaccccagtgagaaaaacaaagagagagagcagagacaaacaaaaagaagagcaaaatcgaagaggacacacaacagagaacttaccacaaagagaacacacaacaaagaacaacaaacaaagtaagagacaaacgcacgaggaggaagaagaagaaagaaaaacaaacacaaagaagacagcaaaagacacaaaaaagacaagaaacaaaacaagaggaaaacaaaaaaagaagcgaggaactgaaccaaacaccaaggaaacaacgaaaaagacaacaacgaaagaagcaaagaa

SEQ ID NO: 615000 - DNA, 279 bp, Homo sapiens
ccatttattattcagtacatcatcatcaaagatgctttcattagcagatataagtacacttgataattacatcttcaaaatacattctgaaatgttgatctcggtttttccttactttctgaaacgatatactttacatgtatattgttttacccgtttactagacccacattactcacatattaacacttttggtcaaacctaccaaccaaacgactgtaacctgcttcacatacaccttgcctactagataacttcttcctacgccatgccactctt

SEQ ID NO: 615001 - DNA, 235 bp, Homo sapiens
ctgcgcccgctcataaggtgatggccatggctaggattatagatagttgcgtggttgttgtaaatgagtgaggctgtagtccgaggaggttagttgtggcaataaaaatgactaaggatactagtataagagatcaggctcgacctttagcgcagtgtatgcatattatttgatccgagggcagtttgattaggcattgctgagctgtagtaacgccaggtgtggatgagatatt

SEQ ID NO: 615002 - DNA, 114 bp, Homo sapiens
agaattgtgtaggcgaaaggaaatatcattcgggcttgatgtggggagggtgtttaaggggttggctacgtatcattgtctgggtcgcctaagaggtctggtgagaatagtgtt

SEQ ID NO: 615003 - DNA, 603 bp, Homo sapiens
ccccccctaaccccttttttaatgccatccaggggggggccccagtttggggggggggggttggaaaccaaaagcaactttttttgggggggaataccccctttttcccaaaaaagggggaaatttgttttttttttaactcattaaaaaaaaaaggggtttgttgaatttccccccgggggggaaaaacatgggtttggcctttaaaaaaatggcccaaaatttttaaaccctttttttggtgaggggaaccaaacccttttccccggccttggaaaacttaagggggccctcctttgggcccccggaggggccaccccctttgttgaaaacctttgggtggcccaatgtgcccaggaccctttttaaaaaatgggtcccagaatgggaccgtttggtgaaatttaaaccggccaaccttttttttttattttccagaaacttgtgagaaatatcgggggggagttctttttccaggggctcggagttcccctctaaaaggaaaaaaaaaaaagggggggctttcccacagttttttattaacaccccccaccggggacaggtttttacgggggtggtgttaacaacctccctaaccccttt

SEQ ID NO: 615004 - DNA, 404 bp, Homo sapiens
tcacgaggaaggtcataaaagcttcattctagaggtacctcactgtactggaggacaggaacatccttattctaacgacacagagatgccaagaagcatctgaacaaacaggcctagctaaactcccttaagtttattaccagttagatcacatcctttgtgtcccccaatacatactctctgcacaactgatgcattcttatatccaaacctcaagccataacaatatgcagcatttctctagtttctcttgcggtcttacttttctgcaagcctccccatgtccatgccaaaacttcatatttgcacattcaatttgtcatgctctatctccttgttaaaacatctgtcttcttgttcgtaggcagggcaaggcatggggcatcctcatagcagtccgcacc

SEQ ID NO: 615005 - DNA, 591 bp, Homo sapiens
  misc_feature (77)..(77): n is a, c, g, or t
  misc_feature (273)..(273): n is a, c, g, or t
  misc_feature (390)..(390): n is a, c, g, or t
  misc_feature (475)..(475): n is a, c, g, or t
  misc_feature (500)..(500): n is a, c, g, or t
  misc_feature (511)..(511): n is a, c, g, or t
  misc_feature (555)..(555): n is a, c, g, or t
tacagaaactcaaactcgagatgtaatttatataacataaaatttcccataatacaaaacccaccattttaaagtanacaattcggggccttttagtctacttacaaaattgtacaaccaacaccatcatccaattccagaacattttcatcatccccaaaaggaaccccataccttttagcaagtcactgctaattgtcccttttccatagccccataaactaatatactttctgtctctatgggatttgcctattctgaaacagttcatanaaagtggatcacacagtgtggtgtgtgggcctctttctccttttaattaagcataatgttttcaaagtgtatccatggctgtagtatgtggtcaggtacttcattacttttaagggntggaatattattccattggtgtggggtatactacaaatttggtttgcccaacaacctgagtaagatattgggaattggaattccnatttatttcttgcttggcacaagangcctcaagggnccaacctagggggccttctcaagaattctttccctggaggcaanagggggacagcccctaatggcataaggggggggggg

SEQ ID NO: 615006 - DNA, 286 bp, Homo sapiens
tcaccgtcgtcgtccatcctcaatccatcgtccactcgatggtggagttctgggatggcgccactattgctcaggcttcgcctcccgacatgagattgccgattgccttgggactgtcttggccggatcgccttcctgacgcagctgccggctgcgactggtcgacggctactcagtggaccttcgaaccccttgacaacgacactttcggggccgtcgaactagcccgacgcgctggtcatgctgcgggtactgcgccggccgtgttcaatgccgctaacgagtc

SEQ ID NO: 615007 - DNA, 435 bp, Homo sapiens
ctcccaggaaagccgatcaccttgctattgagctcatacgtgggtctacaaagtcctgccgggaaaggtgtaatggttggctcttggtaactgttttggagctgctctgcagtggtcctgggcccaggccagaagaaagaagctcccaagttcctatcctgcccagggcaggctgacctgccttcatttccttcctgtaggctacctggccagtgcattgaaaggtctccaggcctagagaatcttagataaaaggcactggaaccagatcaaagcccatcttttcagctggctgcaacccttgggccagggaggcacaaacctaactgtacccctgctacaggcagggtggatagacagagacccattgtcccttccatgtcctttgttccctcctagggaatctgagcagtcctccgggaacatcagggtggc

SEQ ID NO: 615008 - DNA, 331 bp, Homo sapiens
ctactactactaaataagcggccggtcgacgacggacgctcgcttctttgcccaggttagagtgcaatggcacaatcttggctcactgcaacctccgcctcccgggttcaagcaattctcctgcctcacctcaccagtagctgggattacaggtgcccaccaccacgaccaactaaattttgtattttttagtagagatggggtttcaccctgttgcccaggctggtgtcaaactcctgacttcaagtgatccacctacctcggcctcccaaagtgctgggattacaggcatgagccactgcacccagccaactaggtcgacgcggccgcg

SEQ ID NO: 615009 - DNA, 256 bp, Homo sapiens
tcccccccctttgggggggtggggggggggggtcccccaaagtcggggggttgggcccccccgggccccccggggggaccccccttttttttaaaaaaacaaaaacaagccgggggggggggggggcccccgttttccccccccccccggggggggggggctaaaaattggtttaccctggggaagggggggttttgggggcccaggtggcccccccgcccccccgcggggggggcaggggggggttttgttccca

SEQ ID NO: 615010 - DNA, 216 bp, Homo sapiens
tagcattccattagatattcctctccgggcattaaggtctcatctttaaattggagatttctcactagggatcacaacggtaactttaacttaaaacaatctttccagagttaatgttctacctactaaatgtcaagaacccaactggtgtgccacacatacttgtactacacatgccaccactgcatgcatagtatttaaaaacggccaaaaatg

SEQ ID NO: 615011 - DNA, 784 bp, Homo sapiens
agagcggcggagtcggagggagtaacaccaactggaaaaccttgtatgaggtcaaatccgagaagccatggtgccaaaggcgacaagaccggactactttagttctgtggccacaggtgtgtgtatcttcgacaagagagaactgctatgtaccaagcctgcccgactcaggactgcaattaagatataggtgattgatcaactagaatggatcgtaccgcatgtgagacgtgcgacaccgaatttcccactttcaggtaccgcgatgatcctgtcagtaaactacttgcagattttcaagagaactcagtgggtgacttgtatccaggtagtctgctgtacagctagtccttggagccgagaaattgctgacttactctcctgtggcggacagttgacatacaccacaaggaacttgaacaggcatttgaagaagttttccagaatgccaacttccgatctttcatgattcagagctcagggtcaatagtggtagacctacaacgacgagtctcgaattaaagggccacgtgtgagtgtgacgttgaagcccgtgtgactacagagagtatggccgaaggtggttcatgagcatcaggagcaagtgcgtcgaatgtgagaggcagcgtgccgatcggccagaagtctgcactgggctgacggaatcgatttcctcccactccgttgacgatcctgtttagctaccaggcaaggttctggtggggcctaaacttgctccctgtggttttggacctcgtccagggatcccgtgggggaagtcgga

SEQ ID NO: 615012 - DNA, 263 bp, Homo sapiens
aaacttcgatttttttttaaaaaaattagattttagctggggcttttgtctaatgtaaagtaaatgcccaacccccgccttgatagggatgtttttgtaagttaattttttaagactttttcacatccaaagtgatgctttgctttgggttttaactgtttggccccggcgggggtgggggcggggggttggtacaaaaacttgaaactgtttgtgatatgtacaactcaaatgtttttcattaaaaaacaaaattagcccga

SEQ ID NO: 615013 - DNA, 233 bp, Homo sapiens
agcattctaaagacgtcctgagctatcaagaaattctccttgcctcagcatcctgtgtagctaggataacaggtgcctcccaccatgcccgctaatttttgtacttttagtaagatgaggctccaccatgctggccaggttggtctcaaactcctggcctcaagtgatctgcctgtctcgggctcccagagtgctaagataacaggcatgagccattgcaacagggtctctca

SEQ ID NO: 615014 - DNA, 530 bp, Homo sapiens
agaggagtcccgtcagtaaggtgtgccaggaattgaggctgagggaactagtgatcacaccactgcactctagcctgggtttattgttatctctataaaaaataaaaccagtccagcacagtggctcacgtctgtaatcccagcactttgggaggtcgaggcagtggatcacttgaggtcgggagttcaagaccagcctgaccaatatggtgaaaccccatctctactaaaaatacaaaaattagccaggtgtagtggcacgctcctgtagtcccagctccataatgtgtgcccattggggaccagagatattattggggacagagagaatattagaaatcagagaggataaaggccgggcgcggtggctcatgcctgtgatcccagcacttggggaggccaaggcgggcggatgacgaggtcaggagatggagaccatcctggccaatatggtgaagctccgtctctgctaaagtgcagaaattagctggacgtggtggagcatgcctgtaaacccagctctgtaatcc

SEQ ID NO: 615015 - DNA, 431 bp, Homo sapiens
gaagcagtctttataaggcagtcgtcttcctccatagattcacgggttagtatctgacacccattaataatttctagagcaccattggtacttctctgtggtttggccgagcaagtcttcgatgatgcagtccacccttccataaaaacgtactccaattttcctagattctactttcattgttttgtgaatcaagttagaaggtacataacttagcctgatgagatggcattcataaggttaggatagcagagttgcctaactaatcttcctgttgcaatgaaataaaagaatgatatctaagttgaccaaccttgtaaaaggtaattttacaagaggcctccaaaaataacggactaggactggccagagaagaaaataaacccctcatcctcaatccagaacccagagtttgtcatcagacaatgtat

SEQ ID NO: 615016 - DNA, 569 bp, Homo sapiens
tctccgcttacatcattgctgggtcctcccactaagtggttcacccagatcttgctccacacaacactgttgccacaacaccgctttgctgacccatgaacactcaatagttcctctgcagccttgtctgctcttcttccccaacgtgtctgcttcactccagcagggctggtctcatcctctcctgcacttgtaaggctctttcctgcttatgctcaaactacatcccctgcccagaaagcctttcactttccaaactctgaaccgccttttcttggagatccagttcaagacttacctctgctgggattactctggctcatgcctttacctctcctcaactcctaataagctcacagcaagtaccatagctctccattctcctcagtcagttgccaatggttctctttactgagcttagtagcttactgaagttaatgaaagcaatgctgcaggcattaacagtatctatttcataggatgctgtgcagattatcggatgcccagcacttagcagtgcctaacacaaagaaggtaaggtactcagtcagtgctgaccatggcggagg

SEQ ID NO: 615017 - DNA, 183 bp, Homo sapiens
gatcagaacatcctccaaaataataaatatagtagcggggcatggtggtacacatctgtagtcccagctacttgggaggctgaggcaggagaatcacttgaacccaggagttcgaggctgcggtgagctatatgattgcaccaccacactctagccctagcaacagagtgagatgctgtgtct

SEQ ID NO: 615018 - DNA, 504 bp, Homo sapiens
  misc_feature (244)..(244): n is a, c, g, or t
cacgaggaaaaaccagttatttggactttctggatatgatgtgtatgatgtacatgtatttaattgccatactcccttcctaatagtttcagactcctacttaaatgactgaaacaatatttattaaaatagagaaaatctacatagtcctattatttgaaaggggtcattgcgtgccagaaacttttcataattcctgaaaacagagctaaaacaagattgagaaaatcaacaaaaattcctnacttgcaatgcactgtgaaaacaagaaacctgggaaacaaatagacaagaccctagaaaaacctccctgtaaacttctctgtctttggctacagcgggttgagacacaatttgaggagcaaagctcaattcccttagtatgtcagcaagctcactggtatcctggaaccacgcctcagcaatcttgcctccacttcgtggatgcgccaggttaaaggtggaaacaaaattgattgttggttaagaagctcatgtttcctt

SEQ ID NO: 615019 - DNA, 314 bp, Homo sapiens
  misc_feature (7)..(7): n is a, c, g, or t
gagctanagcatcctaacaggaagcgtggtacttcgcatctgggctcaacctgggcgggactcttgccatcctgagccttcacagattactccaactctctaagactcagtttcctctcatactatatgagaaaacttcacaggattgtcataaacgatcacatacaacagggcatcaaagttcttcacaacaaggccacagtgggtaggcaaagaaatggccactaccatcatcaccgtcatcatcaccaccaccattttgctttgcagggggcaaattttcagaaaagagtccaagtgcaagagattctttt

SEQ ID NO: 615020 - DNA, 118 bp, Homo sapiens
cgccatattacagtgcaaaatgtgcaacagaatcaatacatgtgtcttagctctgagagcccaaattggtgataacttactacctgtaccatcagttgggcactgtgcccctataccg

SEQ ID NO: 615021 - DNA, 955 bp, Homo sapiens
  misc_feature (129)..(129): n is a, c, g, or t
ctgaagtactacgacgtgttgtgtaccgcacacgtattttttgctctcgtccagatgggcccctacttcgatcggcccaatttcatgttgcaccacagtatgctgctctacacgcggtcacaccttgcnaaccccattgtccctgggaacaccgtggtttccccgattttcggcgtgataactagccacgagtgcccagcagtccctcctaatgtttccccccgggtgaagtctaaaagtagtgctcgcgcctgggagcttaccccagctttatttcataggagactgggatctataatttagtttggtaagcgcacacccctgcccctctacggtgcttgaagcacacacagagccctggtatttcataccccacgattacccccccttggttcgcccgccgaccccccaatatccatgtttgcagttacacgtgatggttgaatagtgccgcttccatccaagatgcgggctcggagaaaatcccacttgtgtaagaatcaggttctctagtcaaacacagcacgcgggtggtcaccacagggagaaaacagagaataatccacccttgggcatgtgttaggagaaaaaaaaaagcgagcacatttcgtgcgcctactaatcgtggtaccaaagtcttattgtcgtgttacgaccctagagcagtgactggccacttcccccacttcacgttgggagtggagaatggtgagacctcagcatcctcccaacgaagtagtgtggtacaccttgagcaacgtttaataactgttgtcctcaagtgtaaacccccgtgtcgtatgagattcccacaaggggagattattcaggtccacatgtgggctatgggttccaatatagtactaggactagacaccctgtttagcacataaccacaacacggagctgctttgttcaaaaaaaacttaaaacatgattttcgtcccacaaaaca

SEQ ID NO: 615022 - DNA, 121 bp, Homo sapiens
ttgaagaaatacgagattacttcatttctgggcttgacttggacctgcttcttctttgagatgtacttggataatgtattaatcctgctctgcaaggatgagccacgatctgccgtcttct

SEQ ID NO: 615023 - DNA, 168 bp, Homo sapiens
ttaaaatgggcacagaaattgccttccttgtccctcccttaaatctcattatctatctcagacaactgaggaatgcaaccacacctgatcgacctgttacaagatagtgcctgcctctcaggctcatacgaatttcaaagagaatcatttacaaggttggtttctgtg

SEQ ID NO: 615024 - DNA, 417 bp, Homo sapiens
tggccttgtaccaaccagctcttctgcaaccggagtttttacagtctgcgcgggacttttccgatgaggacattttatccataggacagattccgatgacacaagagcttgaaaaatctagaccacaggacacgaacatactgattactggtgagctagcaacgtcattacagtcgctgaagacttcaagagaacatatcaagacctaaaaaattcgccagaggaaggaaacggttaaaagcgcataaaacatgtatcaagatgagatgaaactgcttcaatcagacacaaacgtatttaaaagataatagttcgaccgcaacactgagaccctggtagaatcaacgaatcagctacgctacaagactgaagcccgagcaaatagataaagcctagattatacaaaccagctgatct

SEQ ID NO: 615025 - DNA, 207 bp, Homo sapiens
agtgtcgagaaggtgctgtcttgcagaagacacgctgatccctggaggctcagaatcacttgtctataccaccttggtctggaggaattggcatccgttgtgccattcacgtcccagtgaggaccactgacttcttccagtcatgtgtgaaatgcaccatgcggtctgatacatcccctctctctgtgtggcgggaccacgctcaga

SEQ ID NO: 615026 - DNA, 331 bp, Homo sapiens
gagacagggtctcattctgtcactcaggctagagtgcagtggcacaattatggctcactgtagccttggccacctcccaggctcaattgatcctcccacatcagcttcgtgagtaactgggactacagttatgcaccaccacacccagctaatttttaaattttttgtagagatggggttttaccacgttacccaggctgttctggaactcctgaactcaagcgatgctcctgcctctgcctcccaaaatgctgggattacaggcgtaaaccactatgcctggactcaagccgactttttaacatgaacaataagtctctttattcatctc

SEQ ID NO: 615027 - DNA, 80 bp, Homo sapiens
  misc_feature (22)..(22): n is a, c, g, or t
  misc_feature (46)..(46): n is a, c, g, or t
  misc_feature (52)..(52): n is a, c, g, or t
tgatatcaaagactcattgctnaattctaagacttttgaattttcntttttnaaaaagatgtacaaaacagtttgaaata

SEQ ID NO: 615028 - DNA, 816 bp, Homo sapiens
ctcccctcaccgtggtccccccgggggggaccctttccctgccccttcttgggggtgccttttttggagccctggggaaatattttggggcagtgggttcaactgggattgagctatgtggctttcgggggtcttcccttgcaacaactttctgggggagccaccggggggccccacaaaaactcctttcacggggctctctcgaggatttttgcggattgcccctgtgcgcgtctgtgagggaaacacagggggtgttacacaacagagggttatctgccgctcttcatacccccccccctgtttctaactcacttgtccccccctcttctagggctttttggaaccccgcccagatgtgggggggaaataatggtgttctctttggtgttctccccccgcgtgtactctggctctgggcctttccccccgttgttccccggggggcacgcgttcccacggttacccctcggggaatttttatgcccccccctcgggggagagtagttatcacacacacccacacccgtgggttattatttggcggcgctgtatattgttggggggaatagttgttgtgggccaccgctgcgtgtctgtgtgtgtgtgttgtgtggtgtgttttgtgagcctcctgtccccactggtacgtcccacaccctgtccccacgagatcccctatttctcctccaccacaatataccacgaaacacctccccgggagactttggggagagagaggctggggaccaatacccgctgtcactcccgaggacatctttttttagccataaaattgagtgtccacatatttta

SEQ ID NO: 615029 - DNA, 169 bp, Homo sapiens
tgcggtcttgtgcggcgctcctgctactcttccccctgctgtcctccctctcccggctggcgtctccctccctgccctcgactgacgtgtgtgcccccgaccgggtactggcggcctcgaccgggctgcgtgctgtggtgatcgacatgaccacgtcgacggaccccac

SEQ ID NO: 615030 - DNA, 245 bp, Homo sapiens
  misc_feature (132)..(132): n is a, c, g, or t
  misc_feature (186)..(186): n is a, c, g, or t
catgtactgtgacctgagatgcagccagaatgaagcagcagttgacaggaattcaaagcgtgtggtggttccgtcatgagctcatcaggctgtgaagcatgaagggaacagaatgggtagaaccacgaggancccacagtcattgctgagaatgagctcctgggagctgcagccgccattgaggcntgcagccaaaaagctagagcagctgaagcccgggccacacccaaggaggcagatgagtc

SEQ ID NO: 615031 - DNA, 137 bp, Homo sapiens
cattttaaaatcttatttgactggcgaatcatggaagaatgaagtgcaacttggctcagagttctgtgtgtctaccctttctgaaccagtgtactccatttcttcagggccaggctctctcctgcgttgagaagctt

SEQ ID NO: 615032 - DNA, 817 bp, Homo sapiens
  misc_feature (64)..(64): n is a, c, g, or t
  misc_feature (98)..(98): n is a, c, g, or t
  misc_feature (101)..(101): n is a, c, g, or t
  misc_feature (158)..(158): n is a, c, g, or t
  misc_feature (188)..(188): n is a, c, g, or t
tgggccgcacgggagcctttgcactgctctatgcagctgtgcaggaggtggaggctgggaacgnaatccctagctgctcagtgtgcggcgcatgcggnagngagaaagcacatgctgcaggagaagctgcacctcaggttctgctatgaggcagtggngagacacgtggagcaggtcctgcagcgccntggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggcctgaagagcccccaggcctccggccagccaagcctcccagagtctaccccaatcccatcttttcctccgcaaccccccttttttcctcccaattaccttgaggctccccagcctaggggaggagccgccagttgcttgaaaagccccccagctcggggggcccccccttactcctccctggaaattgcttggcctcctttgacccccagaggtctttctccctggacagactccctgcgggggcaaaaccagcgcgatgaggcaagcaataatttttctgcagggccaataacggggcaaggggttgggggggcacccggccctcttgaacgacccctacagccttctggaatccactcctggacactcaacaagacctgaaacaggtttggcctacctggtccttacactacatcatcattcatctcaatgcccacttgta

SEQ ID NO: 615033 - DNA, 332 bp, Homo sapiens
  misc_feature (64)..(64): n is a, c, g, or t
ccagggcactctgcgtgcaggaggcacgtaatgtttagaaagagaagtggaggccgggcgcggnggctcacgtctgtaatcccagcactttgggagactaaggcgggcatatcacgaggtcaggagttcgagaccagactggccaatatggtgaaaccctgtttctactaaaaatacaaaaattagccagacatagtggcgcacggctgtaatctcagctactcaggaggctgaggcaggagaattgcttgaacccgagaggcagaggttgtggtgagccgagatcgcgccactgtactccagcctgggtgacagtgggagactctgtctcg

SEQ ID NO: 615034 - DNA, 705 bp, Homo sapiens
tctaccgactgcttagggagccttagcctgtgcagtgcaatcatcagccagaaggtgaggcaggttcgtggaagctgtgggagagcatagcttgggactccctctcctcactcactctgtctactcagaaccaccttcctcaggactcccaggacctggtcctcggtggggatgtgcccatcagctccatccaggccaccattgccaagctcagcattcggcctcctggggggttggagtccccggttgccagcttgccaggcctgaagagcccccaggcctccggccagccaagcctcccagagtctaccccaatcccatcttttcctccgcaaccccccttttttcctcccaattaccttgaggctccccagcctaggggaggagccgccagttgcttgaaaagccccccagctcggggggcccccccttactcctccctggaaattgcttggcctcctttgacccccagaggtctttctccctggacagactccctgcgggggcaaaaccagcgcgatgaggcaagcaataatttttctgcagggccaataacggggcaaggggttgggggggcacccggccctcttgaacgacccctacagccttctggaatccactcctggacactcaacaagacctgaaacaggtttggcctacctggtccttacactacatcatcattcatctcaatgcccacttgta

SEQ ID NO: 615035 - DNA, 199 bp, Homo sapiens
taagatgaggacagacagacagcagcatgaagtgctctacatgacagagaccctctgccaccagagacctgtcctcaccacctgtcctcacatgctccactgaagccagccttcttcaatcccaggacaccacacccagactcagtcctcccctcacagactctgacccctcatcactggacatactccatggtgctga

SEQ ID NO: 615036 - DNA, 422 bp, Homo sapiens
actacccagtgttcggtaagaacagcgcgcattctgcgcacatcatctttgtaggtcagttttaccgagtggtattgcgggaattgcattcgttgactggaattatccatggaaattctcttaaaggtggttggtttaggccggctcatagcgaccatggtcgtactcctccatcacctccttttccgttagtgagcgaacacgcacaacgccatcgatcattctgctgcggtctttgaagtacaccactttgagcggcaattcaggaatcgaccggtcgagtgccaaaacccacgcctccaccagttgaccctcaggggtgtactggcgaccagtgttgaactcgattgagttcaattgggcatccgggccgggtttgctgatgatgtcgccaaactcggcgaccaatgaggcgtaatgat

SEQ ID NO: 615037 - DNA, 529 bp, Homo sapiens
ggttcataatgtggccgaggctggtcttgaactccggggctcaagtgctgtaccggcctgggcctctcaaagtgcaaaggcatgagctaccacgcccagccattattattattatttggagacagagtctggctctgtcacccaggctggagtgcagtggcgtgatctgggctcatggcaacctcggcatcccggcttctaagggattctccggcctcagcctcctaagtagccggcactacaggcgtgcgccaccatgccaagctaatttggtatctgaaggggagacagggttcaccaggtgggccaggcgggtctcgaactcccgacctcagatgatccaccagcctcggcctcccaaagggctgcgattacaggcgtgagccaccagaccgggctcctacccttttttttccagacatgatctcgctcttacatgcaggcgggagagtggtggcatgatcatggctcacggcagcctcgacctctggggctcacgtgattctcttgcctcagcctcctgagtact

SEQ ID NO: 615038 - DNA, 675 bp, Homo sapiens
  misc_feature (553)..(553): n is a, c, g, or t
  misc_feature (576)..(576): n is a, c, g, or t
aaaatggacaattcaatggtttttagtatagtcagagttgtgaaaccatcactgcagtctattttagaacattttcatcaccccaaaaagaaactattcactcccaagccccttccagccttagacaacagttaatctactttctgtctctataaactagcctattctgaatatttcctgtacatggaagcatatactatgttgtctttttgtgactggcttctttcacatagcatattgttttcaaagttctatgtggtagcatatatcagtattcaatttcttcttattgctaaatatttcattatttggatatatcacttcttaccatttattgatcaacatttgggttgtttctactttttggctgttataaataattcagctgttggtcaggtgtggtggcttacgcctggaatcccagcgttttgggaggctgagacgggcatattgctcgagcccaggatttcgagaccagcttacacaacccagtgagactgcttgtctcaaaaaaatagaaacaattatccgggcatggtggcatgcacctgtngccctagctactcgggaggctgnggtgggaggatcacttgagcctggaaagtcaaggcttcagtgagccatgatcacatcactgcattccacccttggtgacagagtgagaccctgtctcaa

SEQ ID NO: 615039 - DNA, 513 bp, Homo sapiens
agaacaatactctggcattgtggttatagttgtgctatggcagggtcactctgttagaagtttactctttcccactgaagtagaaccccatcatacggctttctgtgtccagaaaccaaggcgattttagtttctagacggtgggcgctggtgttgcttcccaggtgctcaactctgggcagtaacaagcctgcatggtctggacatggtggctcacacctagaatatcagctacctgggaggccgatgcaagaggactgcttgagcccaggagttcgaagccgaagtgcagacgcattcaagctggtcgagccgggaacgcacctgcactccagcctgggcaacagagcgaggccctgtctcaaaggaaaaaaaaaagctttggcagcagggaacttggagaacatgggctgaaacgataagtcttttcgtgctacagatcctgggtctccacgggatgtaaacctgttcactgtccaacaacagcagcaatcaacacttccagagcacttg

SEQ ID NO: 615040 - DNA, 134 bp, Homo sapiens
ggtagtatccggggactctaagaatatcctctttgtcatacacaaaaccagcatgtctactatagcccatgcttcagatacttacatagtttatggggaagccatgatcgaagatttatcccagataagcacaa

SEQ ID NO: 615041 - DNA, 156 bp, Homo sapiens
ctcgttatgatgtcgaagaaccaattgcttgatcgggcttcaagctgggcaacgtgcgagatcccctctcgacaaaaatacaaaaattagccaggcgatgtgggaggcatctctactcccaactactcaggaggctgaggcgggaggaaatcataa

SEQ ID NO: 615042 - DNA, 507 bp, Homo sapiens
atacggtagctaggttcctaggagcatggcaaaatagggaaataaaggccagttaatatctatacttactataatcttaactaattctactctctctccttcctatccttccttccttaccttctaacctatactttacttaatctatatcttaattgagacagagtatcgctctagtagcccaggataggagtagcagaggtacaaacttggctcaccgcaacctaccacctacccgggttcaagagatacctacctagcttaagcctacctgagtagctaggataacaggcatagcaccaactatgcccagctaattatgtaatcgttagtagagacaggtaatctacatgtatgatacagactaggtcccaaactacccaacctacaggtaatactagcctagcctcggcctgccaaagtagctgggatatgcaggtagtaagccaccgtgcccggcccaggccagtatcattacactgcagtgagtatggcacttcagaaaac

SEQ ID NO: 615043 - DNA, 296 bp, Homo sapiens
cagaactctcagttcccagtctgctagagaactgaagtcctggacagtcacagggtacagagacccaggcagctccagcatctagctgcttgagagacggtggctgggtggaccagcttgtagagtctcaatgggccaatcaaaccggtgtgcaggaagctgagctactggcttcattcctgaccacagctgagaagtatctgtcttccatacattctatctcgagttttgttttattttttaaaaattttgcttaaaacagcatgttttataaaataaaagtatttttatctcat

SEQ ID NO: 615044 - DNA, 1005 bp, Homo sapiens
  misc_feature (33)..(33): n is a, c, g, or t
  misc_feature (86)..(86): n is a, c, g, or t
  misc_feature (105)..(105): n is a, c, g, or t
  misc_feature (155)..(155): n is a, c, g, or t
  misc_feature (161)..(161): n is a, c, g, or t
  misc_feature (167)..(169): n is a, c, g, or t
  misc_feature (190)..(190): n is a, c, g, or t
  misc_feature (262)..(262): n is a, c, g, or t
  misc_feature (282)..(282): n is a, c, g, or t
  misc_feature (288)..(290): n is a, c, g, or t
  misc_feature (302)..(302): n is a, c, g, or t
  misc_feature (306)..(306): n is a, c, g, or t
  misc_feature (310)..(310): n is a, c, g, or t
  misc_feature (316)..(316): n is a, c, g, or t
  misc_feature (332)..(332): n is a, c, g, or t
  misc_feature (337)..(337): n is a, c, g, or t
  misc_feature (368)..(370): n is a, c, g, or t
  misc_feature (372)..(372): n is a, c, g, or t
  misc_feature (395)..(395): n is a, c, g, or t
  misc_feature (399)..(399): n is a, c, g, or t
  misc_feature (401)..(401): n is a, c, g, or t
  misc_feature (412)..(412): n is a, c, g, or t
  misc_feature (484)..(484): n is a, c, g, or t
  misc_feature (502)..(502): n is a, c, g, or t
  misc_feature (504)..(504): n is a, c, g, or t
  misc_feature (506)..(506): n is a, c, g, or t
  misc_feature (512)..(512): n is a, c, g, or t
  misc_feature (514)..(514): n is a, c, g, or t
  misc_feature (518)..(518): n is a, c, g, or t
  misc_feature (529)..(529): n is a, c, g, or t
  misc_feature (572)..(572): n is a, c, g, or t
  misc_feature (705)..(705): n is a, c, g, or t
  misc_feature (709)..(709): n is a, c, g, or t
  misc_feature (720)..(720): n is a, c, g, or t
  misc_feature (757)..(757): n is a, c, g, or t
  misc_feature (811)..(811): n is a, c, g, or t
  misc_feature (879)..(879): n is a, c, g, or t
  misc_feature (893)..(893): n is a, c, g, or t
  misc_feature (899)..(899): n is a, c, g, or t
  misc_feature (909)..(909): n is a, c, g, or t
  misc_feature (911)..(911): n is a, c, g, or t
  misc_feature (952)..(952): n is a, c, g, or t
acggcggcgagcaggctgcaggccgcggggatncggggcgcggggggcgccgggcctgatcgccgcctctcgcggtgcccgcaggnccccgggcgcgcactctcnccccgccgccgcctgccccgggccccggagcgcggtggagaagcccccgnaggagngggggnnncgcgccccgcgccccccaganatggtgggccacctgcatctgcagggcatggaggacagcctgaaggagcagggccgggagggcttgctgganagccccgactccgggctgcnccccannnccagccccagcncgcncttntactcnctggcgcccggcatcntcgangcgcgcgcggggggcgccggcgcctcctcgnnncncccgggacccaacaaagccaaancgcncncctcccaactnccaaatcccccggcgtcggagatgaggccccggatgctgccagtgttctttggggagagcatcaaagtgaanaggaacacaaaatgaaanangntgaaantntgangtcaagtacgnctcggagaagcatttccaggacaaggtcttctatgcgcccgtncccaccgtcacggcctacagcgagaccatcgtggcagcacccaactgcacgtggcgcaactaccgcagccagctgaccctggagccacgcccgcgcgccctgcgcttccgcagcaccaccatcatcttccccnagcntgccaggagcnctttccggaccaccctgcactgcagcctgggccggcncagccgctggttcaccgccagcgtgcagctgcagctttgccaggaccctgcccncagcctcctggggccctgccacgctctgacggggctggggccgcccggggtgctggacgagccgggancctggggagacgcnggacgntgacacgatnantcggctggcactcgggaggagcgggaaggaggctgcagacnaggaccgtgtggaggaggcgctcccgctgctgcctgactaacgctagttgtgt

SEQ ID NO: 615045 - DNA, 293 bp, Homo sapiens
  misc_feature (139)..(139): n is a, c, g, or t
tagcggatacgacttcatggcacgtctgctgtctatatcaacaaacaacctttttccaggggtctccttggaactggaaggcccgtcggatcggcgcttaaccgcgtaggtcatccgcacgcagtctgctacaaagtgncactaggactcgcatccagccgtgtccagccaggaccgggttcttaccatatacagttgagactaggttgagaccgtttcggccccaagagctctaatcattcgctttaccggataaaactgcccgccggagaaggctggggtaccgaggctcg

SEQ ID NO: 615046 - DNA, 1196 bp, Homo sapiens
  misc_feature (436)..(436): n is a, c, g, or t
  misc_feature (482)..(482): n is a, c, g, or t
  misc_feature (505)..(505): n is a, c, g, or t
  misc_feature (665)..(665): n is a, c, g, or t
  misc_feature (932)..(932): n is a, c, g, or t
tgtcgctcatgcttgcactttaggtcgatgctggcttgttggcttgtatagctacgtagtgcttagtctagggtgatttgctcgactctcgggtagttttgtttgctgtctctttgttggtgtcgtcgagtcgtgctcgttgattgtagtggttgcgagtcggcgtagctgcgtcgcacgacattgtgttcctcggtattccgtcgcggttggggcggacccgccgggtctccgccgtactgcctgggtttgtacccgctcccctgcggttctttgtttagattcctcctccacattaatgggctcagttattctcctccagtctgtgtgatgtccggcgcgccccgatgtcctacttgtgcctggggagaccctggcccggtcagtttctcgggtgtgcggagcactcctctttacccgacgtttcacgtcctcntccggttctccggacaaaatatttccccgggtcttttcggctccanctttctcgcccgcccggacgggntttttttcattcccgccacatattacgtggcgttcttcctttgtatgacagaccccttctcctgggttccccgcgaccttcttttaaaagaagaaaccaatcgtttctgggtgagcacgtcgttggtgtgcccacggagcagccaccttatttctcctcnggatattaaataccgggcgttgtttctcctccgtaaccccaaagggggctacccccccgctctcttttttgtcaacaaatgaggaagggtccgtcttactcccgccgcggagtgggcacacccgacatttctatatttctgcggccaaacagatatgcgcgcgtgttattattgatttatattacgccacagaggctcaccactccggtgtacattcctcgtgcgtgcgactaatcccactcaccgcagcctgcgtcgtccttcctntgggggtaaatacatacttctcggcgcccgacggcgaacgacagcggactcgtgggtgtgacgcacacacgtctcggcgaagccaacatctttctcctcgtcaaggatcgcccttcgtgcaccaccacgacatgccgcggtagttgccgttcccccccaggcgagtttcacggaccataccgacaaacctaacgaaaaaaaaaaggggcaatggccttcttcatttttcaagggggcgtaaaaactttcccccctgacaaaaca

SEQ ID NO: 615047 - DNA, 125 bp, Homo sapiens
  misc_feature (31)..(31): n is a, c, g, or t
  misc_feature (80)..(80): n is a, c, g, or t
  misc_feature (105)..(105): n is a, c, g, or t
aacgctgatggggaggctggaagatggcagncccggactgggcagatcttcaagcagacctacagcaagttcgacacctnacacaacgatgacgcactactcaanctacgggctgctctctgctt

SEQ ID NO: 615048 - DNA, 235 bp, Homo sapiens
catatcagacaccagcacgcaagagctatacacacggtgcatatcagacaccaggacgcgcagtgctataacacggggtataatcagacaccaggacgcagagagcttacacacggtgcatatcagacaccaagacgcagagagcttcacacggtgcctgtcagacaccaggacgccgagcgctaacacaccggtgcactatcagacaccaagacgcagacacgcttcacacggt

SEQ ID NO: 615049 - DNA, 119 bp, Homo sapiens
ggtactgctacctagtgggggactgctacctagtgggacaactggccacccgagagtgaccgcaaggtgcccattctggaggacactgctgatgcgcatcctggtcatctgggctgtcc

SEQ ID NO: 615050 - DNA, 203 bp, Homo sapiens
ccacttttgtagctttccgcgtgagtgagaacatgctcctctttctgggcctggcttatttcactgaacataatgtcttccagattcatctgtgttgctgaacttggtacaatttccttctttttatgcctgaatattatttcattgtgtatatagaccacatgttccttatccattcatccattgatggacgcgtctcgcat

SEQ ID NO: 615051 - DNA, 882 bp, Homo sapiens
tgatgaactcctaagtcactgacagtgtgatttgggtcaattgtcggcatgaggtgcttgctcttacttccagtgtattgatccactggtaaaatttggcctatgtgtggctgtggatgaatccgatgtagagagaggtgagcttgtacgtgtaagagatgctgtcagacatagcgatgggtaggcatctaggagaggaagtggccgtagattttttaaattgagttcttgaagatgtgggatatgcacgtggttgtctgtggcggatgaattcatagtagagctagtgctgttgtgatgctgtctaataacggcctgatgccgtattgactttaatagttgattcagcttttaaatgatgaagatctaatgggatccaattgacagttgagtttgcaatttagccacagatgtttccctggtaccagttggaatcgagacaggtcacgaggcatctttcaggacacttcagtgttatatgcacacagtacttgtaagacgtctgcgtgtgtctggaggagttgacaacacaaatggcatgcaatggtcatgatggattatcttgttaaacctgccctttctgtaaaaaatagttcatatgtcccacaatagcaggaatgtgtggaatcctttattactaaattgccagcaattgttgctgttaaacatcactgtgagtgcacttgccggcaaagttgcggattcggagccaaggtattctaaagaccttagctagaagggtggccccttgtaaggtaacgccgacggaatgtaaaaacgctaatggaggaccgcgagccaccacgggagaaaggggcggccacaacaagacaaagggcccaagataacataacatctctctcttattttttctttattatt

SEQ ID NO: 615052 - DNA, 756 bp, Homo sapiens
  misc_feature (25)..(25): n is a, c, g, or t
  misc_feature (62)..(62): n is a, c, g, or t
  misc_feature (102)..(102): n is a, c, g, or t
  misc_feature (233)..(233): n is a, c, g, or t
  misc_feature (271)..(271): n is a, c, g, or t
  misc_feature (273)..(273): n is a, c, g, or t
  misc_feature (276)..(276): n is a, c, g, or t
  misc_feature (318)..(318): n is a, c, g, or t
  misc_feature (338)..(338): n is a, c, g, or t
  misc_feature (348)..(348): n is a, c, g, or t
  misc_feature (471)..(471): n is a, c, g, or t
  misc_feature (554)..(554): n is a, c, g, or t
  misc_feature (562)..(562): n is a, c, g, or t
  misc_feature (583)..(583): n is a, c, g, or t
  misc_feature (756)..(756): n is a, c, g, or t
ggacaatggagagagcttcccctgngatttttttttaggaagctagcttctctacggtcatntttgcttagagtatactttaacctggcttttaaagcagtngtaactgccccaccaaaggtcttaaaagccatttttggagcctattgcactgtgttctcctactgcaaatattttcatatgggaggatggttttctcttcatgtaagtccttggaattgattctaaggtgntgttcttagcactttaattcctgtcaaattttttgttncnccncttctgccatcttaaatgtaagctgaaactggtctactgtgnctctagggttaagccaaaangcaaaaaaanttttactacttttgagattgccccaatgtacagaattatataattctagcgcttaaatcatgtgaaagggttgctgctgtcagccttgcccactgtgacttcaaacccaaggaggaactcttnatcaagatgcccaaccctgtgatcagaacctccaaatactgccatgagaaactagagggcaggtcttcataaaagccctttgnaccccctncctgcgcctgtgttaggaganagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatcn

SEQ ID NO: 615053 - DNA, 383 bp, Homo sapiens
  misc_feature (218)..(218): n is a, c, g, or t
  misc_feature (239)..(239): n is a, c, g, or t
  misc_feature (243)..(244): n is a, c, g, or t
  misc_feature (249)..(250): n is a, c, g, or t
gcaggaacaggaggctgaaggggtggctgccctgcgacccagagatggtcaccttactctgcaactagcagcaccatggggcaggtgggacggcagctcgcatcatcggggacgacatcaaccgacgctatgactcagagttccagaccatgttgcagcacctgcagcccacggcagagaatgcctatgagtacttcaccaagattgccaccagcctngtttgaaaacgccaccgcttngggnncatcnnaactggggccgtgtggtggctcttctgggcttcggctaccgtctggccctacacgtctaccagcatggcctgactggcttcctaggccaggtgacccgcttcgtggtcgacttcatgctgcatcactgcattg

SEQ ID NO: 615054 - DNA, 120 bp, Homo sapiens
agcattgtgtcgacgtggtgcgtctgttaaacgactttgtgttttaatatcccaaacattgggaagattaggtgtgatacatggtaacccctccttgggtagtcacaggctgggtagtca

SEQ ID NO: 615055 - DNA, 128 bp, Homo sapiens
ttgggacggcggggagctcatcatctctactgtgtggccatgccatcattagccagctgtttgttggtttgactgagagacggcattgtgaaggccccatcctgtatgttacagccagggctgtgtgg

SEQ ID NO: 615056 - DNA, 347 bp, Homo sapiens
  misc_feature (135)..(135): n is a, c, g, or t
ctgccttctgtaacatctagaggccagcggtttgcactggcagctgtcttgctcaatgcaggaaactgtcagttcctctctcaccatactgtactctttgctgattctggtagggccccccactgtgtgtggctnaccctgatagctgccctttttaaaatttttttcctaaattattcctgactcaagggcagggcagagacctactgcctagacctgagcccaggtctgggctgctatctagtacaagcagatggtgagaggcagagagagcacagggcagctagagagagtgctagaggaaaggagggtgagggcatgcttcttctttgataggttttctgaag

SEQ ID NO: 615057 - DNA, 102 bp, Homo sapiens
tccccctggtatccccaccccattgtctatcactgatgacctccttctgcctgcagatgaagtaaacatgccccatcaatgggtagaaggaaacatgcctgt

SEQ ID NO: 615058 - DNA, 338 bp, Homo sapiens
gtattagtaattctagtccaccctgaccttgtgatctcgccatgaccttctgtactgtgatcttttgtatgccttgaagcatgtgatctctgtgactcaccctattcatacactccctcccctttgaaaattgctaaaaaacttgctggttttacagctcaggggacatcacggaatctgccgacatgtgatagctcccccggacatccagctttaaaatttctctcttttgtactgttcccctttatttttcagagcggacgacacttagggcaaatagaaaagaacctacgttgaaatattgggggttggttcccccaataaactcccctaatctg

SEQ ID NO: 615059 - DNA, 1243 bp, Homo sapiens
ggctcgctccctgacaagatgccaggtcgctggtgttcatgagcgcgcgttgcgctaacgaggcgggccatcagccggcggtgcatgagaagaccttgcagtcggtgtgccgcttgagctgtccgagggcgtcgcgacgacggatgtacaggtgtctggcacgatggcagtgtgatcgcttggcgcagcagagtgaccgcaagggggctgatacggccgatttctggctcggtgataaggacgtagggatggtaacatcctggctgactgcgctctcgagtggacagctgtgaccgccgttgagattcggcgcagtctgaaggttcggtcactcacttgagaacttagcgtcaagcgtaggaggtcatagatggtggtattccagtgtagcggatcgtcttataccttgtacttgtgcatcgcagcggggcggtcgcaggcaccccggtattcgtggccccgttgcccttcttagctgtttgcttttaccagggaccacccgcgacgagacccctgaactaccaggcaggggtaaggcttccatgagcttgcagagggtgccggcgcacatgggaaggacatctccgtatggtcccgggaaacacgtacaaattgcctgtacttatggggtctgggacaacttgacgacttagtatgcttagcgcactgtgggacggaaagcccagcatggtccgccgtagggcgttgaaacctacaacgggatcacttcgaggtggtccatacgttgaagtgttagattggcgttaggcattcgtggctccgataaggacttgcgaatacgatgtccccaaggggactcgaatggtgtacaccccaaatgggaagcccttgggtcagacgtcagacacgaacattccaagcgggagcatagcggggaagcttcgtcccagagggtccttttggttaacaattcgcgggcaatttcacagatggaacaggttcgtaggcaagatgcgacttggaggtcaccggtgtaggccatatttaaagttccatacccagaataggttcccttggaatgggagcctgtataccatgcatgccgcgtttctggcagtgcctatcctggtaaatctccttcgggataagttcgagtgggggaccccttgcctgattataactatccgactttatcgtgaaaggcgtactaagtagaggcatgcccagttttgctcaccctttgtcggaggagttttcccgagttcttgccacctgatatcga

SEQ ID NO: 615060 - DNA, 319 bp, Homo sapiens
  misc_feature (100)..(100): n is a, c, g, or t
gggggggggggggggggggggggggtttttttttacccgggcgttttttttgggggggggttttttttggaacccccccccccggtttttttcccccccnagggaacccggggcccctttttttctccccctttttatttggcggggggggggggatatttttttttcccgggggggccttgggccctttggcctttttttgggggccctttttcccggtttttgccccaaaacgggggggggccgggccggttttttccgggttttttggcccccccgggcccccatttccaaggaatttttagacccccggggccca

SEQ ID NO: 615061 - DNA, 104 bp, Homo sapiens
tgcgccacgttatcttggcatcgagaaaggctgccctgagtctcggccacccggcacgcggtgtcgacgttgcagctcccggattcgccgatcttctccagcag

SEQ ID NO: 615062 - DNA, 198 bp, Homo sapiens
tacgatgattcgcccgttttcgatgatggagacggtgtcacacacgccgtctgctcgtcaaggtggtgggtggtgtcagagttgtcatgtgcagcaggtcggtcgattgcagcagggagaccagaccagcgcgagcttctgggtccagaccggcagtgggttcgtcgaggaacaggacagcgggacgatgcactaggg

SEQ ID NO: 615063 - DNA, 596 bp, Homo sapiens
  misc_feature (275)..(275): n is a, c, g, or t
  misc_feature (288)..(288): n is a, c, g, or t
  misc_feature (387)..(387): n is a, c, g, or t
  misc_feature (425)..(425): n is a, c, g, or t
  misc_feature (459)..(459): n is a, c, g, or t
tggtcccatatctggtaggaccagtggtggctggtgccccggcattgcagctgtttgagtcccctgcagggcatcttggcccacagctcttcaaccagtttgcactgccttacatccgtgatgtggcccagccagtgaaggcccggttgcgggaggcaggcctggcacccgtgcccctgatcatctttgctaaggatgggcacttttgccctggaggaactggccccagctggctaatgagcgtggtatgggcgttgaactggacacgctggccncccacagaaagcnccgcggagtgtgttggggaaagacggtgaccattgcacgggcacacctggaacccctgtgccttgtatgcactctgaggaggaatcgggagttggtgancagatgtggatgactttggaccaatcgctacattgccnacctgggccatggctttatcctgacatggacccngaacatgtgggcgcctttgtggatgctgtgataaacactcacgtctgcttcgacagaactgagtgtatacctttaccctcaagtacccctacacagatgattgatcgtttcccggaccatcaaagtttcgaagttga

SEQ ID NO: 615064 - DNA, 279 bp, Homo sapiens
gattttctttatcaacagactgttttcttagcaaaaagggaggacgctactgatgtcactgctttccacttctactaagctcggtataagtgttcagacttctagggattcctgcttgcccgaaccgtccacttcatctttcacctcgctaactcgtcccacacagccctgctgaaggctaggactaactcatcccctatcccaacaactcaggtacagcgaacgacctacggagcagcactacaccctgaccactgctacacgcccccctcaagccca

SEQ ID NO: 615065 - DNA, 444 bp, Homo sapiens
  misc_feature (235)..(235): n is a, c, g, or t
  misc_feature (273)..(273): n is a, c, g, or t
  misc_feature (307)..(307): n is a, c, g, or t
tcttctactctgtacaacataagccctagaaagaccggactttttgttgctgttgttcatttgtgtttatgcttcatgcctgggtccatactagggatctgataaatttattgaatgctgaatacactgagtaaacatgcctacatatgcgttgtcactagtaaatagggagacaaaggcttgtggtcctcctgacctccctgttggtcccccagaggaatcgggagttggtgancagatgtggatgactttggaccaatcgctacattgccnacctgggccatggctttatcctgacatggacccngaacatgtgggcgcctttgtggatgctgtgataaacactcacgtctgcttcgacagaactgagtgtatacctttaccctcaagtacccctacacagatgattgatcgtttcccggaccatcaaagtttcgaagttga

SEQ ID NO: 615066 - DNA, 145 bp, Homo sapiens
  misc_feature (105)..(105): n is a, c, g, or t
aaactggtttttaatctttaattttccttaaaccctaacccctggttttaaatttttttaaaaaacaattttttttgcctttttccccttttttaaatttttggntcccctccaacctgggggggaattgtttgggaaagccaca

SEQ ID NO: 615067 - DNA, 169 bp, Homo sapiens
cagaaaatggacgaacttcacctccctaaaatcaccagtagtctcacaagctgaatgctaagggtgtcacacatgccttccacaaatgtgctcaaaacatatcaaaatcttcatttggcaaattgcatcatgctagaaaattccacccccaaacatttaaaacgtgccg

SEQ ID NO: 615068 - DNA, 309 bp, Homo sapiens
ttacatgatgaggtgctctaaggtcttatatatcgtggggttattgactctattgtctgaaagtctctgatgtatgtttatgctgtctgtttattcaaattcagtctatgtgaaagtagaaacatgtttatctagattcctgctgtagcctatagccatgactggtttgagatacccattccatcagagaaactgttggtagcaagtcttatctttattttgcacttccctttctgtttttttttttctctttttcttttcatttttcttctatctcccctgccttttcatttttttcttcttatttac

SEQ ID NO: 615069 - DNA, 460 bp, Homo sapiens
  misc_feature (450)..(450): n is a, c, g, or t
gctcccttagctattcatagcatgcaggtacataaagaaacaatagacgccgtactttatgcaatacctggaagaacagacatagaggtgggaatatatggtatggaaggtattccagacaacgacatgcatgaaagacgacgacttcttgaacagaaaacacatgaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggngaaaacataa

SEQ ID NO: 615070 - DNA, 118 bp, Homo sapiens
atttcttctcccactcaagagccactcaagtatgtgaagacaataagctgccctggtagcatctcaaggtctaaagctgcactccagcctgggcaatggagtgagactctttctcaaa

SEQ ID NO: 615071 - DNA, 331 bp, Homo sapiens
tctggaaaagctgaattgggttttggtctgaatcaataggaaacagaaaaaaaaaagagagagagacagagagtaaagataatggatccttgaggaatcaccacactgtcttccacaatggttgaactagtttacagtcccaccaacagtgtaaaagacccattatacaggctgcctttccagctctccaatcatacttccaagaaaactgctcactctcagaaccaaggttcaagttgtacattgggatttgggtagaggtaagaggaaacaccctcaaatagatttggatcattccagatgtcctataaatgaagtttgacatttaaaa

SEQ ID NO: 615072 - DNA, 365 bp, Homo sapiens
  misc_feature (7)..(7): n is a, c, g, or t
  misc_feature (160)..(160): n is a, c, g, or t
  misc_feature (204)..(204): n is a, c, g, or t
ggaattnggcacgagttcaaacttgaatgtcaagccgtctcgtcaaaccgttgatgctaatttattaattaagcctatggaatattctaaatcctctgttgtcatttcaacaatgttcacagcatcttcacctggagtaagttgtatcttaataaaccgnttcctttgtttatccctaagaagcagcttctcatcctttcatgnttgttttgcaagattgtagcagctcaatcacatcttcgggcttcacttcaaattctagttctcccactgtgtctaccacattggcaattacttcctccattgaagtctggaagccctcaagctcatccatgagagtcaaaaaatcaacttcctccgaactc

SEQ ID NO: 615073 - DNA, 216 bp, Homo sapiens
  misc_feature (175)..(175): n is a, c, g, or t
ctctagaccactgtttatgaggaggagctgaagactcgctggaagtataggattggccagatgcttgcttgggaggaaaggtgggcatctcgcctccagcaggcggggtaggtggcaatctcctgctccagccgcgtcttcacatccagcaatgatctggtactccgtggctctngctgctccatcttcaacagcgtagcgtgggcccagcttgct

SEQ ID NO: 615074 - DNA, 127 bp, Homo sapiens
gcgaattcactagtgattggagggcaggggaaagccgcagagcaactatctgatctcatatctactaaaaatacaaaaattagccaggtgaggcggggggcagtggctcacgcctgtaatcccagta

SEQ ID NO: 615075 - DNA, 721 bp, Homo sapiens
  misc_feature (14)..(14): n is a, c, g, or t
  misc_feature (70)..(70): n is a, c, g, or t
  misc_feature (72)..(72): n is a, c, g, or t
  misc_feature (80)..(80): n is a, c, g, or t
  misc_feature (91)..(91): n is a, c, g, or t
  misc_feature (94)..(94): n is a, c, g, or t
  misc_feature (98)..(98): n is a, c, g, or t
  misc_feature (110)..(110): n is a, c, g, or t
  misc_feature (168)..(169): n is a, c, g, or t
  misc_feature (176)..(176): n is a, c, g, or t
  misc_feature (264)..(264): n is a, c, g, or t
  misc_feature (307)..(307): n is a, c, g, or t
  misc_feature (410)..(410): n is a, c, g, or t
  misc_feature (471)..(471): n is a, c, g, or t
  misc_feature (514)..(514): n is a, c, g, or t
  misc_feature (707)..(707): n is a, c, g, or t
gttatttcctcctngcggcgcgcttacagtattaagtgcctctcctccagtctccatcccacaccggtgncncagagtgnttaggccagcngcnaganggaaggaataanaacagtgacattaccgtgggagggcacacaggccaccatctttggccctcaggttctnnagaaggncacggcgacacgtggccatggttacccctggcagacgatatcgtcctcgcagtgataggaatctcttccacagaggcagcagagaagnggtttagtgccatggatagggagcgcaaagataggacgccgcntgcccagaaggtgactggctgtgccttaggccttaagcccaggagtgtgtttatattctgtctgcaaggacaaaaatagaattcggggaaaataaggtgagtnacatctaaaacacttgtagcaggaaagacgtggagaagagcaattgcaaaggacagggtanactgcttgctggataatatttgcctttaaagagatgcattggnccacagcaactggaaaaggggtgtagcaagaagaatggaaagaagagaagcaaggccctctaattccacttacctcaaaagactgagccctgaggactatgtgaatacacaccctaaaggcaaggctctcactcaacatccctttctcacaaagcatctggtgtgcatctctcccacagtagggtattggccncagcagaaacagaa

SEQ ID NO: 615076 - DNA, 151 bp, Homo sapiens
acatacatcccaagttgggggacaaaaaagggggaagggggggcacgaaggtctttcattcaaaataaaacaaaataaaaaagtattgaggcgattattaaaaaaattttgcattacataatttacacgaaagcaatgctatcatctcccc

SEQ ID NO: 615077 - DNA, 492 bp, Homo sapiens
acagtaaccggcgctcgagcgccaaggcgagtattgcttgaatgttcatccaaagcacacaaccagcgagccccaagaaacagctagggaaataacagatgggtcgccctgacgctgcgccgcaaaaactatatatatacctaatgccacaggggacgctattctgcgtgcagacacaaggacacaactgttggcgtagcaagacctattctgagagcataaaaggagcgcccggaccaggagtccatccctcatgaaaaccacaattcaattgggggccgatcttacgatatacgcagtatttccggtacagtggagaaagactggggggccacaaccatatcacgccacgagcaaaccgggagatcacacccgcctttaccaagcgtccaaaagctcctagagcctgccaagtcaggatttcaccgcctaaagcaacgcccactacgcagcaccggcagcccttcttgccggtcctcggaacaaaccaac

SEQ ID NO: 615078 - DNA, 1313 bp, Homo sapiens
  misc_feature (248)..(248): n is a, c, g, or t
tggctgtgcccaactgttaattacaggggccctaaagggttggtgcgtgaacttgcaaaaaattcgggcccaaaacgtttaaccggccggttccaaacgccccggggcggcaaaaccacagcgccaggagagcatcccttggccaccaatgtgggcgccaccgtgtcaagcgggccccaaaggagaccatgccagatagtgtcgccccggggccagatggccacgttgggtgtcagtgttgtcacccnctacgctcgagggcgtcagatgtagatgagagtgcggtgaacccccacaggtatattcctctgtgtgtgtcccccccatatttgttcgccgcagagagaggcgcccagagggggggcggctctgggaggttcccccatctctgcgctactgtggcgccaccccccgtgttggcacagcgggactatcaacaggtctgcgctgtgagacccaggtgttttgggttgttgtaagaccctttttgtaggcgcggtgggctctctgggtgttgtgtccccctcttactctaagagggcgcgtaaacatctgtgtgcttataagaggatatttcttaccaaactcttttctacccccgtatcgcggcggacaaaaaaagtgcgtcccaatagaaggccttctggtggcaatatttgtcccccaacagagggggggcccccccgagtgaggcccccccaagttggacaccccccgaagaagaacaaccttaaaaaagggcccctaattgggtgttgtgcgaagagcgccctacgggggaaaaacaaacatagtgtgttctgccagaaaagcgccccttttgtggagcgccaaaagtgtgcgccctttgagatgaggaccagcccactttgtggtacgcctttgaggggagaaaccccccccaaaggggctaatatcagaatcaggggtaaggccggcccacatcctcatcattattaggccgctgtagaaatgacacaggaaaagatatctccccagtagtgcacacaccgggggggagacaccttttgtaaagcaacccccccagtgtgagtgttgtttggaccccccaacatattctacctgatatgatgcgcggcaaagcacgctgtggtgcccccgataaaccaggtaatttgtttgttgtcaaaaagaagaggagggggctcgccccccaaagaaatgtgtgttttagcccggttaggtagcgcgggagttacacaccatacacggcatcccccacctgagattgtgtgagataaaaaaaaaacgcctgccccttggttgtgatgtacaaccgccgagtagtcgcc

SEQ ID NO: 615079 - DNA, 130 bp, Homo sapiens
cactgattaccaacacaggcatgctcataaggaaaggttaaaacagtaaaaggaactcggcaaatcttaccccgacctgtataccaaaaacatcacctctagcatcacgcagtattacgaggcaccgctc

SEQ ID NO: 615080 - DNA, 148 bp, Homo sapiens
atttggctggacctcggcgtgtgcagtgtggacattcggcgtgtgcacgtgaagatcggcgatttcggtttgggttctcggcgtgtgcaacacgccgaggccccatactgcacacgccgagtcaccaaaccgttatcgccgatcttca

SEQ ID NO: 615081 - DNA, 705 bp, Homo sapiens
cgttctagcagcgagcggcgagcgagccagggccgacgcttcaccacttacttcccttattccactcggcaagctggcgcctcgtgcactttcaacctctgtttccccgcttcactggcaaacccccgtcatttaacacaacgacgcagggcacctgtgagcgcaggagcgagcctaaggccacccagcggcagcgcccgtgtcctgggcactcagcgtgctgcggcagagcaggtgcgatggctcccggactgtgcagggcagccgatacgtttgctgatagcaactactggaaccaccgggtgcgatggcagtgaggagactgcccagtgcctctggggctgtgcttgccactaacgacacgactttcctggcaaaggcagtctgcaacaagagggtaaccggtgacctcagcaaagaccgaatgttccggcactttaccccaaatgtgccatcacatagtgcttttctcttgccttcgctggtcgatctcccatcatgtaatcaactctcctccaacgcacacatgtcatcggaccccgctggctgcccctaactccagcattactaccggaaccacgcgactatggcgaaaggacaaccacacacattatttaacacaaaccccggaccaccccaccacccacacccaactcaccccaccccccagcacctccgggccaacacacctatttctacctcacc

SEQ ID NO: 615082 - DNA, 421 bp, Homo sapiens
  misc_feature (40)..(40): n is a, c, g, or t
aaattcaacctgtgttgtggccatgtgtcaagcattttcntccgtttttaaggatgaatagtattgccagtgtgtgtgtgtatgtgtgtgtgtgtgtgtgtgtgtgcgctttcaccccaggctggagtgctgtggcacaattatggctcactgcaaccttgaccttcccaggattaagccatcctcccacttcagcctctgaagtagctgggactatggcacatgcccaccgtgcctgtcttcactaaaaatacaaaaaaaacccaactaaacaaaaaaaacaaaaacaaaaacaaaactagctgggtgtggtggcacacacctgtggtcccagctacttgggaggctgaggcatgagaatcacttgaacctgggaggcacacgtggcagtgagctgagatcgcaccactgcactccagcc

SEQ ID NO: 615083 - DNA, 373 bp, Homo sapiens
attcgcaggagccaaagtcatctcatctgacatgtaactaagagcgcgggaggtggatagcggagtatagagagccaggtctcggactgcagcagctctacaggcagcagtgccatcagctctacagacctctttaggggacatggatggagctcacggagcaggaagtgtatctctggggaacgtgctgcctacagcggacattgccccgtttaagcagggtgtccagtctgtggctgggcaaatggctgtgctggccaatggtgtgatgaattccttgcaggatcgctacggttcctactgatccgagctctgtgactcaggcttacgatggtgacggccacaagagctccacagttcccaggctggggat

SEQ ID NO: 615084 - DNA, 380 bp, Homo sapiens
tcatcgtgctcaagcattctcagaagaactgtgcaagtcaatgagtcgcttgtggattctcatctggaagggaccccacgtcttagaaccttcaccacaaggactttttctgtagtgatgctcaaggtctgggcaggtatgcgaactggtcctttcatttggagattctatgcctcggctcctatgatgaagtcagcacacaccttttccagggctgtgatgttgcggctcgtcacagtagatcaattccggtgaactgccatcgtccagttccacgcgtgtcgtgccggtacgcttcacagccagagctgatgtagcggttcctgacctgaattctccgttgcggaggtccggtggggcgctgggaggacccggtccca

SEQ ID NO: 615085 - DNA, 305 bp, Homo sapiens
  misc_feature (23)..(25): n is a, c, g, or t
  misc_feature (39)..(39): n is a, c, g, or t
  misc_feature (66)..(66): n is a, c, g, or t
  misc_feature (103)..(103): n is a, c, g, or t
  misc_feature (111)..(111): n is a, c, g, or t
  misc_feature (120)..(120): n is a, c, g, or t
  misc_feature (142)..(142): n is a, c, g, or t
  misc_feature (150)..(150): n is a, c, g, or t
  misc_feature (163)..(163): n is a, c, g, or t
  misc_feature (169)..(169): n is a, c, g, or t
  misc_feature (171)..(171): n is a, c, g, or t
  misc_feature (189)..(189): n is a, c, g, or t
  misc_feature (221)..(221): n is a, c, g, or t
  misc_feature (226)..(226): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (260)..(260): n is a, c, g, or t
  misc_feature (298)..(298): n is a, c, g, or t
attttccgatcggtccctaacannntggggggggccctngccctattactatccatcctcatcctngcaataatccccatcctccatatatccaaacaacaangcataatntttggcccnttaagccaatccctttattgantcctagcngcagccctcctcnttttancntgaatggggggacacccngtaagctccccttttcccatcattggacaagnggcancngnantatatttcccaccaatcctaatcctaancccaactttttccctaattgaaaacaaaatactcaaangggccta

SEQ ID NO: 615086 - DNA, 193 bp, Homo sapiens
atttcaagtctttgaaatcaaatctcccttgaggcaaacttggcaccattcttcctctttcctctcatgcaggtaacaaggagatgagcagaggtggccttggtcctcgtcatgttgtgcatgggtctttcctctctctgctgtccatcctttgcatgtccagagagtccaaaaggctgatgagtggacaatc

SEQ ID NO: 615087 - DNA, 192 bp, Homo sapiens
tcgatacagactaatttttttgtatttttagtagagacagggtttcaccatgttggccaggctgatcttgaactcctgacctcaggtgatgcatctgcctcagtctcccaaagtgctgggattacaggtgtgagccaccacgcccggccctatgttgtattttttaaggaacctcccttctgtcgtcttctc

SEQ ID NO: 615088 - DNA, 97 bp, Homo sapiens
tagagacggattcccactgttgccccgctggattgcagtggggtaatctcagcccatggcaccctcgtttcccccaggtccacgtgattctcctgcc

SEQ ID NO: 615089 - DNA, 433 bp, Homo sapiens
  misc_feature (30)..(30): n is a, c, g, or t
  misc_feature (417)..(417): n is a, c, g, or t
  misc_feature (419)..(419): n is a, c, g, or t
  misc_feature (422)..(422): n is a, c, g, or t
accctgccccctgtctttcccctcctaggnataaagacagacatcccctgccctctgctcccccctaccacttagtgtacacccttgttacagagcctcagaacactgaattatggcccatttatttgaaaaatccttcctggccgggcatggtggctcatgccctgtattcccagtactttgggaggccgaggtgggctgatcacttgaggtcaggagttcaagacccagcttggcccaacatggtgaaatcccgtctatactaaagatagaaaaattagccggtcatggtgttgtgcatctgtagtcctaggtactctactcgagaggctgaggcaggagaatctcttgaacccaggaggtggaggttgcagtgagctgagattgcgccactgcacttcagcctgggcgacagananggntattctatctc

SEQ ID NO: 615090 - DNA, 131 bp, Homo sapiens
actctattaactatacctcctaaacgtattccaaatccatttatatctctccattttcaatgccatcaccctattcaaagtgatatagtgagtataagtaactgcggtttttgccattaatagtatgtatg

SEQ ID NO: 615091 - DNA, 133 bp, Homo sapiens
tgccccagctgaatggcatataggagtagttactgcagagcgtgtagacacagcactgactccatcacaattaaaaactttattaataatcatgtatttttactgatcacattctgatatgccattcttgctg

SEQ ID NO: 615092 - DNA, 426 bp, Homo sapiens
agcagctttgtcgacccacaagaagagaggtgtgtaggatatggtaatcctggatgctgtcattgaagccaaatcgttgccccagggcacttcagcccgcaagaccaaactcattgctttaattctggcctttgagctaagtgaaggtaagactgtaaacatttacactgactcttggtatgcctttttaactctccaactgcgtggggcattctacaaggaaaaagccctgttgaacgctgggagaaaagacataaagtatcagcaagagatcctgcaattattagaggcagtgtggaagccccaaaaggtggctcatgcactgcagaggacaccagcgagcttctacctcgattgccttggagaacccccaagctgactcagaggctcgaaaagcagcatccacccactaccaggcatcagtca

SEQ ID NO: 615093 - DNA, 185 bp, Homo sapiens
ttacatcttgaccttctgggtctctgaagtatacagcacacagtcagcccagatcagagctacccgggcggggagcaccaggtggttcattcatttagaccatcataccaagcgctacacttagaggaggcatctctttaagattgataacaccacgattcaactcatttcagtggatataaagt

SEQ ID NO: 615094 - DNA, 390 bp, Homo sapiens
  misc_feature (104)..(104): n is a, c, g, or t
  misc_feature (110)..(110): n is a, c, g, or t
  misc_feature (191)..(191): n is a, c, g, or t
gagccggcccgaaataagagaaagaaggaagggacgttgggaaatgtatctagcgatgcacccagcaagagagcactggtgaatagctagccagtctcagccangctacngtatgtagatctaagttcatttgcatttaggtgtaagatagctttataacttttaaagagttaaaaattaattatgggttnatgtttttaattctgtgtaaggcctccttcccaaacccaaccttttttgttcacaaagaaggcagcttagaatcctccatggatcccataggaatcttttttctttgactttaaacactcatttcccgagctccatactccattgagcatttcttcagttgggataactaagtgcagtccctttggagctcatcaaagt

SEQ ID NO: 615095 - DNA, 594 bp, Homo sapiens
  misc_feature (42)..(42): n is a, c, g, or t
  misc_feature (50)..(50): n is a, c, g, or t
  misc_feature (68)..(68): n is a, c, g, or t
  misc_feature (155)..(155): n is a, c, g, or t
  misc_feature (162)..(162): n is a, c, g, or t
  misc_feature (205)..(205): n is a, c, g, or t
gatttattttatatttaagataattggaaaggattttgaaantttgaagnttagtaatattaatattnttttttaaaaagtggatgaaattaggttgaagatgaaggtgttttttagaggaagtttttggatggtaatgagtttatttggtgatngtaattngtgttaaagttatatatagtataggtggtgtgtaagaagtatnggggatttattatttttgaggttttttggggagtgtattggtatttgagtaatgtttatgtttgggaagaatttgtttttatttgtttagatgatgaggagattgagtttgtttatgagtaagtggtaaaggtttttaaataagttttttttgggatttttttaattttttttattttttttataaaggttttggtggtttttatattgttatttaatggatatattttaaaatggttagtgggtagggaattttggagtatttgttttgggatggtgtggtggaagaggggatgagggaaagaaatggggggtttgggttagatttttattgtggggtgggatgagtaggataatatattttagtaataaaatatagaataaaaatta

SEQ ID NO: 615096 - DNA, 227 bp, Homo sapiens
actgacgaagccgtacaaagggagatggcagttgacttgatggtgatgcgaccgctcctgctcgtccttccgggttcagtgaagcgtgtctccccggtcccgggccggaggctgatatgcccgccttgcacaccaggaagtctgtcagcgtggacttgccagtggtccacgtgggctatgacagacatcttgcggatgttggccttcttctacggcttcgtcggtca

SEQ ID NO: 615097 - DNA, 166 bp, Homo sapiens
agatcaccgggacggcaccagagcgaggtgaacttgcagttcctcacacactttatgtaaacttagcttaaggacggggcctacaaaagtgttcgtcttgtgccgttaaacactgctaagcaccaggacagccagcacccgcagagactcctccccagtgctccat

SEQ ID NO: 615098 - DNA, 621 bp, Homo sapiens
agcgggtcgtgtccgccgcggcgcttgcgggagtggcctggtgtgagcgcagagtcgggccctgggcagcagcggctgcgcggtaggacctcggcgcagcgtccgcgggctccggggcgggggcgccggcggcgaagccccctccccggggaggcgggacctgggtggagctcccgagtcctggggagcgtctggcggccgggaacgactgcagtcagaagctgtgtgaatcgagcgcgtcattatcactcgtagcgtgggcatgctacacagtacttgtgcacggtccttgtgttgcacccgtgtgcattcacgtctgtaccgacctttactgagcaagatcccgcgggggtcgccttcggaaggaacaaactctcggatagccgatctatgcagaagcggggtttaccaggtgcccgtaaccttggcccggtcacaggcttgatgtactcaagagagttatgtatgtacttctggagtctagagtgtagcacagtagaagcatctggacgtcagtttgcctggagttgcgtttctcgttacttcaccgcttgggaactagtattgaccatgttgagcatctgtcgttaccgttcaggcaaggtgcagtcctacgaagaa

SEQ ID NO: 615099 - DNA, 138 bp, Homo sapiens
ggctagtcccacctcctgtatcagtaatcctccaacttcagcctccaaaagtgctgggataatataagtgagccacggcgtctgggcttgggatggccggattctatggtagctctatttttaattttttggaggaac

SEQ ID NO: 615100 - DNA, 443 bp, Homo sapiens
taaacccccatccttgaacctgcaccccgcccctgacttgctggctagtatgcagctgcacaaacttaatagccagtatcaggggatggctgctgccactccaggccaacccggggaggcaggacccctgcaaaactgggactttggggcccatgcgggaggggcagaatcactctctccttctgctggtgcccagagccctgctatcatcgattcggaccctgtggatgaggaacagctgttgtcacttgcggaggaactggggttggaccgagccaatgagcttacggagctgaggctgtggcagaatgagtttgccttcactgcggactttccatctagctgctaatgccacgtgtgcgtagggacggaggactaaagccaccaattttggtgtaaataaaaataacgtcccttacaaagtgtccgacctgaagactgga

SEQ ID NO: 615101 - DNA, 138 bp, Homo sapiens
aaaagaagagatgaatataaggaaagaaatcataaagagaaagggagcttctctgacacaggctcatgactagcatgagctgtggtttgacatgtttagttcaatggtttcacactgaacactgacccgacaaatggg

SEQ ID NO: 615102 - DNA, 153 bp, Homo sapiens
ttcatatccagtgctttcatgccaatcaggaagagggaagccagtgaggagttggggaggacggcaaaggcctggacatccacggcaggttagaatgtaaggccggtgggctgcacatgacaggtgtggcggcatgaaagcactcgacatgaa

SEQ ID NO: 615103 - DNA, 450 bp, Homo sapiens
  misc_feature (163)..(163): n is a, c, g, or t
agggggggggaggggggtgtcccgggggtttctccctccccccccctctccccacagggggggtgtttttggcccaatcatcgggggtttcctcaaggtgggtttccccccccccccctttcgccctagggggggggggggtgtggggggggggtttttttanaagagcctctttttttcacccccccactccccggggggggccccccccccttttttttccccctttggagacaccggggggcccccccccccccgccttttcctttgggccggggggggggttatatttttccccggggacccccttggcccctttggcctttttcaaaaacttttttggggccccctttgggggggccccccggggggcccggcggggttttccggggggccccccccccccggggaaaaaggaaaaaaattttttttttggggtccggttttata

SEQ ID NO: 615104 - DNA, 96 bp, Homo sapiens
aggtgaggcaggagaatcgttaacctgggagacagaggtgtttgagctgagtcaggcattgcatccagcccggacaacagacacggactccatctc

SEQ ID NO: 615105 - DNA, 395 bp, Homo sapiens
cggcttggaggatttcggaacaaggcccactgtaggaggctaaaaggattccttggcttcaaccaatccttagccagaagttccaagtcgaccaccagccaaaatggtttccaaattttgccaagcttcccaaggtagcaaccttgaaaacttgacctaaaagctttggggcttcttaaaaccttgccaccccaagggcatgggttggttggcggcctattcggacttacagtggtctcaatgggcagacgcctgggcaccccttggggcctgtgcacaaatggccatgggccaggtctctaaacccgaatggttttccaaggcctgggagatttgctctacaggacggttggcaccttctctggggcgcggcccacacgcacccccaccccccc

SEQ ID NO: 615106 - DNA, 280 bp, Homo sapiens
  misc_feature (222)..(222): n is a, c, g, or t
cggcacgaggcggactctcagtcctgcaggggccgcggacacaggtggggaggagtgggggagtttttccctgggagaaatgggaagcgtcgaaggattttaaggagtgcggctggtcgggtttgcattcggggaggtcgctttgtctcttgagtggagaatgaggaggtggcaacagcaggggagtcaccaggaagcagccctccccagacactgctgggnccttgatcttggactccacagcctccagaacaatgagaataaatttctgttgtttgta

SEQ ID NO: 615107 - DNA, 448 bp, Homo sapiens
  misc_feature (26)..(26): n is a, c, g, or t
  misc_feature (34)..(34): n is a, c, g, or t
  misc_feature (45)..(45): n is a, c, g, or t
  misc_feature (82)..(82): n is a, c, g, or t
tccaaaagaaatatgaacaagatttnaaaatggnaaaaaaaaaantagccagcacccccatcccatttccctccccctatantggtaactgttgaaggaatggccagcctagtagcccactgtggcctccttgagcacttgaaatgtccctttgtccctaactgagaagtattggcccaggagtggtggctcacacctgtaatccctagcagtttggaaggctgaggtgggaggatcacctgagccccaggagtttgagaccagcctgggcaatatagtgagaccctttctgtatttaaaaataaataggctgggcacggtggctcatgcctgtaatcccatctctcagggaggcagaggcgggaggatagcttgagcccaggagtttgagaacctgccttgggcaacatagcaagactctgttctccacgaaaaggaagaaaaaaaa

SEQ ID NO: 615108 - DNA, 536 bp, Homo sapiens
gaggggggcaagaattattaggtattctagaatcaagttcttgatacctgttgtggcaagtatttttaccaaatatatggctttttcactttcgtgtctttagaagagagaaatatttttgaagtccaatttattgatgtttttcatttataatttatgctttgtgtatattgtttaaaactctttgccaaaccaaagatcattaagattctctcttatgttttttttctataagctttttgtacgctttagcccctgacacctgggccccagtgatccactttcaacattaaacttttgctatgtaacttcgagcatacaagggctcaaggctctcactttctctcatgaccttaactcctcgacatcacatctctcgtgtcccactctccttaggccgcctctactctagctcatgctggcctttaacatatcactctgtactacttaactgaactcccaacattacaacctctagccacaaactgcctattccaagagcatatctcaagccatgtccaaaactaagccgttaa

SEQ ID NO: 615109 - DNA, 366 bp, Homo sapiens
ctattcgtcgccctgtagatcaggaacttggggagccttcctggtttcttattataatttcccccagatttatacatggtggaaagattctgggtcatttggatggtacttttggcacctggtaaccaaatcagcaggaagcccaggtaattaacggggacccttatgatcatggtgttttgtgcagaattttgcacgaggaaatagtttcgagtttttttttttttttttttttttttttttttttttttttttttttttttttttttttttttttttttttttttttttttttttttttttaaatggaataaacttttaatcatacagagaaaataatttttgagaatcaggacaggatcttcc

SEQ ID NO: 615110 - DNA, 304 bp, Homo sapiens
tttcccccccttagaagttgaaaagagcaaggaaatgacttgttcctccttgttttaagagcttttgtaataaatgcagccttgtggcccctttttagattttaagcatccagaactttggaatagatttttgtttttttaagacccattaagtttggggcattttgttaacccagttgttccttaagcccttgttcttatgtagggggtttcccaaaaggtccccccccccctttagtagaattgggaagttttagcccatccccagggagggaatcaggaataaaggcagatggttttccca

SEQ ID NO: 615111 - DNA, 327 bp, Homo sapiens
  misc_feature (148)..(148): n is a, c, g, or t
  misc_feature (170)..(170): n is a, c, g, or t
  misc_feature (315)..(315): n is a, c, g, or t
aaggatccctgtaggtggtgtgggtagaagaggtcgctcgtgaatgagagggtcgtgtggtacgcgtgtcggtgtgctcgggtcacctgggggtggctctcttaggggatttctggtgcagcaagaaagccattgtttccatttttgnctgagtgatcctcttaaacggngaatcagatcggggccctccttcacttaaaaaccttgtgtcatagagattaaaattcaaagtccactagttttgggctagtctctcctcctgatctctccaaactcatgggcctcctatctactccttcctcatcgtattccggntaaccacaacca

SEQ ID NO: 615112 - DNA, 348 bp, Homo sapiens
taccgggccaaaaatgtggttcaaaattctccccggactttccgtcatgggggtgtgcttgttgattccaggactgggtactgggtacatccccaggttccctaacgggggcaaggaaaaaagggttgctccttttgggtatccctggagtttgatggaaaaagataggggcatttttggagttgatcgtttctatgtgtcaaagggtttggagaaccttgattaaggaagccttttcctgattgatgaaaaaaataactcagttatggccctttacccctgctaaaaggttacagtgtattatgtagcatgcaatgtgttatgtagtgcttaataaaaattaaatga

SEQ ID NO: 615113 - DNA, 181 bp, Homo sapiens
atgtgttgattcaaccaaggaaaggggagtgatagtttacatgctggtagcgtcgttcgatgcatgcacgagcgaacttcaaggatgcacttaagatgagccttaaagttattatcatggtgatgagacagaacccagactgacgggatagcatacatgggctcagtcgaacggactggga

SEQ ID NO: 615114 - DNA, 156 bp, Homo sapiens
gtgcgcgtgtgcacgctgattctgcggtcgctctgacggctcccgtgtaccctgccctagtgatccgttctcatcggtgggattgcccttcttcgtgacgcccctcactggcaagatcatcaaccttgaggtcgagcccagtgacaatatcgggaa

SEQ ID NO: 615115 - DNA, 114 bp, Homo sapiens
gatcgagccggtaccgttctccccgttgcgatggcatcagctcaatttcaggtcctcctacccagcgaaccgcaggcaagttgttctgaagaagtaagtgacttgcttcatcat

SEQ ID NO: 615116 - DNA, 347 bp, Homo sapiens
ctgtatttttttcagtttacagaccaataataaaataattttgcaattaaaactcccagataggctgggtgtggtggctcaagtctataattccagcactttgggaggccgaggcgagtggatcatttgaggccagaagtttgagaccagcctggccaacaaagtgaaaccccatctttactaaaaatacaaaaataggctgggcatggtggcacatgcctgtaatcccagctactcatgagactgaggcaagagaattgcttgaacccgggaggcagaggttgcagtcagctgagatcatgccactgcactccagcctgggtgacagagtgagactttgtctcaga

SEQ ID NO: 615117 - DNA, 120 bp, Homo sapiens
  misc_feature (66)..(66): n is a, c, g, or t
  misc_feature (68)..(68): n is a, c, g, or t
tttgatttgtagatgttcacccagagtcctctgtaccctcctggagaggattttcttactcgtttngncatgaaggggagctagggaatggatggaaaaaaggaaccagtttgttgattg

SEQ ID NO: 615118 - DNA, 549 bp, Homo sapiens
agcggggtctggggctgttaccattgagtgaccagaaaggctctcggtgcaacagcgttcctgcagaattgcttccacgtaaaggggaccttcgggaaatttcgctggataccggctggaattgacaaaccagcgtccctgagccttgtgaggtttccaggcatgtgctgattgcgaggcaacatgtctgcttcggtgaacagacaagccttcagcttcagctactggagatggacaatgcttgttttctatgtttcctaaccacaggagcaagtcaaaaccttgaagatgtacaatgccctgaacgaactataacacgacggtactttggaaagggcacaagggacaggcgcatgccagccaaacaatcgacacttttgtcaattaccactccagattgaagaagcccaagaaggagactttctggttctccagactggattctgtcccgctggttacacacacttcaatggaaaccctccaacttaatccatggtgaacattgaattgcaagttgaacattgcctccacaggtacccacgtatggtc

SEQ ID NO: 615119 - DNA, 117 bp, Homo sapiens
gttatcaaccacaatatcccagtgcccagagggctacttgcataccacttaatcacttcaaagcgcttcttgccgtgccgctgttggtgccgctcggagggaactcggtcagaggtg

SEQ ID NO: 615120 - DNA, 310 bp, Homo sapiens
tttttattttgagacggatcttgttctcttgtacaggctggagtacagtggcatgatctcggctcactgtaacctccacctccggggttcgaacaattctctgcctcactctcccgagtagctgggattacagttgcccgtcaccaggcccggctaacttttttgtattttttagtagagatggggtttcaccatgttgaccaggctggtcttgaactcctgacctcgtgatccacccgccttggcctcccaaagtgctgggattacaggcatgagtcactgcgcctgtaaaaattattttttacaaaaa

SEQ ID NO: 615121 - DNA, 190 bp, Homo sapiens
tgtagaggatcccagtgtagtgtataagcatatcaatattaaaaaagcagcagcagaattggaattcatccaatccaaatgcggcatcttcaaacctccatgatgctgcttacatgtctcgatcccacttaactatcttgggctgtgacaaagtaactgggttcacacggcaggcatactcatctttttc

SEQ ID NO: 615122 - DNA, 387 bp, Homo sapiens
ggaaatctgaaacatgctttgtcattttctctgttattgtttttgtatgttataaaacccccatgtaacagtctcccttatggtcagtgattgatgacctcaattttgatttagattatcacatgtgtttggtttctggaaatataatcttcttgtcaaagaaatatctctcagaatatacatggggcttatttatgttgttttcgtggtcctttttattctttttacttcgctgtgttttctgaactgttgttgcttggcctcctcttttgcttttccctttgtgacctgtttgttttttggaatcacgtcatgatgttcgatcttattcttccatctttagcggtgccatggtcgacactatgctacttggttgagcctggtgcg

SEQ ID NO: 615123 - DNA, 124 bp, Homo sapiens
gttggtcaaggacatgaggatcaaggtccctgggggagatctatttctcttccttcccattagggattcagagataattgattcttccctggggccctctcaagggatgaggttttgagagatt

SEQ ID NO: 615124 - DNA, 432 bp, Homo sapiens
  misc_feature (2)..(2): n is a, c, g, or t
  misc_feature (82)..(82): n is a, c, g, or t
  misc_feature (84)..(84): n is a, c, g, or t
  misc_feature (93)..(93): n is a, c, g, or t
  misc_feature (101)..(102): n is a, c, g, or t
  misc_feature (160)..(160): n is a, c, g, or t
  misc_feature (199)..(199): n is a, c, g, or t
  misc_feature (205)..(205): n is a, c, g, or t
  misc_feature (234)..(234): n is a, c, g, or t
  misc_feature (313)..(313): n is a, c, g, or t
  misc_feature (375)..(375): n is a, c, g, or t
cngaggttgcaatgagttgagatcgtgcaactgccctccagcctgggcggcagagcaagactgtctatgtatatatatatgncncagtttttnagaatttnnagaacagttaaagctgttcttagatatttaagaacagccttaacagaaaatatgaganactcttatgaataaagtttaggaacgttaagtataaatntataantactaatggagtattgtgtagtcattaanagtatgtttagggctgggcctgtggcttacacctgtggtcccagcactttgggaggccgaggcgggtggctcatttgangtcaggagttcaagaccagcctggacaacgtggtgaaccctgtctctactaaaaatacaaanttagccaggtgtggtggctcatgcctgtaatccagctacttggggggctgaggcagg

SEQ ID NO: 615125 - DNA, 144 bp, Homo sapiens
gacctggctgacgaggcttgtgcgttgagagagtggaggaacattgagcccaggaagctaaggttgcagtgacctgtgatcatgccactgcactccagcctgggcgacagagtgagactctgtctccaagccgcggtcaaccca

SEQ ID NO: 615126 - DNA, 364 bp, Homo sapiens
  misc_feature (310)..(310): n is a, c, g, or t
tgatgaggaacgccctagcctggaggcactctgaacagctggctccacgctcccattctaaagggcacgctcctctcggtctgcggaggctcagtgcccctggcataggaacagcagcttggccactgcccacccaggtcactgagcttcagttggaagtggcagcaatgggcttatccagttcaaggtcaatgctggagcttgtgggatgtaggctgctatagcaagactcgcatacgtcgattgggttcaaagagctgctggctggtaactggaaccttctggttacaacaactggagcagaatacgntcccacaattccacgtttgatcaacacggtcagtgtccctgcagtgttgcttcc

SEQ ID NO: 615127 - DNA, 268 bp, Homo sapiens
aaaaaaaatgttctcctctaaaaggaaccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttataaa

SEQ ID NO: 615128 - DNA, 666 bp, Homo sapiens
tggaagggaaaattggttttatttcaataattttaatgtacagaaaactcaacagggtacattaaacccagttaagtgggcaagttcttaagcccttggcctttcacgagtctgtggggatacgagccacagacttaggacccaggacattggccaccccagtgacggcggatctcatcgtatctgtcattggtaatgggccctgatagcttccaccagctaagccaaagcgccttggtctacccgagtatcacctgtgtgaaggcagacagtggtgcaggtctccctggtgggactaaactgtcccagttcttggccttcccccttgataatggcatgtaggggacccccatttaacagacatcagggcaggcaaagaagacaaccagctccgatggggatccacgtctgtggtgcaatcaccaccagttgagcttcctggttcttccaccaaggttgttgacggtgtataactccgtgtctcgaaggcacagggtggtctacttcgtggggacgtccccttgtgccagcagccttcttactcggcccggtgccaacaagtctctggtacttctctaggctaggactctggtctgactttgtggggccagcttaagccagttgagtagctgtatgggcggcccaggcctgggtgacccgggttaa

SEQ ID NO: 615129 - DNA, 400 bp, Homo sapiens
agtgatctagaggatcccggagatatttgtgaagttgtgcaattactttggctctttttctgaaatatctaggctgaaaaattagtatgtttcacccgttattgtattggttatttatatcatctgttctcctggacagggattaggctttatgtgtagtgtattttattacaaaatcccgactgcgggtataatactatattaatacaacctagcttaatttttcaaaagctttctttaatgagagtgggaaatcaagcaccatttctgttttaaacttcaggatatggatttagagaagtgtgagatggtctatttacaacatagtatgtgatacgcacttaagaatgatgttctggataaatctaccgggggcggctaccgcgcacgcattcgtaag

SEQ ID NO: 615130 - DNA, 351 bp, Homo sapiens
gacaccccttccccagcaagatagagctttgagtttcggggttggatatggcgttactctttccatggcttacaggtggctgaaaagtaaatggtacctgtaaaggaaaatcatacaactcagcatccagttggcatataacgaattctgtatttccaatttataatgaatactttcttcagcattttaggtcaggcaggggagcagcaggacattcatgcaactggggtcaacacccattttgcaatcattcagcattgccactatcctgtcattcttgttttcacatttggcattagcacacatttcaaccatcagtcattcttcaagtcttttgtctggggtcaccgc

SEQ ID NO: 615131 - DNA, 272 bp, Homo sapiens
ctcccgatctacatccagattactaaacacacgggtattagtattctattgtgagctgtcttacaagtctatgatacattatttttgacctagttttttccctgtttgaactttttctccgcataaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggt

SEQ ID NO: 615132 - DNA, 836 bp, Homo sapiens
cgctgtcgccttagctgggagagcgagccgtggtggctgttagggagagcttatggtcagccgtgaagtactgcctgcctctagtgtcgcgtcctccagtatccgatgggagcgccgtccgcggggaatgtgtctctctgatcatggtgcctcgtgtccagctctggggaagaccgagacgaaatcgagctcaggctgggcgatagcggagagggctctagtttccgccgttccgacttgcccagcgtttcaggcaactttgattctgacgagcaggagctgcggattccaagggcaagggcttgtgtacacattattgtgcgatggaacggacgacgagggagccgtaggcacagcatatgctagttacacgtgtagcaggcatggtcacgacgtccacgacatgcttcagtcgcacaccagccagctcttgggagttgcatggaacggccctgagctgcaacgctggaatcaacccggagagcttacgagcattgatgcctgagagcccagctgtggagcgacagtcttgaacaagagctgcaggtgactctaatgtgcagctaaagctaggaaccactgagctacatctcagggaagactgaaaattacaaagaatatgataaaatcttacttcaggaacaaagctacgtatgttccaggttaatgtataagtggttagaggtaaaagaaaagtataagtgggtacacagtaggtgtgaacattaatgggccacctgagaataatatagacacagagctctgcaataaggtcataaatcacatccaggacaaatagggatatcaatcaccataaaagcataagacaattgaga

SEQ ID NO: 615133 - DNA, 236 bp, Homo sapiens
tcagagagaaatagtggtgggataaaaatgataggatactagtataatgagatcaggttcgtccgtattaatgtgtgtatggtgtatcatttgttttgaggttagttatgattgagtcatagttgtggtggtggttagtcggttgttgatgagatatttggaggtggggatcaatagagggggaaatagaatgatcagtactgcggcgggtaggcctaatttctctcggaccaatg

SEQ ID NO: 615134 - DNA, 165 bp, Homo sapiens
gctcggccccgtgatgatgccctgcactacacgccttcccggtagtaccagaacgtgctcccaactatatcagtgcggtgaggcgaatctgggccgggaacgagcccggtgttttaccatcaagtctccgtcggcagggcatcaatcctcgagctgtcctcgagg

SEQ ID NO: 615135 - DNA, 267 bp, Homo sapiens
ccccggatgccgctagaggccctgatggactcctgaccataatcctagccccgagttatccatcctgagccagggaacagccccaggggtggggggtgccggcatctcccctagctcaccaggcctggcctctgtacagagagacctcttggctatttctgtgtccagttttggaggctgagttctggttcatgcagacaaagccctgtccttcagtcttctagaaacagagacaagaaagtcagacacaccgcggtcaggcactcg

SEQ ID NO: 615136 - DNA, 668 bp, Homo sapiens
  misc_feature (246)..(246): n is a, c, g, or t
tggttctgaaaaagaagattgagggtcttcaacagtgggaaccaagcaacttgagcaagttgattcggttcagtaaagtctggccttgtgtgggctcttctagagggagggccattgacgtcatcggtcctgtgcggttgtctgcatagtaacgcacattgtggtaaggacaatttagggcctacacctaggcatgcatgtcatgcgtatcttgatctatcagtagacgctatggttaattactanccctcgataagctgctctgcatacatctggcaatggcaggtggacctcttcgagctattaagtcattgaccactatcgtcagaccaatggatgtgcgtaacaaagtttcagtcagagaatcagtcagagcataccttggtcacgtacagatagggctcaagcaggcgaggacagtagctgttgcatggcaggagctcgagttacatgcagctcagcgaacgcttggtggcagactacagaccaatgtcaacgcacaggggttctatccattgtgccctccaggacaagtctgagcaaacccagcctgagtggggctgacaccaactcatgggttgcgcaaatacgcgtgtagagctagggcgtcacgcgccctatacatgcacccttccacagcaacagctggcccgggaggtacagctaca

SEQ ID NO: 615137 - DNA, 223 bp, Homo sapiens
ccccgcctccgacagtgtcctcgctttacctttgacctctccggaggttccgctgcctccaagccggacttagggcttcaaaaggcgggggtgccctttggagtcccctaccatgactgaaggggccaaagactggcggtgttttaagactccgggcccccccccgcgctgtcaagcacagcctgtttttggtcagttgcaataaacgtgacattttgggaga

SEQ ID NO: 615138 - DNA, 108 bp, Homo sapiens
  misc_feature (1)..(1): n is a, c, g, or t
ngtttatcgatgccacgactcgaggagcagcagggagaagcgaagcagctctagatggtgtttatgtagggattcctacatgcaggaggcccccgtgaaagagtatga

SEQ ID NO: 615139 - DNA, 128 bp, Homo sapiens
tcgccagggttttcccaggcacgatcgccaggtgtctcccaggcacgatcgcgaggaattcaccaggcaccaatgccgggatcttcccaaccatcatagccaccatcaccctccttaacctctacttc

SEQ ID NO: 615140 - DNA, 411 bp, Homo sapiens
gcaaagttacaactggaatctggaccttcgccacttgagaataaactcctctccgccgtgagattctaaccgcactcttaaatccactcttctaattactgagcacagtctgcatgcatccgttatagcttcatcccatgtagcgaagttttttcttacctatttgatatctgaggatatgagaaaccctcgaaggcattgtccacatacctggcttgccctgcatgatcgttggctctttctttcctactgggcataataaatctgcaggatcgagtggattcctcaggagcaagctgactgttcccagactcctcattagcagaagagaccctaaaacacgaccaagtttgcattgactgcagatttggagctaattcagagaactctggaaactcattttcccacagt

SEQ ID NO: 615141 - DNA, 146 bp, Homo sapiens
tggttgccagtttcccaggacatcgctctccatgctgcccagtgctttatcagtatctattcgtttgctggggctgccatgaccgatctgccacagactgagggtggtttaagtcaacagcaaattcctccgtctcacagttcctt

SEQ ID NO: 615142 - DNA, 145 bp, Homo sapiens
cgactctgactacgcgcgctcgatcgtagactacgcggtctcgatctagactacgcggctcaggtcctaaactaccaaacctgcattaacacatttcggttggaggacgacctacgagagcagaacccaatcctccgagacagta

SEQ ID NO: 615143 - DNA, 288 bp, Homo sapiens
caatgggacgggtatctttggaaaatgcacagcaaatgtaaaggcttgacaatacctttgtgttatcacaaattgacttcttatggttaaaactcagtagttttgaatagattatgatgagccattaatttattttagtagaattggagtctcactacgtagtccaggctggttatcgaattcctgggctcaagtgatcctactgccttggcttcccagagtgctgggattacaggcatgagtcatgtgcccagcctttatttttacgtagtgaagagccttcttggt

SEQ ID NO: 615144 - DNA, 205 bp, Homo sapiens
gtgatgctcttgatctcctgacctcgtgctccacctgccttggcctcccaaagtgctgggattacagccccttcactcactccactccattcactagcctcctcctattgccaagccagccaggcgtgcttctgcctcgcggtctttgcatttgctactcctctcgccctacaccactcttcccccataaacatccggggtccga

SEQ ID NO: 615145 - DNA, 1605 bp, Homo sapiens
  misc_feature (1248)..(1248): n is a, c, g, or t
tcccggtgcaacctgcaaaggggcccatacgggcgttgtccgggatccccgtcgtaactttaaggggaaacttttcacaatggctccggacccctttaagtctccgtgcaaatgtgaaggaggaggagtgttcattaagttctcctttgcagcaggacacccacttataggtgtggccaccaatcttctgtggcattctccgagagagtggaacacgagactcactatctctcttataacagaggaaaagagtgtgagagtggcgctctctatattctctctcattacacatctctctcgaagagagagacacgcgtgggaagaagagtcttctctgtggcgtggcacagcctgtgcgtggggaccacagtgtgtgtgtgcccccaatgtatgaaaacccacccgcgctgcgcgctggatgtgtctccgacgcgttgtgtatatatatctctctctcgccgagagaaaatatcgctgtgggcccacgagagacaggggcctgtgtgtgccgtgtgagagagtgttttgtgcgtcgtgcgtggtcgccccaagtgtgtggcaccgcccacaactctcccacacaggttgtgcgttgttgggccccggcgtttttcacactctcccctagtgcggacacacctccttttttcacacattttcaaccacccgccaagaaattctctcacatagcggcgtcaagctcccctcattcctcgcggagtagaagaacccccccaagcggggtactacttcctcctgatgtgagtagagatttcatcacatgttgggcacccccccccggcaggagagcgatcctggtgatgcaacccaccaccacatcaagctcctcctctttctcacaacgggttgatgaagacgacaaaactcctatacatgatggtggtcgttatcaacccccgcatcaataaccaccattatataacccccctaatcgttggtgcgcgccgccgaggctgctgggttggtacttaccaccccccaacgagaaagatgaattattgtcttcattcgacccctcttctaggtaggaccacgccccacatagaactgttggttgctagtagccacccacaattgtttgtagggcgccaaaatcaactccccgtccaaataggttgggccgaaaccacgcaacaaaccactaagtgatgaggggagaagacgcagtgccatccccccaaaaccctcctccacccaccgaagggtgggagggagacgtgcattacntaactcacccaccgtctggtgcgtctgtaatgctgctggcaagtccaaacctatgatcgacagtatggtggcaccaatcatgccggacagcacgacacaacacagtgttccacactcagatcggccacatcccaacatgattgacacctggtagttttgagtgcaaccaaccccagccacataagattattttcgtccccccgccgccgggtgatgatgtaaataacaaacactccccccccccatcctatattgtgagtgagacaaaaggaggagtcacacaaatgatgtggtccacagcgagtgaaaaaactaccgagcatgagggacaacacctctcactctatctacaccagt

SEQ ID NO: 615146 - DNA, 182 bp, Homo sapiens
gccagagctggagaggtccattcaggccaagttggaacttcctccttgaccctttgggttaatgggttctcctcctttgttttctcctcttcggtgacttctttcttctcctctgggtcttcctctttttcatcctctgtgttgactctcttggctttcctgaagttggaagagttcttgcg

SEQ ID NO: 615147 - DNA, 172 bp, Homo sapiens
caatcatagctcacggcagccttcaaactcctaggctcaagtgatcctcccatatcagcttcctggaaataacaggcacatgccaccacacccaactaatatataaatttttcatagtcttcctgtgttccccagcatggccaacatggtgaagccccctctgtccttaaaa

SEQ ID NO: 615148 - DNA, 619 bp, Homo sapiens
atccgagatctgagtcagtcacttctttgtagaggcgtgatgtacaggtagtagcccgactcatgggtgatgaacaggctggatgggaacggcactgccggtggtggtctggcggatgtagatctagacctcagcctgtaacacagggagtgccacagccggctgccgtagcgcataaccatgtagcgcacggactcctcgagtcttgaaggggtccatgatgacgcgtgggcacgatagttgaggaagatgtggttgcaggtcggtgcgcacgctggtgttattgaacgcgatctccagctcgtccatggcctccaggagcagccgctcaccctcgtgcggctggtcttcagaaggaggcttcctttgtgatcaggtcagagggcctgatgatggcgcggatgagagaagctatggtacgtcacttccacaccttccttcaccttggcagcacccaggtaaaggtgcatcttgtggttggcacagggcacggcggtcagatcgaagttacgcatccggttgagttccagctggaaggccaggacaggttccaagtgacggtaaatgcgactactgcaaactcatctcttgctctgaatgttgaaaacctgggaaattc

SEQ ID NO: 615149 - DNA, 499 bp, Homo sapiens
tctactgacatgttccatatagaccttcttgacgagatcctctcttgataccctgatacattatgacacagcgctcctcatcttcctgcaaagagcggttggcgtggaccaccatctgaagcacgtcatagctttggcctgagagattaggcgagggtcatgcaatcgtagaactgggtcttcattatgaccagcaggtgggctgacaccggagatgccccagaagcgagtccgaaaagtcaccactggctggatagcccctgagctgaagagcttgctccaggaggcgtcgctccatggggctgagcccttcatgcaggtagcccatcccatttagcagcgtatccttgagcgtgctgacacttagcttctccaggtacggaatcagatccttctcggtgcagtgcaagaacctctgccgtaggatgtctgctgcccaggtggtgaggatgtccatggcagagaggcgggtctgcttgcgagacggcccaaagacaat

SEQ ID NO: 615150 - DNA, 1332 bp, Homo sapiens
gcgatgagtaatcttctatgaatgtcactagatcatgcagggctgttaatctcaaggaaccttccagatgcagcgtggtacttatttgtgtgcacttaaacttccgcagtcagtaccggggtagggcattagacagatcaatctctagtatcttgaaatccattaccatagatggtcataaacctaatcatcttcaccttcaatcatagttcgacatcagtgaacaagcataaaacagtatccgagcacatatggttcaggtccagtagatcgcattcgtaactcggtcaagatgagtacttgcatgtctatgagacccttgcagtagaggaacccagtgtatgggtgatgtaggtccgaacgtagtcgcttgggcgattggtgcactattaactctctgttgtttgaactatggaaactaagcgaattctagataactatctactatggatggaccttgccagttcagtccaaaggcgcgctccctggcatgcaatgacgtgccccgctatcacactatttaaaagatccatgatctcaccttaacacggacggtctacagagatgtcctcagttgggactacagtagcccctaaggggaaaaacttggatttacacaccatgctcaacaaagcattccctgtgtccatttccttcgaaggccattgtgcctaatctagcattgaagcttaattcagcgacctgtgaataatcagttctcacacacaacgaccactactcaatcccagggtcttccaattcagtcgctacacacgttgctatggccctcatatcaggcgtacagtcatccatgccaagataccacggtttcgctatacaggacacggtgccttcaaagatagtcccccaaaattaaacccaccgaaagtcacgcgccagggcgcaccgtctgggcacacacgcttcgcgcctgctgggagccacatatgggaccgcgcgcggaacgagttcgatgagcccccagcagggggaactatggccccaaaccacaaggtaacacatagacattggtccactgacaacagcccgcacactacgaacacacaaccctacctggaccaacacaggacaggcgacccaagccgactgtcaaaaccggcggcacacgcaaacacacgacaccgccgacctgacccagtgggacacagaagacccagtaggccccacaacgatgagcataacaacgccacagagcacccaacacgctacgagcacacacacccccgcagcacggaccgacgcacatagcaggcaacgcccgagacaaccgacaggcagcagactataccaacacggagcagccagccagag

SEQ ID NO: 615151 - DNA, 430 bp, Homo sapiens
gtcgacggacacagtggggaaacccagcaaggccactgtgcacaattccccttcccctgaggatagggcaggacccctcgggaatgagggtcttccagggaggagggagtgaccttgctaggttttatggctggctttgggagagaggagttctagtttctatgacctgctgtgagaaaaagaattgtggtttctgggactcactttgcggcagaaaagtaggcaggaaccaggagggaaggacaaagacctggcttctgaggccttccagtctcctctgggtcagagtagtctgcatgccaaggtgccatactttcggggtttaatgagccctgacagcaggtccttgcagatttcacaggcaacttgtgatcccagtaattgggtttcagtcccccaatttcagaggactttagcaaagcctggttga

SEQ ID NO: 615152 - DNA, 262 bp, Homo sapiens
aaggactctgtgggcaagccttccgttactccaattgccttcattaccatgaaagaactctatcactggagagaaaccttatgtgtgcatggaatggtggcaagagctttcagtttgtctcagttccttgcaaggacatatataaggctcatgctaggtgaagaacccgtatccatgtaagcaactgtgggagaagccttcagcatacgccagttatccttcatgaaacacgtagaaaactacatattgcacagtaaaccct

SEQ ID NO: 615153 - DNA, 1613 bp, Homo sapiens
  misc_feature (250)..(250): n is a, c, g, or t
  misc_feature (447)..(447): n is a, c, g, or t
  misc_feature (455)..(455): n is a, c, g, or t
  misc_feature (1097)..(1097): n is a, c, g, or t
agtgtgatccatcattactatttagagaataatacgtattgtcgtaacgtggctcatatccatcactattactgccctaagaagagaggatagtgaactaatcttgattccagcgtggatcccattcttagtgaggtcgtgagctccatgcaattaaatgccctacaaggcgacctcacaacatcctcctcttgtaaagacccatagtgtggtagcccgtcattgcaccatattgagatattggtcgacngctcgtgtgacatggaggccgcgaagagggcgatagccgcattagcgtaccttcgtgccaccactgcgtcccaaatagcgatcgagttatatgccgacgctacaagcctgtatcgatcaacgacttacatcgcctaaaaaaatcgccttagactacgccggaactagaacctcagaagagaccttgaaagtttcggntttgcgcncctaaaccaaactcttagttgaggttctaaccttcatcgcgaacttggaccgaatgggacgttgtacgctaagggatcaaacgatcggagtgagatttgttgttggagaactcgaggacattcacatgcgaactccctaagctaaggccccattcacaattgtggagttctccaagcaaatttccaaagttcccccccttcattaatctttagtatctttcctatgataccctcagagaactcctataccagaaacaaaaaggcttatgttattgaagccgtccggtattgcgcaccacaaacaaagccaattttgtcctacgccgtaaccgcagaaaggaccaccaccatttagatccgagaggccacaccgcgctttcccctttacattgagctttacacccatggagggcctcggaggactgcacccatgagcaccgcaccattctaaacgagaagttccaaatggtggcggacatgggctcgaaagaaaggccccattcatgtaagtaccccaaggtgtgaaaacccgaggcatgaatttcgatctgggagagaacaaagacataatccgttatgctcttgcgttcgtgaactcaaacctccaaaagtaaccttttcgcctaatacaaaacaattggntccctcctttagatacttattaataaatgggcacttctggggccaccgttccccactttaggaacacccttgagaattcgaattacattctgggaaatgaggttcgacttttccgtatcccgggaagaaatccaacccaacttgtttaattccccccaccacaccgttttggtggctttatttccaatttccattcgcccggaatttggaggtggggccaaaccgatggacaccaaaagaaaatggcgctttgaagacgaggcgaggaggcgaccagtaacactttgtccgcgaaatattcatgaaaacacgccccttaaaagatgaagaggcacgccccgttgtccacgcttatcatctagtctgcggcgcactagtattgtcacacctcctgacacacagcaggcccctgattaagggtctcacattaagaagagcattatcgtaaataaacgatcaacactcttcaccatatgtgcacgagagaaagcataattatagactcctctgtgtgcg

SEQ ID NO: 615154 - DNA, 751 bp, Homo sapiens
  misc_feature (534)..(534): n is a, c, g, or t
  misc_feature (669)..(669): n is a, c, g, or t
gccgttattattttaatttagttatgtaatttaattattattttaatttcttttcctatctgttaagaaacactattaattctgtaagatggaataatctgattcttcacaccttacaagaatagtcactgccaaatgaatgtgaattctgtagaaattttaagagacaaagaaaacaaattgttggattgataagctaactaagagctcatttttttttttaaatcaggcctccatacaaataatcctggcttcttctaagccatacattaagtcttgcatttaagaaatatgagacttattttccttttccaaatggaagacataatataatcagaatataatagtataagaaaatgaaatatttcaagataccccaaaaattcagtttcctggtgatgaatgttttattatagcatcttttgtcagtatcaacttctagaaggaggaccaagaaaggcagcctaagccatccttatacctatattctgtaacacacatatgcacaccagcacaaaagcacatttaaagcangacagaaaaaaaaaaaaaaacacagtgtaaagggaaaaaattatcctttgcattttcttttccttttcagggctttcagttcactcgtgcgaatttggacgagcttctttctggggtgtggtaacctcgaaagcnctggtatgggcaaaggtaaataaaccgaaaggcttaaggtttggggttgaaaatgggtttggaagccttttgggtagggaaa

SEQ ID NO: 615155 - DNA, 105 bp, Homo sapiens
aattgctggccggagtgcaatggctacagtccaggatattatggtcagcatattgccgctaataccaaagcaacaaacaggttttttgaatgtcgaaagttactg

SEQ ID NO: 615156 - DNA, 663 bp, Homo sapiens
  misc_feature (534)..(534): n is a, c, g, or t
gccgttattattttaatttagttatgtaatttaattattattttaatttcttttcctatctgttaagaaacactattaattctgtaagatggaataatctgattcttcacaccttacaagaatagtcactgccaaatgaatgtgaattctgtagaaattttaagagacaaagaaaacaaattgttggattgataagctaactaagagctcatttttttttttaaatcaggcctccatacaaataatcctggcttcttctaagccatacattaagtcttgcatttaagaaatatgagacttattttccttttccaaatggaagacataatataatcagaatataatagtataagaaaatgaaatatttcaagataccccaaaaattcagtttcctggtgatgaatgttttattatagcatcttttgtcagtatcaacttctagaaggaggaccaagaaaggcagcctaagccatccttatacctatattctgtaacacacatatgcacaccagcacaaaagcacatttaaagcangacagaaaaaaaaaaaaaaacacagtgtaaaggaaagtgccgaatccggcacgagctttcttcctggggtgtttgttaacgctggaatgccactggattgggtcagaggttaattaaacacaagagcct

SEQ ID NO: 615157 - DNA, 120 bp, Homo sapiens
  misc_feature (5)..(5): n is a, c, g, or t
gagtntatgcgggattgtggaaagaggatgtgaggctccggtggggcaggctgaatggcaggtagtggtaggtagtctgtggctcgcgtggtgaagaatctgggtgaaaaagctcgtcta

SEQ ID NO: 615158 - DNA, 420 bp, Homo sapiens
gccacgaataacagctatggctcagtcactgcaactctgctctggtcagtgatctgtgctcagctccagtagctggactacaggcatgtgcacatgccagtaatttggttactggtaagacaagtttgccatgtggtcaggctcgttgaatcctgactcagatatccactgcttggctcccaaagtgcaggattacaggcgtgagcaccacacccggctggaagactgtttctaaagtcagagaaaggatagactaaatgtgttttctgagaaacgttagtctagggaatctgagaggccagaacctctatcatgagtaaaagaatcatggctcataatctctagttttcatctcatactgttgacttctaatcgagttccttgttttagtaacaaataaaataaatgttttctgctctc

SEQ ID NO: 615159 - DNA, 382 bp, Homo sapiens
  misc_feature (338)..(338): n is a, c, g, or t
ggcacgaggcctcgagccgcccagcagcccgtgggcaggcgcggcggagcgagcggggccggcggcgggcgccgagggacgccgagggacgccgaggcctcgggcgggggctggcccggggttccagatgttggatgtgatccttaaacaaagcaaagatgtctgccgtggttgaaagttgtttctaaaaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggntacagcccgtccctgcgcatcctggccatcggcacccgttctgg

SEQ ID NO: 615160 - DNA, 266 bp, Homo sapiens
  misc_feature (8)..(8): n is a, c, g, or t
  misc_feature (36)..(36): n is a, c, g, or t
  misc_feature (42)..(42): n is a, c, g, or t
  misc_feature (70)..(70): n is a, c, g, or t
  misc_feature (222)..(222): n is a, c, g, or t
tccacctntttgggccgggcctaatcgatacctgantgccangacagacccctgcagctgcttctttttntccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggntacagcccgtccctgcgcatcctggccatcggcacccgttctgg

SEQ ID NO: 615161 - DNA, 247 bp, Homo sapiens
  misc_feature (203)..(203): n is a, c, g, or t
gagcttttcctacccccattataaggccacaggtggtgacagccttcagccctgaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggntacagcccgtccctgcgcatcctggccatcggcacccgttctgg

SEQ ID NO: 615162 - DNA, 296 bp, Homo sapiens
aatacctggactgtgcgcaacatccacaggagcagatctatatgggcagcgtgcacattctggatctatatacacagacagactgcccacatatccattccgcttagagcaagtgtcttgaagaacgatctaccggaatctaatatagccctctgctttgatatctacgtcatttgcccctttgagaaccacagatttaatgaggttcttagcttgatcgaccatgtatcctacactgtttaaacagatgtaagtcatgttctgggaggattcttttgataacaggcgcaaaaaag

SEQ ID NO: 615163 - DNA, 168 bp, Homo sapiens
gcgtcgacaaaataaaaagtacaagctagtatgtagcctaaagcaggctaggccgggcgtggtggctcacgcctgtaatcccaacactttgggaggccgaggcggatggatcacgaggtcaggagatcgagaccatcctggctaacatggtgaaacctcctctctact

SEQ ID NO: 615164 - DNA, 263 bp, Homo sapiens
  misc_feature (117)..(117): n is a, c, g, or t
  misc_feature (121)..(121): n is a, c, g, or t
agtttccaggccgctgtacaagcaccacaattgggtagttagataacagaattgtttgatagttataataaggtcagatgtctaaaccaaagtgttggcagggcgtccctctgaagnactnaaataaaatttccagtccttctaatttcttgtggtccttaacttgtggcagataactcatcttacatgagttcttcctgtgtgtgtatctgagtctatataagggctagtcatattggttggggccatctgctctgtaggcc

SEQ ID NO: 615165 - DNA, 250 bp, Homo sapiens
gtggtgtgcgcctgtagtctcagctacttgggaggctgaatcgcttgaacccgggaggtggaggttgcagtgagtcgagacttcgccactgccctccagcctgggtgacacagtaagactctgtttcaaaaaacaaaaaggcaatgtactgtatacttgaaaattcgctcacagagattttaaatgttctcaccattacacaatgataattatgtgacatagtgcatatgttagtgagcccgattgagtg

SEQ ID NO: 615166 - DNA, 173 bp, Homo sapiens
tcatgatcacaccactgcactgggcaatagagcaaaaccctgtatcttcgcaaaaaaaaaaaaaggaaaaaaagaaattttccggaaaattttggcaatttttttttcccctaaggggctataaaccttacaaactttttccttttatcacctggtcttttaatttgggaaac

SEQ ID NO: 615167 - DNA, 181 bp, Homo sapiens
tggctgttaccataaaatggctgttacctatatggctgttacctaaactggctgttacctaaactggctgtacctaaatggcaactcgtgatcgccaaatccagcagccatttaggtatcagccatttaggtaacaccatttagtacagccatttagtacagcatttagggatctctagaa

SEQ ID NO: 615168 - DNA, 373 bp, Homo sapiens
gccaagtttacctttgcttattaaaatattaagtattttgtttttgtaacattccttttctgttttttaaaaagttgtttatcgtgctttttgtatagatttttttaaaagactaatttcacatgaaatttgccttggactatatttatacttgagatatctgaattcaattaaggaaaaactttcaaagtctaagggaagtaggatccatagctctgttgagtttaattttaaattaaaaattggcaaattaattttgaccatatttttaatatgttctgagaaaaattcatttgttaagactttgatcttgttgatgtaaaatgttaaaaagggataaattattgctaaggaatgtgcagatatccataaa

SEQ ID NO: 615169 - DNA, 708 bp, Homo sapiens
gagcgggcgctcccgcgggggagcgtagtctcggaggcgggcacgcaggggatagaggggtagactgagcgtggcgagccttagctttctcccgaacgccagcgctgaggacacgatgtcagcggcgtctcccgcatcactgcatttgggccgcacctgcctgggcgtgcgtctgcgtgctgtccagcggacaagaacacgatccagaacccgaacgtgacgactttagacgacccatctccaacgtaagcctcggcgccggtgacgtccctcccgatggtcaccactccggacaccagaagacctgtgaaggtcgaaacagctggcgttgtcctgtattaattgttagcgttgttacatactaccgtgcttcaggatagaatgtagtgatgagagcgtattgtctcacataactcagcgagttagtgattgtcaacgtggggaagcacgagcagacttcatgtatccgttatccacggggcaatccagatgtcgaggagcacgttctacagataaagcgcacagttcagagcctcccacttctacaacttccaaggacacgctacgtacatcaggtacaaatggtaacactgtgactccaaacctcacaacctgtgcgaaagtctaacctttggatgcaggcagggttcattggaggaattggtcctggtattgggtgtgaaggctgcaagttacattgctttataa

SEQ ID NO: 615170 - DNA, 206 bp, Homo sapiens
  misc_feature (4)..(4): n is a, c, g, or t
  misc_feature (28)..(28): n is a, c, g, or t
  misc_feature (108)..(109): n is a, c, g, or t
  misc_feature (128)..(128): n is a, c, g, or t
  misc_feature (144)..(144): n is a, c, g, or t
  misc_feature (171)..(171): n is a, c, g, or t
  misc_feature (174)..(174): n is a, c, g, or t
  misc_feature (178)..(178): n is a, c, g, or t
tganataaatattttatatggttttacnaaaaataagactcatgtatctggtcacctagtttacaaattttgaattatatttattgaaacatgacatactgtgctctnncttatacctcaagtgtatntgtgtgctgtttccantttcatgccctgtaaataactgtatanatntggncaaatactaataaaactttaatgccatt

SEQ ID NO: 615171 - DNA, 304 bp, Homo sapiens
ggccctctctagagtatccccacgttgacacttcagcctcctgagtggctgggaatacgggcatgtgccaccacgcccggctgatttttgtatttttagtagagacggggttgcccaggctagtcttgaactcctgagctcaggtgatctgcccgcctcaacctcctgaagtgcgggggttacaggcatgagccaccacgcctggcctataatgatatcttaaaagattgctttcttttttttttttttttttttttttagggggggtttcccccccccctgggaaaaaaaaaaattttttttt

SEQ ID NO: 615172 - DNA, 328 bp, Homo sapiens
  misc_feature (68)..(68): n is a, c, g, or t
ccaaccatactgattaagtgagacaacatgtgtttgcacatgttcaagttcctacagaagacttcgcnacagaattgagactttaactggtatcaatatttaaagtgcaaaagcaacagagacagtgcactttaatgcagctaagtaacaaaccaaaacagagcacagatggcagaagaatgaggaaggtaaaaactctagaacgttagattgagggtcaggagcagaaagccagaagtggacattagccagttggtagtgcgggacttctaagcacttgtacaccaggaaagttattatgcacaaggacacattttaggacttatca

SEQ ID NO: 615173 - DNA, 1116 bp, Homo sapiens
accggggctcagcggggtgccctcggcccacaaggccctcccggagcccctggtgtccgaggcttccagtggccagaatgggcagcatggtgatgaccccggccttccaggcccccagtggcctcctgatggttgactgtgggctgacctggtggtcctgggaggtgcctgcaggccctcaagggagaccagggtatttgcatgtgttcctgactggtcttccttggggataaatggtagaactgggtcccatgctggcctggtctggacccaaatggagatgtcttggcatgtctgagggtggaggcttggtgccccaaaatgtgcatcccatggggtccccaacaggcagccatgctggtgttcagggggttggtcccctggtgccccgccgtgtcctcttggtgccatgcatgtggctgtccctgggtgttcgctggcgatcgacggggagcgcctgggatgttccgggggaacggagtgccagctgatgcatgcgcgatcagggggagcttgtgtgggggggatgatcagtcgaacgaaatttggcacagttagcctgctgcacctaatggaagccttgtggcaccctgggtccattggtccgagccggtccagctgtgccgccctggggccccccaggacccccaggctccaataggtcaccctggagctcgagggaccccccggataccgcggtcccacgtgggagctgggagacccgggccagaggaaaccagggtgacagaggagacgaaggcgcggcaggagcaggggaggaggggcctgatggagaccagggccccaaggacccaacggcgtgccgggaacacaaggacaggcacgacggggtccgggaaactgtgccatccggaaacctggatccagagccttggggcccgggggacagccgggggaaacggcagaaacgtcacgctgccaaggaaccggtaaggaagggacgcggagacacaaggcccagagcagtaaatacaacggaggacgaagtgacacggcaccctaagcgaggagaggacacagaagaggtgtcgcaagagagacagacaggaaacatgcacacagacgaaggcagcggagtgagagagccagaggtga

SEQ ID NO: 615174 - DNA, 204 bp, Homo sapiens
gccgataagggactcctcacttccttcagatgtagttaatgtcaccctctgagaagcgttcctgagctcccagtccaaaatagcacccttgtcatcactagccttactttttaatcactggtaccagaaattatactttttattatttgtttcgttggaaattgactgtctttttcactagaatgtcaactaggttagaaattt

SEQ ID NO: 615175 - DNA, 674 bp, Homo sapiens
cgagccccccccccccccccccccccccccattcaacaaaaactcccacccccccaccaaaaaagaagcatcccggcagtcacccaaacaagaggggggcgggaacgaacgctgagacatgagtattcgtactccccagctaaccgctagcggagctagcggggcgtcaagcgcctcgaatcgaagcaggcgtatcaaggccttaagtctttcgtaaggactcggatgggaggaaagtagaggtttcgaagggaaaaaagttcgtcctttaacatccaccccccaccatcgcataaaaagtatatctctttctcccccgctctctttattaatggtatttttttatttttaatttaagaggatcacatacggagcgtagggatagagcgattaggaggttcccgcttggtatttcgtttataggtcgagtctagttttaggtttccctaggtactcagatatctttacagttcgctaggtcggggtaaggagactttaggctatatacatcttccggaagagccggatccagggcaagagtggggcctatggcatttacttccgtctccacctttaggatagggaataggagaattacggtattccttacgcagattccggggtacaattccgtttagctttacacaacagggtcgggtctaaatcctccttcc

SEQ ID NO: 615176 - DNA, 222 bp, Homo sapiens
  misc_feature (124)..(124): n is a, c, g, or t
tgaggaccagccggccgacattgtgaaaccctgtctgtaccaaaaatgcaagaattggctgggcgtggtggtgcacacctgtagtctcagttacttgagggggctgaggcggcgagaatcgctntgcacctgtggaggcacgaggttgcatgtgaaccaatgatcgctgccactgcactccgagcctctgtgtgacagcagtgagactcctgtgtcaaacat

SEQ ID NO: 615177 - DNA, 931 bp, Homo sapiens
cccagtttaggttgtcgtgctcccctgctgaaggtgttccgcccggtccccccgtgttgacgaaatggtgtagcacgtcgtggtgcaagtggccccgctgtttccccaaacggtggtgtgcggtccctcttttgtcaaacacttcgtcgacgaatgggcttgtttaaatgcagcgaaggtccatttacaaccgctgcgttatatggcagagaacccttctgtcatcgagccgggggggacaatgcgtgtcacctcgctgttgttggatgccccagccgccaagtttcaccctgcttagtttgtggttcacgtagctacattcgccctcgttcaatgcgcaccagggttcttgatatttgacaaatagaggatcgcaccactgcgcacaaattgttggccccccttacgaaagggcccacttggaagaagtagttagacttcgccccggtactgttgccaaatgcgtccttttcgttactcttatgtgtcaacgccgcactccattgtgtgggtatacatgggatataaacttttacaaggggtattttccgcacacgccgctcctcgcactccgtgttgcagtacgcttctaaacagcgggcaaccacacggctctttgtaaacaatatgtgccgcactgatagttcaccgtcttgctgtttgcttgaccacttttagccgcacagctaagaggattcattgtgagaggatggtcctctgttaccccgccttccggcccccctccctcggttggtgtctctagatttgtcatcggggagaatatgggcattctgtcccagccttatacgggagcattcaacgcatcggggaaagtactaccccacagagtgcaaaaatatcatcgggcggagcaccccccggctctaaagaatacacattataaaacacaccccccggcgggaacaaaaac

SEQ ID NO: 615178 - DNA, 169 bp, Homo sapiens
agtgctacctccacaaacagcctgagaatgtaactaaggaaaacaactccagccgggcacagtggctcactatctgcagattcccagcactttgggaggccaatggtgagtggatcacttgagggtcaggttcgaagaccagcactggctctagcatggctgtaaatcc

SEQ ID NO: 615179 - DNA, 157 bp, Homo sapiens
aagagggagtctaactctgttgccgaggttaaaatccagtggcatggttttggctcaccataactccgcctcctgggtccaagtgattcttgtgcctcagcctcctgagtagctgggattttggggacatcccccccccctaaaaacctgaaaccca

SEQ ID NO: 615180 - DNA, 160 bp, Homo sapiens
acgacccacggaggtgtactatatgtcttattattccggattttgccattaatcaaaaaagtctcagatgacggcaatgatggaacttttgctaaggagggcgagaatgaaggggtgtaggacagtctcagcgtctctttacaccgtggctggccctata

SEQ ID NO: 615181 - DNA, 1849 bp, Homo sapiens
  misc_feature (239)..(239): n is a, c, g, or t
  misc_feature (254)..(254): n is a, c, g, or t
  misc_feature (295)..(295): n is a, c, g, or t
  misc_feature (298)..(298): n is a, c, g, or t
  misc_feature (1418)..(1418): n is a, c, g, or t
  misc_feature (1433)..(1433): n is a, c, g, or t
  misc_feature (1471)..(1472): n is a, c, g, or t
  misc_feature (1509)..(1509): n is a, c, g, or t
  misc_feature (1518)..(1518): n is a, c, g, or t
  misc_feature (1527)..(1527): n is a, c, g, or t
cacgcgtgcgggtgaaaccccgtctctactaaaaatacaacagccaggtgtgatggtgcacgctcgtgatcccggctactcaggaggctgaggcaagaaaatcgcttgaacccggaaggcagaggttgcagtgagctgagattgtgccactgcacgccagcctgggcaagagagtaagactctctctcaaaaaaaaaaaaaaaagaatttaaaatcccaatttattttctaactctttnatgggatgtatttanaacacagtatacctatagtatacctatgtgtttattatgtnggnaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataaatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttctttttttttttggaatagagatcagtctatcacccaggctggagtgcaggggtgacatcatagctcactggtaacttctcccatactctaccaatcctccggcctcagcatccagactagctgtgattggcaggtgtgcaccaccacacccagctacattttttttgggtagagacagggtctcactatgttacccagtctgggtctcgaactcccggcctcaagcaatcctcccatgtgcctcacaaggtggggatcnacgggtataagccantgcacacggcttactatgctatcaattccatatttggnnagggtgtttcccctttcagagctcttaaaagctctgnagaagattnacatgtgtnatagagctaagagaaactcaggcccgttggacacatggcgtgtgtactaaaaattaaactctccaggtcattctaatcaggcataactcctatctcacattctctgaagtggctagaagacgccatcacagctaggaagctccatcatgaattaccttattcccaaaagcaggtctcaaataattgtctcagagcggaggaccaactgtacagctgacatatgggcggatggtagactgattggggaccgacagttccatatatgccgttagcctgtgctaacgtaaatctatgcaagtatgtcccgtgtgccttaaaaacg

SEQ ID NO: 615182 - DNA, 118 bp, Homo sapiens
tcggcgggggggagggaggggggggcgtttcttttatagagaggagggcggtttaaaaaaaggagaaccccttttaaggggggggggggggggtggtaaaaacccccccttctggggg

SEQ ID NO: 615183 - DNA, 107 bp, Homo sapiens
gtttacacccttttaaacatttttatctgacaattcctcaggatttggtaaggcttccaagttgtcagcttctcagctgtaagtgctggggtggtaataaaatgtta

SEQ ID NO: 615184 - DNA, 526 bp, Homo sapiens
tgactggggctgctgggaccccagccccgagagccggagggctcctcagtgggcgcccccagcgttactatgccccgcagacccacccgagcccgggaggatcacaggtcctctctggtcaccgagaggagctgctgcagggtggggggcgggagggtgttcagagctgccctgaccgggaacagggggcagatgtgggccgctcctctagctcttacagaccaagggcttctggggctcctcccacctgatcgggggctttgggagacccgtgggtggtcagaggaccccttcccggggaacacatgccggaacgggggtctgtccctcccaaggcatcacggtgggtagctgacgctcggtttctcttaatgaacgagtaggtcggatatctaaacggaactggtttgtccagactggacgagacagagaaaacgcatatccatatgagaagttagaacattctgcaggttggcttcataattacaaggacatttacaacgagggccttctccggtggcgtggt

SEQ ID NO: 615185 - DNA, 112 bp, Homo sapiens
tgtgatggtgggggcggaccacatggagagaggcaggggaaggtgccatgtggcgcgtgtcaggtccaaggacgggcgctcgggtgcagccacctgccagagaccagggtca

SEQ ID NO: 615186 - DNA, 327 bp, Homo sapiens
  misc_feature (279)..(279): n is a, c, g, or t
tggtgggattacaggtgctagccattgcacctggccgttggtggatatttaaaaacacagtcctaaaacaaactgtggggcacagagaagcactcagattgaaaatgagaaaacctcggatccaacagtggcaaacacgacgagaggcaaggtgtgtgctggccctggtgctcctcggaggatgtgggagggtcaggcatacgtctggaggacggttgtgagcggagcacccatggaaagagggaggaaacgtgggacgacgggcatgctggagactgnagctggggtgggtgctggagagaggtgcattgtgctgtggtccacagt

SEQ ID NO: 615187 - DNA, 188 bp, Homo sapiens
tcctcttgtgctttgggacggcggtagcagaaccggaagtgctgtatcggttgaattctggcttgatgccgaaattgggtctttctaaacatagctgactgggatattccatacagtctcctacatcgaagttcacactttccagagatatcatgctttttggagacgctccttgaagtccttggctc

SEQ ID NO: 615188 - DNA, 840 bp, Homo sapiens
tggactaaaaagccaaggtctttaataaaaggtcccgatgggttatccccattgttatttccatgccagccagggtccagggaacagcctctcggggaggaaccgggtgtggcatgggcgccatggggagccctggtacgacaaatgctggcttacgggtgaatcatgcctgcctcacactccagaggggccaagagcgcacactagcacagattgcctgcaccgagacatcggtctactcgcaggttgagccctgtgttggtgcctagccccatatcgctataaagaacttacacaagaccgaggacgaagcccgcggagagggaacatacacccgcgctaaacaaaaaacccgcgagtgagccgacaaagatctacacgagaacgaacatagaggaaaaattacagagagggaataatcccaccccccatcaacacgagagagagcaacacacataccacaagagacagaaaagacaacgcagcagcatcatacccatagtagaaccagaggggacgaccatggagcaccaacagggtgggcccacacgaaatatggcgcgagcacgcactctcgcaagcggagtaggaccaccacaaaacaatgaggtagagcatacccccacaaagacattagcagggaggaggaacaccacccaaccagcagaggagcacccgacaggaaaaccatgaggtgagaaacccatatagaggaacaaatccacagaaggagaagagaacgaggggctacgcacccgcaaagaaggaataccccactcaggcgcacgataatatgcacccgccctaaggggcacagacggcaaacaaacagacagcggg

SEQ ID NO: 615189 - DNA, 339 bp, Homo sapiens
cagtctggactgagtctatggataggtgataacacagccggtgttggtgtgtctgtgccctatgggaggggcatactgcctgaggacagcaactttcttggaggactgtaatttaagtgatcgttgctatagcttcccagtcacctttgggtccctgatcccttcggcttttccagctgggtgactgctatcctggaatctggcggaagcttgggtctatagtgacagaaggtacagtggacaattctgagtactgcccctttggagatgccattcagcttctggaaggaggcctacttgggatgtcgctgtttctgcagctagggtaccgagcgtcgc

SEQ ID NO: 615190 - DNA, 762 bp, Homo sapiens
gcaccgtaccccgatggggtaacgtgacacaggccccacctctgagtgaagggggctgtctgcccatccaccaagtgtgtgagagggcgcccccgtgtgtggggtccatgctctggcacactgcttggacggccgggattcacttagagctacgtaacgtattctttgctgagctttctttggcttgttctttttgattttaatgcctctttatgactatccagctctgagagaccgggagttggggagttggacccgtcttccactttgggttgggttgggcggggaggctggcgggctcgtctctgcgttaccttaacttatagctaacgaagttgggtactctctctctctcaacttatccaaacacgtgtgcagctacctcgccccacagccaaggtaattctgcgacaaaataatttgcgtagccgtctatggcgggtggggcttctttcacaccatcgctgatcatctgtgcacaagaccctaaccactcctcgctccctctcactttacaaggacggctgccatgagaccttactgaagcgtcgagttaccctagacctacatcttgtcgtccccctctgtcccctgtgcgagcaccgtaggtaacgggaccgctgcgccctcgatcagccgcgggcggtaccctggtggaagtacagattaagtactaatttctctctaccctacactgcatagaacccaactaagccacgcacaaaaaccgacttcctcgacaccagggttctaggagggcca

SEQ ID NO: 615191 - DNA, 115 bp, Homo sapiens
gttaatgccgcgttaggctctcagacttctgtggtctctggaacggactctgagacccacggaagccatagcaactgttcagccaggagacctggctctcacgttgatcgagcta

SEQ ID NO: 615192 - DNA, 936 bp, Homo sapiens
  misc_feature (17)..(17): n is a, c, g, or t
  misc_feature (19)..(19): n is a, c, g, or t
  misc_feature (72)..(72): n is a, c, g, or t
  misc_feature (77)..(77): n is a, c, g, or t
  misc_feature (85)..(85): n is a, c, g, or t
  misc_feature (97)..(97): n is a, c, g, or t
  misc_feature (102)..(102): n is a, c, g, or t
  misc_feature (131)..(131): n is a, c, g, or t
  misc_feature (152)..(152): n is a, c, g, or t
  misc_feature (166)..(167): n is a, c, g, or t
  misc_feature (176)..(176): n is a, c, g, or t
  misc_feature (178)..(178): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (193)..(193): n is a, c, g, or t
  misc_feature (222)..(222): n is a, c, g, or t
  misc_feature (274)..(274): n is a, c, g, or t
  misc_feature (290)..(290): n is a, c, g, or t
  misc_feature (306)..(306): n is a, c, g, or t
  misc_feature (333)..(333): n is a, c, g, or t
  misc_feature (336)..(336): n is a, c, g, or t
  misc_feature (348)..(348): n is a, c, g, or t
  misc_feature (365)..(365): n is a, c, g, or t
  misc_feature (368)..(368): n is a, c, g, or t
  misc_feature (379)..(379): n is a, c, g, or t
  misc_feature (381)..(381): n is a, c, g, or t
  misc_feature (399)..(399): n is a, c, g, or t
  misc_feature (432)..(432): n is a, c, g, or t
  misc_feature (452)..(452): n is a, c, g, or t
  misc_feature (454)..(454): n is a, c, g, or t
  misc_feature (466)..(466): n is a, c, g, or t
  misc_feature (506)..(506): n is a, c, g, or t
  misc_feature (509)..(509): n is a, c, g, or t
  misc_feature (563)..(563): n is a, c, g, or t
  misc_feature (634)..(634): n is a, c, g, or t
  misc_feature (722)..(722): n is a, c, g, or t
  misc_feature (727)..(727): n is a, c, g, or t
  misc_feature (730)..(730): n is a, c, g, or t
  misc_feature (733)..(733): n is a, c, g, or t
  misc_feature (808)..(808): n is a, c, g, or t
  misc_feature (843)..(843): n is a, c, g, or t
  misc_feature (850)..(850): n is a, c, g, or t
  misc_feature (927)..(927): n is a, c, g, or t
tgtacaaaacctgaaananttttacttttttaaaactttgatctaagtcgccttagacctcatggactcganacaanagtaaaangaattgggaaanaaaanactttaaaagccacgaaaaactttgttanaaatgtacatgttgccaaaanaaaaaaaaaaaaannaaaaaaaananananananaacagcntgatgtccaggttagattatataaatgtncaacaagggcagggtaaaggaaactttaaaaacaccagtcccgaataagccnggggccccgggagacncccccccccccccccngtcccgggccccagggactgcgtcccnccnaacaggacaagngggagtggataaggccnccnccaagccgccncncccagtggacaaaaacanccaggtaatgggtatataaacaaagcccaaaanaaatgtacaaatataaaaancnacaaacattaanaaattacagcatcacaaaacacggaaacacttcacaaggngcnagtaaaataactgtatcccccaatccccccatcatacaaggaaaacaaagagcnggtattaaagttgaagattcatcttcaaaatgtgtctgaaatagatcttttgtgttctatttgcttctgtnaagacagagtgtaaggctgcacagacatcacttgtttttcaggcaataccttagttcttaaaagaaaaaaataataataataaaaggnaaggnganggnaaaagcatcagaacccaactgtccatctgactcagcaaaaaactcgtataaatgttaatgaagaactctataganagaaattcctaaagatacttttactcttataaaanagaagtnatttaaaaagctatttacacgctacattctatgaaaaatatgcttcaggaaatacatctaaaattaaatacaggatncctgagaaa

SEQ ID NO: 615193 - DNA, 255 bp, Homo sapiens
tagagatggactaagcatacccagccaaataatgcagaggacacaggcttccctgtccctaacgatcaggtaaaacttgcttttcattttatccctctctgctgcctctagccatttgtcaagaccctttgggccaggcttgcactggaccggaaggcatgcctcacccattggaaagctaaattcctcaacctaaagccttcttgaatcacttcccttgttgatacagtagggggttcacgagctcgaatacga

SEQ ID NO: 615194 - DNA, 220 bp, Homo sapiens
accccccagtggtcctcccttccctggctcggttacccctcttagtccccggagttagaacctgtggtgtattttataagcaaacacccctgcctggctctcaggttctccacaccgtgccacaagtgtggccctctgatatctcaacggtgtcccctctcaaagtttacactctcggttttaaaaacctcgcgtaaaattcctgcacacagcggggtcc

SEQ ID NO: 615195 - DNA, 434 bp, Homo sapiens
gtggcctaacatcagttgtctaggttgatgtagccagtcagccaattccaaattgcactgagtttacttcattatacttttggatattaaaaactaaatagttttctgcagcatcgtagactagattagaaaccaagacttctgtatcacaatttataaaataggacaaatgtattctcagtgattctgcaatgtttctgcccatttttccctcttcaggaagtagtagaggtaagataccctattcctgctatgcttatgttgggcattattccagaaactgaagattcaaaggtgggtccccactcctagaagcccttcaaggggcagaggttcccagagaggaccataatccagtgtgaaaactgttgtactgtgtgtggatcaagtgtcaagaaaacccacataagagcatggctgattcttgttgagga

SEQ ID NO: 615196 - DNA, 638 bp, Homo sapiens
gttgtggggtatctagaggatcctgacattgtgtctcagtgtgcaggaaatgtgtagtgaaagttaggacttgggcacaggtaatcatggacgtatatatcctttagcataattattattataattattagcatggaagggtttaacagaaatcagcaagagcagattaatattttaaactgattcctctagctgcagtgtgtatgtgtggaaattggattgaatgggtacatgatgggaggcaaagagacctgtttggggccacaactttatggaaaaaaaataataataataaaacctgcaaaccaaaaaacacagtggctgaatcaggagaggtactgtgagagaaggggctgcaatcctgatactgcagagtgaggactgataggtgttgctgagtaactgcacgtgggtggtaagcagaaggaaggggtcaagggatgatggcagcattctggctgggtaattgggtggattgtggtggtcttccataagacgtggacccaggtagagaggcagactctggggtggtaagtggctaaattcaattttgggcatgctgagcttgtggaatctagtggatgcttaagtttggggagtggacaggcaaggggaattgctagaagtgtggggagtaa

SEQ ID NO: 615197 - DNA, 146 bp, Homo sapiens
actgtgctgctacagagtaactgtagagcttctctggtcacccagtggtcatgctggcacgctttcctgtgtaatccagcagatggtgtactagccttgcaccaggcccttggaaccttcccgttccaagaaccacagcaccgcag

SEQ ID NO: 615198 - DNA, 487 bp, Homo sapiens
gcggcccctactactactaaaaaagcggccgctcgacggaagtgaagtttaggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615199 - DNA, 3294 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaagttgtgataagtccccgggaaggagcatgacaagaggctgagacatgtggcagcccagtccttacctcatggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615200 - DNA, 3221 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccactgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615201 - DNA, 3997 bp, Homo sapiens
  misc_feature (30)..(30): n is a, c, g, or t
  misc_feature (1400)..(1400): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaaggtacccgggggctccctctgcagccgccagccgcncccgggctgccctcagtgccctcccctgaaatgcgggcggcgtcacggccgtttccccgccggctgcagctgtagctacgaaaccagctttaatgccgaggatgacggctccttcccgggagggtgtagcgctcgtctgtcgttcccgatgatttcagagctgtgacggtttccttttgcaaagctggtgcattcaggttccccgagcaggctggcagcctcccgggggccagggcagaggctctctgtttcctttgggtcggggcagtggcagagagtgcaggaggccgctccctctggcccgcgcctctgtgtgtggtcagctggcctggctgtgacctcaccagtggcccagagcagaggggcaaggtgggctggggggagggctgagcgcacagagggggcctgccgtgggcccgggtccctcctccgcagcgtgaacctgacaggtctcaccagcgccggtactgacgaccccctcagcaccaagagcctccctgctcctcctgcaggcgcgactggtaactcccatgagcccggggccagggcccacagacagacagacctccccaggacagacgtccccggcacgctccttgtcctcaggagggctgcgtccccctggagtccaacgcggggcgaccccataacctgttgtctgattacagttgtgataagtccccgggaaggagcatgacaagaggctgagacatgtggcagcccagtccttacctcatggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615202 - DNA, 3443 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccactgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaactaaaaaaaaaaaaaaaaaaaaaacaaactttgtgggcgcgctgggacccacgaaaaagtttttaaaacccttctgtgtgcgggccgcgcccatttttgtacgtgtacctggcaaacctgtccaaggaaaccgggctgatgtggttggttccccaataaacccgcgcccgccgtggacaccagtggtctggctcggctcaccggggcagatagaaccccgggtgt

SEQ ID NO: 615203 - DNA, 2560 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615204 - DNA, 2216 bp, Homo sapiens
aagcttgcggccgcttgtgacctaaccgcagcgcctgtgtgcaacgtggtggggctcccggcagggctcggctctgcccaagaggcccgccctggggctgcgcgagccgctttgccaaggggtttccttctcactcagacgcatgatggccccaggtgtggccgcgggaccgagggatggacgggctggacctggctcgccgtaggagacgccccccacccctgggctggagtccagccaggccgctgatcctgcatccccagaccatggggcctccaaacaccttcccagctcctgtcccacgtgtccggccaggctcaggaaccgggctcagctgcactttcctcttccccgcaggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615205 - DNA, 392 bp, Homo sapiens
caaacaaaaacaagtagataaacattaatataggaaaccaataaactaggactagtatctgcagacgacagaaacagagcattcacgctcctctaggaagtttctgctatcttctggaggtatctgggtgagcaatgaacttcctgcagaaaagtcccggggcccagaccggcacagtaaccatgacacccaacgcctcgatttccggttacacctcatgtgctatcctaagggttctggcaaatgagtgttgaaacagaacaaaacaatccagataccacttagagatttgtgatgagatcttgcaacctgttctttcaatgttttaatcacttttctgcaaattgtcatcatttgttttacaagaagatagtttaaagtatattttatac

SEQ ID NO: 615206 - DNA, 407 bp, Homo sapiens
cctgaggacatgaaactattcagggtggtaccttgatagatagtcaagggctatgtcatgctctttaatattctctttaaccatacactgacttcgaattgaggcaggccctttctggctcttatcctttcctctctctctctctctgtctctctcacacacacacacacacacacacacacacacacacgcacacatgcaactcacagatttctttaagagtgcagggagtggagaattgtaaatgcagcaaatactaaagaatgtgttatttggtattggactgcattatgtcgcagatgttggttactaaatgcaaaaatctagatttacaaaacagatcaatgggtaatgaatttgcagggaaactggagaatgactatgccctttacaataggcattgccat

SEQ ID NO: 615207 - DNA, 3275 bp, Homo sapiens
gtaaagaactccgttgagatggctgttaacaaagtggaaaccggtctctgacacggcagagagacactgctgtttctcttctccgggtccagaaaatgcctgctggcttggcccctcctcattggcgggggaggtggggggtgctggtgctgactgtctgcgtcttatgtttcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaagttgtgataagtccccgggaaggagcatgacaagaggctgagacatgtggcagcccagtccttacctcatggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615208 - DNA, 2728 bp, Homo sapiens
tgtaacgcgccggaattacgggatctagcaaggaccttatcttcatcctagcttcataatcgtagccttctcaggaagatgccaggtagacttgggctctctactggcacccgtacagacgctagacgtgttagaactaggatgacctctctctataacccgtcttccgtgatcgcccgctggtgtccccgacaggaacgatatttggtgagaaccagctttaatgccgaggatgacggctccttcccgggagggtgtagcgctcgtctgtcgttcccgatgatttcagagctgtgacggtttccttttgcaaagctggtgcattcaggttccccgagcaggctggcagcctcccgggggccagggcagaggctctctgtttcctttgggtcggggcagtggcagagagtgcaggaggccgctccctctggcccgcgcctctgtgtgtggtcagctggcctggctgtgacctcaccagtggcccagagcagaggggcaaggtgggctggggggagggctgagcgcacagagggggcctgccgtgggcccgggtccctcctccgcagcgtgaacctgacaggtctcaccagcgccggtactgacgaccccctcagcaccaagagcctccctgctcctcctgcaggcgcgactggtaactcccatgagcccggggccagggcccacagacagacagacctccccaggacagacgtccccggcacgctccttgtcctcaggagggctgcgtccccctggagtccaacgcggggcgaccccataacctgttgtctgattacagttgtgataagtccccgggaaggagcatgacaagaggctgagacatgtggcagcccagtccttacctcatggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 615209 - DNA, 565 bp, Homo sapiens
  misc_feature (341)..(341): n is a, c, g, or t
  misc_feature (349)..(349): n is a, c, g, or t
  misc_feature (483)..(483): n is a, c, g, or t
  misc_feature (506)..(507): n is a, c, g, or t
  misc_feature (521)..(521): n is a, c, g, or t
  misc_feature (526)..(526): n is a, c, g, or t
  misc_feature (535)..(535): n is a, c, g, or t
gttgataaaccttgcccggtgaatatgactaatcacgtctatttcaatcttgacggcgagcagtctgacgtgcgcaatcacaagttgcagattctggcggacgaatatctgccggttgatgaaaggcggcattccgcacgacggcctgaaatctgtcgccggaacgtcttttgatttccgcagcgccaaaatcatcgccagtgagtttcttgccgacgacgatcagcgcaaagtgaaaggttacgatcacgcattcttgttacagccaaaggcgatggcaagaaagtggcggcgcatgtctggtcagcagatgaaaaattgcagctgaaggtctacaccancgctccgntctgcaattctactccggcaacttcctcggcggcacaccgtcgcggggaaccgaaccttacccgactggcaagggctggctctggaaagcgagtttctaccggacagcccgaaccaccctgaaatggccgcaanccggactgcttcctgcgtctaannatcagagtattccncgctnacggaatancagtttattgctgagtaatgttacgcccta

SEQ ID NO: 615210 - DNA, 228 bp, Homo sapiens
aaaggcagtatcaagcttgatatgtgtcttcacagttgatgacactgtcagtgaggcagggacactgaactattagaaaggaagacccatgcaggcacagtggctcacgccatacagtacagcacctttgggaggcaaggggggggatcacttgaggtcaggagttccgagacgagggtgggcaatatggtgaaaccccgtcgtcggggtgggatcgataaacaccgg

SEQ ID NO: 615211 - DNA, 3378 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccactgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataattttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaactaaaaaaaaaaaaaaaaaaaaaacaaactttgtgggcgcgctgggacccacgaaaaagtttttaaaacccttctgtgtgcgggccgcgcccatttttgtacgtgtacctggcaaacctgtccaaggaaaccgggctgatgtggttggttccccaataaacccgcgcccgccgtggacaccagtggtctggctcggctcaccggggcagatagaaccccgggtgt

SEQ ID NO: 615212 - DNA, 1196 bp, Homo sapiens
  misc_feature (307)..(307): n is a, c, g, or t
  misc_feature (405)..(406): n is a, c, g, or t
  misc_feature (692)..(692): n is a, c, g, or t
  misc_feature (727)..(727): n is a, c, g, or t
  misc_feature (840)..(840): n is a, c, g, or t
  misc_feature (886)..(886): n is a, c, g, or t
  misc_feature (894)..(894): n is a, c, g, or t
  misc_feature (906)..(906): n is a, c, g, or t
  misc_feature (931)..(931): n is a, c, g, or t
  misc_feature (935)..(935): n is a, c, g, or t
  misc_feature (945)..(945): n is a, c, g, or t
  misc_feature (948)..(949): n is a, c, g, or t
  misc_feature (951)..(951): n is a, c, g, or t
  misc_feature (967)..(967): n is a, c, g, or t
  misc_feature (973)..(973): n is a, c, g, or t
aaacggcatcaacagcattcttcgaccccgacggagagatggagatcccatctctataacaaccaacttatactgatattcctcgagaacaacctgatatgtctatattcttatcctaccaggctgtcgtgtaataatcatctctcattatggtgacttacatactccggaggagaagaaccattggatacataggtatggtctgagctaggatatcaataggattctctagggcttgtatcggtgtgagacagcagcccactatatccacgagctatggaatatgacgtacacactgcgtagcatntttcacctccgctaacataatcatcgctatccccaccggcgtcaaagtatttagctgactcgccacactccacggaagcaatatgaaatgatctgctnnagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggnctatccggaatgccccgacgttactcggactaccncgatgcatacgccacatgaaacatcctatcatctgtaggctcattcatttctctaacagcagtaatattaataattttcatgatttgagaagccttcgctgtcgaagcgaaanagtcctaatagtagaagaaccctccataaacctggagtgactatantggatgcncccccatcctancacacattcgaagaacccgtatacntaanatctagaccnaannanggaaggaatcgaagcncccaangctggtttcaatgccaatgccctatggacctccatgactttgttcatgaacacaagagatctccatcagataacagcaagagtcgtgttggacggccccctttggccctggtcacaagctgcctcacacattggttttctggggggcggggccatactgcgttcctagaatggggctaatgctccgccgagaaagctgcggggtcccaaagatcaggtgtgga

SEQ ID NO: 615213 - DNA, 1700 bp, Homo sapiens
cctaggaggtggaggtttccaatgaactgagattgcacccatgcactcccagcctgtgccaccagagggaacatcccatttccgaggaaaaaaaaaaaaaaagaatatgcacagtctgaatgtataccaggagtgtgagagacacatgcccacttcatgcaactcctaaactcaaagtctaaatcagatatttttattaacaatgacaacttgttgccaactccctgtttctaatgaccaaagacccagggtacctaaaaggactttgcaaccaagcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttagcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatctttcccccaaacctcctttaaaggagcatgcataacagtgtgctgaaagacagttgttggttttttgattttagcatattatttcctgtatgaaatatgttttatataatctcctattatttttatcttatgttttgtattgttgataaatcctttttgtccttctaagatgtcctattgtaaaatcacttataaggtatgattactctttatgctattactttatatgccatttggtaataaatagtaaattgttgatgatatgattgactgatgcgcagtccagagcatgtatgaataatctcataaaacagtatcacagacattaagctaaactgtttcgtttttttgaaagaacaactcatactttggaacagttgtcaatattaatttgttgcaaatatttaatttaaataaacatttttgtaccatgaaaaaaaaaaaaaaaaaaaaaaaaaaaaaaaaaaaaagaagaaaaaaaacaaaaaaaaaaaaagacgggggcgcgcgcgcgctagcacagaagtatactaccctacgacgaggcccccccagattatctcacgccaccccccaactttgctgttcgacgaagacggggcgccccataaaacgaggacgtcatgctatatacgacgaagcgctggacgacgaccgaggcgcgccgagcttataaccagcagcggaatgaggcggaacaacaaaagcgtgcgtcctacgcgtgcgagacataccttttgttaggaaaagaagcaacaccctattttcatctgtgctggtgggggggagcgaccacatcaatagtgtgggggcacaaaacttatctccacacagaacgagatatatatatagaagagcttctctcacagggggaatatacttatataacagaccattttgaggaagtggtcattcatacggtgcgtgtgtgcaaccaacaacgcgccgtgcaaataatgtagctattctgccatacacaacgaagaccgtattggggctcatatgctggctagttggtctatgttcgctggaagaaacctatttttttaccaccggcgatcttcttgtaagattaaacg

SEQ ID NO: 615214 - DNA, 274 bp, Homo sapiens
gcacagacaagttcaggtccatggcccagatggtactagctgtctaactagcaaaagctgccccttctgggtacttccctagtaacccgagatcactcaggagccagacaggaaacttatgctattcctgtatactctttctgcccaacacatccaatctctcaaaacggtcaggtctaccttaacatctctagactagagccactcccactgtcatcagctttcacctggattctcgtgacagcctcctactgcttctctatcatgtggccag

SEQ ID NO: 615215 - DNA, 491 bp, Homo sapiens
  misc_feature (17)..(17): n is a, c, g, or t
  misc_feature (24)..(24): n is a, c, g, or t
tcatgtctgtacggccncgcgtanttgatatcgtcgaccaggcgctcgcgcacgcgtcgggagctggccagattgggtgtggggacgcgtctactagcagctttgcctgcctagcaacatgtcgcttggctgccaccactcagcttggggggcccctggtctccccacgcccctggagagaccccagtctagtggctgttgcccacatggtttcctgagatttggggagtgtgactgaggggcgatgtgtattgcactggaatgggtccaatgacacggcacttgttggtgggcaggtgctctgaccagtgaaagctagtgccatcccctgtggtgaccccaaagaccttcctgctgggggcagggggtgagggagtgacagcagagggctaggaggctcgggctcagctgagtacctctctcacaccaacttatggggttaacgaagcccaggggctcactttgagggtgacatttgccacagaaacaga

SEQ ID NO: 615216 - DNA, 635 bp, Homo sapiens
aaaggggccaattttttttgggaaccccaaggggccaaaattttttaacccattttttaaggggcccaaaaattttaaaattaaaactttttttgggccctgggaacctttaaaagggcttggcgggggaacccatttcctgttaacccttttccctaaaagggtttatacccaagggattccaggccctttaaaatttttaaaccctcctttaataaaaaagaaggggttattttttggggggaaaaaccctccccaaaattttgggaaaaaaaaaaaagttgggcccctggcctaaaaaggccccatagtttttccgggccaaatttttccccgggccctttttggaatataccccccgggggacaaaattgcccgggctggaaattttcaaagggccccttaaaaagggtcccctttccctctttaaaaaaagggcggaaaaaaaggttttttttcccaaaggggggggaaaaaaaatgccctttcccggaagaattttttaaaacccccacactttgaggggggttttttttgggcggagaaacccccaaggtttttccaaaaggcccgggaaatttttttttttggcccctaaagaggggtataaagattccaacctttttagagatttt

SEQ ID NO: 615217 - DNA, 1239 bp, Homo sapiens
  misc_feature (350)..(350): n is a, c, g, or t
  misc_feature (448)..(449): n is a, c, g, or t
  misc_feature (735)..(735): n is a, c, g, or t
  misc_feature (770)..(770): n is a, c, g, or t
  misc_feature (883)..(883): n is a, c, g, or t
  misc_feature (929)..(929): n is a, c, g, or t
  misc_feature (937)..(937): n is a, c, g, or t
  misc_feature (949)..(949): n is a, c, g, or t
  misc_feature (974)..(974): n is a, c, g, or t
  misc_feature (978)..(978): n is a, c, g, or t
  misc_feature (988)..(988): n is a, c, g, or t
  misc_feature (991)..(992): n is a, c, g, or t
  misc_feature (994)..(994): n is a, c, g, or t
  misc_feature (1010)..(1010): n is a, c, g, or t
  misc_feature (1016)..(1016): n is a, c, g, or t
cagaccgcaacctcaacatcactcttcattcgacacccgctcggaggaggagtacccctagtactataccagacgaaccatattcgtggactttggtctgcgtcacctccttgaaagcttgttattagtttcctaataatccgtgacacagggtcttgcagtgcacagtaaatctctcgcgatattagtaatcgttacctactccggaaacagaagaaccagtcttaggagtacattgggtatggtctgatgcgtatgatatcgcatttgtgcttcctagggttatatcgtggtgatgcacaatcatatgattatacacgtaatgaatagacgtgagactcacgagcatntttcacctccgctaacataatcatcgctatccccaccggcgtcaaagtatttagctgactcgccacactccacggaagcaatatgaaatgatctgctnnagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggnctatccggaatgccccgacgttactcggactaccncgatgcatacgccacatgaaacatcctatcatctgtaggctcattcatttctctaacagcagtaatattaataattttcatgatttgagaagccttcgctgtcgaagcgaaanagtcctaatagtagaagaaccctccataaacctggagtgactatantggatgcncccccatcctancacacattcgaagaacccgtatacntaanatctagaccnaannanggaaggaatcgaagcncccaangctggtttcaatgccaatgccctatggacctccatgactttgttcatgaacacaagagatctccatcagataacagcaagagtcgtgttggacggccccctttggccctggtcacaagctgcctcacacattggttttctggggggcggggccatactgcgttcctagaatggggctaatgctccgccgagaaagctgcggggtcccaaagatcaggtgtgga

SEQ ID NO: 615218 - DNA, 1210 bp, Homo sapiens
gcacgaggggctgtttcagttagggaccagttcagcagtggaggaagagcaacttcccgcaaatcagaaactcactgtgattccaaaaatgtttctgagccctggacccctgcccccaaaatattttcatctttcccccaaacctcctttaaaggagcatgcataacagtgtgctgaaagacagttgttggttttttgattttagcatattatttcctgtatgaaatatgttttatataatctcctattatttttatcttatgttttgtattgttgataaatcctttttgtccttctaagatgtcctattgtaaaatcacttataaggtatgattactctttatgctattactttatatgccatttggtaataaatagtaaattgttgatgatatgattgactgatgcgcagtccagagcatgtatgaataatctcataaaacagtatcacagacattaagctaaactgtttcgtttttttgaaagaacaactcatactttggaacagttgtcaatattaatttgttgcaaatatttaatttaaataaacatttttgtaccatgaaaaaaaaaaaaaaaaaaaaaaaaaaaaaaaaaaaaagaagaaaaaaaacaaaaaaaaaaaaagacgggggcgcgcgcgcgctagcacagaagtatactaccctacgacgaggcccccccagattatctcacgccaccccccaactttgctgttcgacgaagacggggcgccccataaaacgaggacgtcatgctatatacgacgaagcgctggacgacgaccgaggcgcgccgagcttataaccagcagcggaatgaggcggaacaacaaaagcgtgcgtcctacgcgtgcgagacataccttttgttaggaaaagaagcaacaccctattttcatctgtgctggtgggggggagcgaccacatcaatagtgtgggggcacaaaacttatctccacacagaacgagatatatatatagaagagcttctctcacagggggaatatacttatataacagaccattttgaggaagtggtcattcatacggtgcgtgtgtgcaaccaacaacgcgccgtgcaaataatgtagctattctgccatacacaacgaagaccgtattggggctcatatgctggctagttggtctatgttcgctggaagaaacctatttttttaccaccggcgatcttcttgtaagattaaacg

SEQ ID NO: 615219 - DNA, 1018 bp, Homo sapiens
  misc_feature (307)..(307): n is a, c, g, or t
  misc_feature (405)..(406): n is a, c, g, or t
  misc_feature (692)..(692): n is a, c, g, or t
  misc_feature (727)..(727): n is a, c, g, or t
  misc_feature (840)..(840): n is a, c, g, or t
  misc_feature (886)..(886): n is a, c, g, or t
  misc_feature (894)..(894): n is a, c, g, or t
  misc_feature (906)..(906): n is a, c, g, or t
  misc_feature (931)..(931): n is a, c, g, or t
  misc_feature (935)..(935): n is a, c, g, or t
aaacggcatcaacagcattcttcgaccccgacggagagatggagatcccatctctataacaaccaacttatactgatattcctcgagaacaacctgatatgtctatattcttatcctaccaggctgtcgtgtaataatcatctctcattatggtgacttacatactccggaggagaagaaccattggatacataggtatggtctgagctaggatatcaataggattctctagggcttgtatcggtgtgagacagcagcccactatatccacgagctatggaatatgacgtacacactgcgtagcatntttcacctccgctaacataatcatcgctatccccaccggcgtcaaagtatttagctgactcgccacactccacggaagcaatatgaaatgatctgctnnagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggnctatccggaatgccccgacgttactcggactaccncgatgcatacgccacatgaaacatcctatcatctgtaggctcattcatttctctaacagcagtaatattaataattttcatgatttgagaagccttcgctgtcgaagcgaaanagtcctaatagtagaagaaccctccataaacctggagtgactatantggatgcncccccatcctancacacattcgaagaacccgtatacntaanatctagacaataaaacaataaacaaaacaaaaagaaataaaacttttggggtccgtggcctgcaaggaagttttttgacaagt

SEQ ID NO: 615220 - DNA, 238 bp, Homo sapiens
cgcagaagaggaggaggatttcggtgaggaggccgaagaggaggcttaaggcagagcccccatcacctcaggtttctcagttcccttagccgtcttactcaattgcccctttcctctccctcagaatttgtgtttgctccctctatcttgttttttgttttttcttctggggggggtctagaacagtgcctggcacatagtaggcgctcaataaatacttttttttttaaaaaaaaaa

SEQ ID NO: 615221 - DNA, 1525 bp, Homo sapiens
ctatgtggcccaacctcccacgtcccacctccacctccatcgaggcggtggctaggacgacccccaaatcccgatcgtccgccctaggacaccgaagaccgccgcacaggagacgagagacgacagcgcatcctgcacaacaaccgcatgcctgcgagcctggctggggcaggggagccagcccccacagagcccccatactcgcctctgacggctggccaagaacctgaacttatgctggagcacggtggcactggactgcctgctgcctgctgctcatatccatgcattgctgcctctctccgtgactgcacccaaaccatgcgtgcgccttactagccaagcccccacaaagctgcgcaacagataccgtgtgcgtgtccacagcattgtgcccataacataacgaaactgcgcctcggtactcgcctcatctccacctgggccttggtcgccttcccaggcgcccactcccccgcatagcctggctgctaggccccgcgcggccgaaccggaaccggacacagcggcgccccgcacgcacagcactggccagggagtaccagaggcaggctaccaaacaatgcggactgggcctggcccgacccaatccccaacaactcacacctagcacacccagagacgagaactacgacgcgacccaggagaccggcgcactggccggaacgcggcgcgcgcccaccgaaacgcaaacacacatcaccgcgcccgttccccccggtcccgcccaacggcaccccccgaaccatgagatgctagcacacagggtaccagacccgaacaccgagcaaagcccagagaacgaccagaccgaaccctaccggcaagacacttgcgcccatacggaggccaccgtcggacctaggccgacgcgcgactaaacacgggggcccaaacgggccccacggcgccgcaggcgagcgcaaagggccaccccaagatcccgcgcccccaacacgcggcacgcgccacgcacagcgcccagacaacccgacggagaccgcacgacggcccccgaaggcggcccatcacgatatcgcaccacagagagcgacactaccggggaccggcaccattggacgacgatgggggccgcaccggcgcagccctaccagagcgacacaggcagcccaacagcccgaaagcaggccagagatgcaccgaaccaaccccgcaggcgcgacaaaacagagcatggggcacaaactcaggtctcggccggcgcaagatacgaagccaaggaagacacaccaacagcgcgaccgtaacaatatagcggagcacgcagtcgtaaacaggcagagcaacgcagccgcaccacgagacaaccccccctggcgccacagcacaacacccacaagtagcgtaagctcgacacagtatagcgcgtacgcacccacgcgagcacgacgtagggtcaccaccgcagagcacaacggggcagacaagcagcaggcaggacaccaactgccaacgataaagacgagagggcagagcagaccaa

SEQ ID NO: 615222 - DNA, 863 bp, Homo sapiens
  misc_feature (359)..(359): n is a, c, g, or t
  misc_feature (394)..(394): n is a, c, g, or t
  misc_feature (507)..(507): n is a, c, g, or t
  misc_feature (553)..(553): n is a, c, g, or t
  misc_feature (561)..(561): n is a, c, g, or t
  misc_feature (573)..(573): n is a, c, g, or t
  misc_feature (598)..(598): n is a, c, g, or t
  misc_feature (602)..(602): n is a, c, g, or t
  misc_feature (612)..(612): n is a, c, g, or t
  misc_feature (615)..(616): n is a, c, g, or t
  misc_feature (618)..(618): n is a, c, g, or t
  misc_feature (634)..(634): n is a, c, g, or t
  misc_feature (640)..(640): n is a, c, g, or t
tgtagttatcgaagctgagctcggacagcgcaccatcgagacgaatagtgaggatgctcttgtagtcgagctgtgaggcacttcagattctgtgcactgttctgcacgcgttaagaaggctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggnctatccggaatgccccgacgttactcggactaccncgatgcatacgccacatgaaacatcctatcatctgtaggctcattcatttctctaacagcagtaatattaataattttcatgatttgagaagccttcgctgtcgaagcgaaanagtcctaatagtagaagaaccctccataaacctggagtgactatantggatgcncccccatcctancacacattcgaagaacccgtatacntaanatctagaccnaannanggaaggaatcgaagcncccaangctggtttcaatgccaatgccctatggacctccatgactttgttcatgaacacaagagatctccatcagataacagcaagagtcgtgttggacggccccctttggccctggtcacaagctgcctcacacattggttttctggggggcggggccatactgcgttcctagaatggggctaatgctccgccgagaaagctgcggggtcccaaagatcaggtgtgga

SEQ ID NO: 615223 - DNA, 543 bp, Homo sapiens
aaaaggggccagtgggccccccccaataaatgggggtgggcccccccttgggcccccccgggttttcccttttatttttccggttttttttttgtgggaatttgtaaggggaaaccattttcccccgggaaccatttttccccttttttcccccaggttgaaatttcccccccctaaaagggaaaaaaagtgggggccccccccggggggggcccctttaaaaaaaaggggtccccccgggggcaggaatttgggccaaaaccctttttccccccccctttgggttttcaggcctttttttttcccccttttttcttttaaaccccccccccccagtggaacccccccccccgggcccccccaaattttttccgggtcccttggccccggggtttaaaaaccattttcccaaagccaaaaccgttttttcccccagggggggggggaaaccaaaaaccttggcccctttttggttggggtaaaaaaatttaaaaggtttttaatttttttaattggggaaaaaaacctgggggaaatccccca

SEQ ID NO: 615224 - DNA, 280 bp, Homo sapiens
tgtagttatcgaagctgagctcggacagcgcaccatcgagacgaatagtgaggatgctcttgtagtcgagctgtgaggcacttcagattctgtgcactgttctgcacgcgttaagaaggctgactggcattgtattagcaaactcatcactagacatcgtactacacgacacgtactacgttggtaggacagcaaatgaaaacaatctttctgttcatatagttattatcaatgtatgggaacgttaaaagagacttgtttgacaatgcccgtctacaag

SEQ ID NO: 615225 - DNA, 332 bp, Homo sapiens
ttaaggtttgtgtgcatatgttttgatgaattttaactttttataataggtttgtgtatattttatggcagtaaatgataaaacagactaatctacatatattttatgtagtcatgacataaacctaactttttcttaactttttgatatttctagtctatgtgtttcatctgcaggttttttcaaattgttgaaatctctgaaaaattttattggaaaaaaaatccatatatgtaagtgggaccccacacatttcaaacctgtgttcagggggtcagcctgtggtaaataattttcccccaaattaaggtggggaaaggggggggttacct

SEQ ID NO: 615226 - DNA, 170 bp, Homo sapiens
  misc_feature (32)..(33): n is a, c, g, or t
  misc_feature (41)..(41): n is a, c, g, or t
  misc_feature (58)..(58): n is a, c, g, or t
  misc_feature (66)..(67): n is a, c, g, or t
  misc_feature (75)..(75): n is a, c, g, or t
  misc_feature (80)..(81): n is a, c, g, or t
  misc_feature (96)..(97): n is a, c, g, or t
cttcagccttgtactgtgtatatatattattnnccccccanagttttgtatgtttttnttactttnnctattgtnataanncgcctgccatttttnntatgtggtttgggggatttttgtttgtttttcctgtttgggggttttgtttgttgttttggttttttttgggc

SEQ ID NO: 615227 - DNA, 249 bp, Homo sapiens
  misc_feature (14)..(14): n is a, c, g, or t
ataggatacacttntagcgagcgtctcgtcttaattcataagtaagcaccagaaattatttatatttggtgctgtttgtcgtgtaaattagatccccttgtcctttgatcaatagtaatgttgagtttatgaaaatgataaaatggaggacacatgagacaaggattttttaaagtagttgagagatattatattgtattgaaatatacaatataatcctatttgacatttatttgtcttgtatttgct

SEQ ID NO: 615228 - DNA, 146 bp, Homo sapiens
gttattatgaaggatgcctccaaaatgggacccatgggtaacgcaccttagtccacacattagctatcatatactggatgtctccaatatcaattgtcttcccagatatcccaagctatgtggacaagcatctcagggctctgacc

SEQ ID NO: 615229 - DNA, 147 bp, Homo sapiens
ccgcaatacctactcgtaaatcataggcagaaggtgctacggatactacacctgcaaaggcacaagggtacatagaccatataggcaattcagagcgggttgcccggttgtcctcagaaggcggcttgtttcccaagcctttccctt

SEQ ID NO: 615230 - DNA, 162 bp, Homo sapiens
cacagtcagtgcttgaggtcactggctactattgttacttgaactagcagagatatgatcatacagatgatagatcttccatcagtctgagccatctcagcactgagcctactcagtctacctagtgtcactgcaagataaagccattaagcaaacttaaat

SEQ ID NO: 615231 - DNA, 391 bp, Homo sapiens
gttcgaggcaggcgacacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaaaaacaaaaaaacagggctgggcccgggggctcgggcttttattcccggcatttggggaggctgaggcaattggatcgccagagttggggatttcgagaccagcctggccagattggtgaacccctgt

SEQ ID NO: 615232 - DNA, 159 bp, Homo sapiens
cagtggttcacacctgtaaacccaacactatgcaaagatatcctccaaactatttttcacgagtatctaccctatgtgtacttgggtttacatagtcaacctaaattctataaggaacaaaaaaacgcttaggcttaagaagatgtttctagcccggtg

SEQ ID NO: 615233 - DNA, 482 bp, Homo sapiens
tgggagacgggggtctcaccatgtggcccaggtcatcttgaactcttgagctctagcaatctccagcctcagtcccccaaagggcggggagtacagtggtgagccaccaggccgggcctactcagggcattttagtattctgtcactctttgggcaattaatggtgaactacctacctacggacccacattagggtattatcttacttcacggtatttaatttttgggtactggcacacactttctagcccaggcctctcctatagtaggcaatcctaagggtgattgattgtaaacatgtaactaatagtattttaaaactccaaaggcggacggggagtggagtagttacttttaattggaaagcaggtatttggcatgttattggacaggactatggtgattttatgtccagaagatcatagtgtggggtgggtggtttaaaaacttttatttttggagacagagcgagactcggtctc

SEQ ID NO: 615234 - DNA, 402 bp, Homo sapiens
  misc_feature (4)..(4): n is a, c, g, or t
  misc_feature (86)..(86): n is a, c, g, or t
  misc_feature (108)..(108): n is a, c, g, or t
ttancaggatttaagtctgaaagacacagtgtagaaaccccagaccaggaagtattcccatcccacccatgcctatggagacattncttgactgtgacttctgcaggnagcccactgaagtgtctagactgggttcagtcaaaatcaaatttgcgccgggcacggtggctcatgcctgtaatcccagcactttgggaggccgaggcgggcggatcatgaggtcaggagatcgagaccatcctggctaacacggtgaaacgccgtctctactaaaaatacaaaaaatgagccgggcatggtggcgggcgcctgtcgtcccagctactggggaggctgaggcaggagaatggggtgagcttgcagtgagcagagattgcaccactgcactccagcctgggcgac

SEQ ID NO: 615235 - DNA, 109 bp, Homo sapiens
acaaagccttcccctctgcgcgctgtcgattccagtaggaattctgactgttccttttataaaacagaagagggcgcccgccattaaaaaaataaaatacaggctgggc

SEQ ID NO: 615236 - DNA, 406 bp, Homo sapiens
agaggctgaggcaggattgaggccaggcattccagatcagcctgggcagcatagcaagaccccatctctacaaaaaaaaacccaaaactagatggatgtggtgcacagctacttggaaggttgaagtgggaggatcctttgagcccaggagtttgaggttacagtgagctatgattgcaccactgcatttccagcctaagccacagaatgagaccctgtctctataataaaagtttttaattagccaggtgtggtggtgcgtgcctgtagtcctagctgcttgggaggctcaggcaggaggatggctggaacccaggaggtcgaggctgcagtgagccattattgttccactgcactccagcctgggtgacagagcgagaccctgtctcaacaaacaaaacaaaaa

SEQ ID NO: 615237 - DNA, 119 bp, Homo sapiens
tggtagtcccacacctacacctggtagtcccacacctgcacctgggagtcccacacctagtcccacacctgcacctggcccagcccttagagccaatccttatccctgaggttacggat

SEQ ID NO: 615238 - DNA, 851 bp, Homo sapiens
tagtaagcctgtgttaatcggacgaggcttagatgagagatggtctccccaggaggaagggagtggtctggtggttggcacccactagatgagcatggtcagaaaaatatcaggatgagcaacttctttatctaggaccgtggcgttgggggtgccgtgtgcacatggtctgccagtggcgacggatgctgcagctggtagcgcccacgagcacccgctgtgcgtgtctgtgcctccaccgtgggaagcggctacccgaagaagcctcggattgctgcgtctacaccgtgtcaacggaagggagtggcatagtctgactccttgtggagcgaagcctggggagaggcctgccctcaccgcgctcagcatcagccactcacctcgtactggtcggcagttgcgcaatgaatacgatctggctctgtgtcgctggcactaggatttctacatggtcctcgaaactgatctaccaagcacgacctccgtacagcttggaggcaggccacggatgcaagctggcatgggtgcagaatctggaggctggcggtatccgtgcgagcgggatgtccagctgtagtacagcaggatggcagggcgcccaactagttgggcttaccaagattccattagccagaggaattggttgtcttatccctagtgctcgggccatgacctcaagcgccaatcgcgagcgggaactcggaatacgagggctcctgaggaagaagaccgggacgtgccaactctcagggcccacagatagatcaccgaagctcgcggacctactacaacgaagggagaagggcagcaggacacgctaccagcagccaggaaaggggccccggtaaggc

SEQ ID NO: 615239 - DNA, 876 bp, Homo sapiens
  misc_feature (861)..(861): n is a, c, g, or t
gaggagtttagaaacctcagagctgtcaaaggcccatataccgtaaccgggaatatccaggcgttcttgcacatgcccgaacttgctgtcgataccgtttacactcccccattcatttaagtacggcgtgatgcagctacatttcacgcatttcaggaggattgttgaaaaaacagctgcagagtaatctgggaaaacgtgctaagtacaataatgtagatctaaggaatttagtaaagtttaaatgccatgttgaaattgttgcattatgtctgggtagtatatacccaaatgggtgtatcatctgaagaccaacttgttctagagaatgcctgatggagctctgccatttaggacttgaattcttcaaagtctatgttattaatgaaatttatctaaatggcagcagtctatttgatgtcagctcatagacatgtacaaattgatgaatcgctgttttcttatgaaacaatattgtcacagtgtagttgatacattgctattagttgtccccgtgttcccgttttctcctgtatactgtgtaaaatgttggaaactacttttccagaaggcattatttatgcctccctaataaggtattgttacttatgacagatgaaaaggaaccaggatattgtatgaatttgttcactttcttagtgtgtgaacaagaagtagaaatatcactagtgtggtataggacgttacatgttttttatgatgaaaataattctcaatgccacttgaaaggtaaattagtgtactgagagctgcaatttttcaaccacaaaactgtcacttattcctacaggctatacagaaggtctttatggttttttgtctttgacttaatagcacgcngggaactgcctaacc

SEQ ID NO: 615240 - DNA, 159 bp, Homo sapiens
tagcaggactaccctatacttctgcatatgattactagaatacttgcaggagagccaagctaagaccccgaaccaggcgggctacctaggacagctaaagggcacaccctctatatggcaaatagtggggagattttaggtagaggcgacaaacctccg

SEQ ID NO: 615241 - DNA, 635 bp, Homo sapiens
  misc_feature (261)..(261): n is a, c, g, or t
acctgttaaccctttcgaccccccccttgtgtggggcggcggcccgctagggccactggaggtgtcatggaagcccccctagttggcaagcccacacctggtgcagtccactagcgtggtgatctgcttggacaaaacagttgcacaatacaatctttcgagaagttcagccccctttgtaactgagaacgccccacaatagctcacacctgtgcgggagtatattgctcgccccaccacaagagacatgttttgtcaaanaatcgcacgttcttttgtgcttctgcgcacctgtctgtgtagggaccagaagctccgctgagaatagatagagaaagatggtttgcttcaagacgcccgcgtgtgaatctgcgtgggtgtgacatcactcccctcccctgcgcccagtggcagtttcattctagctatcttttattatccatgcccacccctatttaattgtgtggccgcttttgcacccagattgagcgagttaatccatataattgtcaggtactagtttgttattcagaacacggaggcggggaatatatgttgtggcaatatttttgttgtccccagtaaaacaagaaaacagaggaacagtcccacaaaaaacaatagaacacagaaaa

SEQ ID NO: 615242 - DNA, 146 bp, Homo sapiens
aaagagttgtaaaattttaaagtgtaacaatttgagaaggggttttatatgttgttgataatttagtaaaataggagagaaattttaagtttttctgattgcttttatgtgatttatctgtatactttgttattaatataaataaa

SEQ ID NO: 615243 - DNA, 147 bp, Homo sapiens
tctggtgacctgaaagcagtattgacctgctgatctgatgtatatcgctgcaactggtgcctggactttccctgactggaacctgcgcatcttggggctgaagtgccccgagctgcggtgctgctggagtgaacagtgtctgcgcgc

SEQ ID NO: 615244 - DNA, 270 bp, Homo sapiens
attcagcaccccagcctcctgcagtccacactccacacggcagcccgagggacccttcagaggcctacgcgcctctgctcggaactgtgcggactgcctccctctcagaaggcgcagcccgcacccggcctcactctgcactcagcgccttgcgagcgagcttcaggtccgagagggtcccttgttcccgaaggtctccccgaccccggggccgcctttttggaggttgtgaggacccacgggcctgcacgaagtgagcgctgtgtaaaa

SEQ ID NO: 615245 - DNA, 328 bp, Homo sapiens
gcgtcggataagtgctggagcaggaggttgtgcgcagctgtggcgcgagtaagggggcattctaggcagagggagcagaatgaacaaagcccttcccgaaggagagtccgaactagtctcaggcttcaacatcgaatacgccgccggccctttcgccctattcttcatagccgaatacacaaacattattataataaacaccctcagcactacaatcttcctaggaacaacatatgacgcattctcccctgaactctaaacaacatatatggtcaccaagaccctatttctaacctccctgttcttatgaattcgaacagattacccc

SEQ ID NO: 615246 - DNA, 289 bp, Homo sapiens
gagcctgatccatgcttcggcggccggtggcagctctagatcagctctcgcagtctgagaggcggctaaggaaaggtgccacaccggagacgcgaaggagaggcccttaaaccttttctaagaagaatggaagaaaccatgaagcttgctccgatggaagacacagcggagttctgcctgttcctgataccagatgagttatgggactcacataaactttatgagagtcttcttaagttcatcgagagaatattcactctgtttgctcctatgctggtcccctacatca

SEQ ID NO: 615247 - DNA, 140 bp, Homo sapiens
tttgatgcgtctccttatagatccacactaacaaaagtcaagatagaaggtgagcctgcattcatactgacttaatatgaaggtggtacaataactgaagtgatccactgggagagcgcccttattataaaaatacacca

SEQ ID NO: 615248 - DNA, 573 bp, Homo sapiens
ttgagaatgccggggaagccaatatgtaacctaatatttgcctacctggccaaagcgtaattccggcaactcaccttagccgacgtccagcctattaaacgccctttcgaacaaagggcctctctaagaggtgttcactcccctgggagagcgcgtttgagaaggtcatctttctcaccgtagtcccctgcgtaatacgtcgtgcagctcacctccctccgtcaagtaagtccccctggggaacactctgcataggtctaggaccacccgatgtgtgcagtagctaagaatctgtatgtgctgccctacagtggttctgacacagatctatttcgccgcgcccgaaatatggcgggtaggagaatactgttctccgcccagtaccacaggggggggcagcgcccccgccggctccatggacaaaccatgacagcctgtcgttcactaccgcggtgaatgacccccctctgtttgtgtaaaataccacctcactgccccccattgtccgagttagttatcctattgttgcaccccggcgacgatctttccgggtgttttccccccaacaagaca

SEQ ID NO: 615249 - DNA, 1073 bp, Homo sapiens
  misc_feature (731)..(731): n is a, c, g, or t
cactcctattgttctggcatagctgtcgcgtggtgtaatctatcttgcagagctctgtgattgcgactgactagatctgaacatgtctgtcagagaacatgctatctgttgagcacctctgaacccctaaacctttgaggagatgtccactaggcttgcggattagtcgctcatagaatcgccgctcagcgtatctatataggagtagtctaagacgtgcgtcttgagactatcgcatggaaacctagtggtggctgtacgtgtcttgctatgatcccgtcttatgactttctagccattttgtagtgccaccacaggaggattccttagcgtatatccagtcgatacgtggcgccaagaaataaatttaactaaaatatcagtacatgccaaatcctgaatttgggaagtctgctgctcgcgaatttctcagcgtctcgtgttcatcatatgctatgtgcatcatactatctacctagaccaacattagatgcgcagaatctcgggtaccccattgcattagacatacactattggtattccaagagcctctgaagcagcatcgcaatttgtctgcaggcattgtatggtggtcgttatacagcgctgagtgaatgcgcatactacgtttcagcgaggaccctgatgtatgcaccttgattcgactgtagagggtcatgccgttctctgcgccgagatacaccgtgctgagactagaccatcggcgctgnattagcggccagtctctctgtatgcgaatgaaagaactttgaagacctaagttcaagggcctttccagttttcgactgaccaagaccattgcgggaaagttggtgcccaagacatggctgggaaaaccctgcgcagctgcatacccatcaaggccctgatggtccagaaaagagcaaacgaaatatttctcccacagcagaagtgaaacgctggggctgttttagtgccaagcatgcggtggggcgagacatgagaacaaaacctcttctggcatttgtttccccaattagtaaacgccaagaaattcaaaattcagccgaattgtggtggtttaaatgccg

SEQ ID NO: 615250 - DNA, 517 bp, Homo sapiens
agactgttaagagtgccaatcacgtgtaagcacagccgcgtttacagtaacaaacattcagaccatagcattgagcaacttgtaaagaactattaaaagtgtgcgcggccaggcgtagtggctcatgcctttaatcccagcacttggggaggccgaggtgggcagatcacctgaggtcaggagttcgagaccagtctgaccagcatggtgaaaccccgtctctactaaaaatataaaaattagtggggcgtgatggcaggtgcctgtaatcccagctactccagaggttgaagcaggagaagggctggaactcgagaggcagaggttacagtgagtggagattgcacccatttcactccagcctgagtgatagagcaagactccatctcaaaaaaaaaaaaggtgtgtgcggcaggtgggattgtgggagtaaacctaagggatgggtgtcatagcatcgcatagggccatttatcgaggttgacacttggatttctgggctgaggaggtcaggaag

SEQ ID NO: 615251 - DNA, 236 bp, Homo sapiens
cgtcgactggagggcggcagagaagagcagacaaaaatgtgtgtgtcgaggcaacagacagacacagggacaagcaggatgacagaaagccatgggggctgtcggtggggggagcagagaggcaggtaagaccctgtggggtctgcagtcagagatggagaggaagaaatggggagaggaagagcctggacccgaaagcacaaaaaaaaaaaagtcgtatcgatgtcggtcgacgc

SEQ ID NO: 615252 - DNA, 886 bp, Homo sapiens
ggacgcgtgggtcggcgttcaatgtcatcacatggcggtatctcatggctggcaacgaagtcgtggccactgcaggttcagtgagtccatcccagctcggatgcaggcaaacgttcaggggaagccagtgcgcagttggatgcagagggtattacacacgaatccgtcaagaagtgtcactcaagggacgagatatgggaaaggactgctcagccaaatggtggggggattgacacggcgaggttggactcccaagcatcctggacgaagtaataggaactggcctggtacgcgtgctgacacgaccttgtctactttgggacacacgcttgtggctatcaactggtataacggtaggtacatcgtgacatgcgaccgctagtcggtactccgtagcttcgttactagaggtcttggggaaggtatgacctggacttcaagtctcccgatgaccgccagataggtacatcgtcggcctggacctagcgtggctgaccgtgtacaaagtccttcatcaatggactacgccaggtggtgtcgtatcgaaggatcccgatttgaccgagggatgactgggggacgcttggcatgaagttcacagctcagttgcacggagatccatggtagatggtgaggactgagtctcaacaagatgagcaagggcccggagaggatcgccaaggccggtgaacgaggaagatcctgggaactggtgctagctgagtcagaagatcactcagacttggtgtccggaggaccgaagatctcatacgaggagcgtgcgaagcagggacccagggcctcatggttggcgggcgtaaagggaggtcgtcatggtccggggggacgacggaaaaaagccttcatcggtgaacgggtagagggc

SEQ ID NO: 615253 - DNA, 277 bp, Homo sapiens
  misc_feature (20)..(20): n is a, c, g, or t
ctccacccgacggggtggantggcagtaagctgagatcacgccactgcactccagcctggtgacagagtaagactccatctcaaaaaaaaaaaaagaaaagaaaagaaaaaagaaagaaaattgcaagtattagccaggggtggtgtcgggtacctataatcccagatactcaggaatctgaggcaggagaagggcttgaaactgggaggtggaggtggcagtaagctgagatcacgccactgcaatctccaccccgtggggtggagcgggtaccga

SEQ ID NO: 615254 - DNA, 1278 bp, Homo sapiens
  misc_feature (1173)..(1173): n is a, c, g, or t
  misc_feature (1178)..(1178): n is a, c, g, or t
  misc_feature (1180)..(1180): n is a, c, g, or t
  misc_feature (1230)..(1230): n is a, c, g, or t
  misc_feature (1237)..(1237): n is a, c, g, or t
  misc_feature (1246)..(1246): n is a, c, g, or t
  misc_feature (1275)..(1275): n is a, c, g, or t
tgtacgtctcttttgtgctctgtttttgttagttgcttgtgtcagcctccctgtctgggggtgcttctcacgagtttctgcgcccatctttgttttacaacccactggttgatgttgggctctcttattcttcgtttcatgtactctcctgttgacctgtgaccccatttgacgggtcttggtataaaaataggggcctttatcttgtgaggtttttcctgcgtttgtccagcttttcgccggggattcccccctgttcggggcctacatctgtgggaagcactttgtcatatagggctctccttttttttaaaggggcccaccaaccctagtagctgtaggggtcgtgagaaataacatttggagagtatattgtcgacagtaaaaccggtgttctttcgctgtttatcttggggtgtaaacaagaagtaggcttttaccaccgtttaaaaatggggaacaagtttgtgcgccccctggggttttgctacagtattccctggcggtgaatttcttctgttaatatgtgagaccccacaatagggtgcaatacactggaaaaggctttttaaaaaagcggaagggtgggcccacagtgtttatagctgtcgtgggttaaaaggcccacgggggccctcttcccaaccccgctggttgccacctgagcattttgctctttgtgggaacccctgggggccaagatgtccactgttgaaactcgataataggggggccctcccagagttttgccctttctcgtgtgaaagataggggggcataaattaaataactgggaccttaacctcccaaagggcccgtgtttgaaggcacttgactataatgctttttatgagaagcacattttgggaatccttcagcaccacggaaattttcaaagacctgagtatttttttaaaaataaggaaatgtcccccactgagaacttgataacgtccgtgtgtcccacgaatgctgtcacttagtctataatggttttcccaagagaactgagaatgaaatcccattggaggaagccggtggaataaactatgccacgagcacaaaatttgaggaaatacattaaccacgcattgccccgggaacataccgaggatgccttttctgtgattgggtgggattttttccccttttatgtgggaaatagtagttacntgtgncnagaataattttggaataatttctattaatatccactctgaagctaattgnactaatntgagattgngtttgttcataataaaagtgaagtgaatntga

SEQ ID NO: 615255 - DNA, 203 bp, Homo sapiens
ggagcagcagcctaagggtcatgggtgggcaggaggctagaggagggagctggggagagcaccaggcgggctatcaggccagtgctggaaagtgtggcacaaggggtctctcagctagctgctctgctgctcctgctcatggatgagttatggcgatggggccggtgatagccgcgctatcaaggtcccgtactcatacgaag

SEQ ID NO: 615256 - DNA, 1089 bp, Homo sapiens
gctttatactcgcgcgcgttgcgggtccacaggatggcgcgtgggtggcttctgtgcgacgcttgccggcgcgcgttctgctccgtgcgggggcccggatcgcggtggcgcggacacctcggtggggtgagcgagagctgggggcagaggcgagtgagcgagatgactgggctgacgcgtggcgtgacttcagagagaagaccatggcaggggtagcctggggtgtgatgcctggagcgacggggcgctgaggggatccgacatgtgattgacgattgcaagaaaccacctagtgaacaagcctgaggcctggagttgctgagacggggtgctggtgcatttagctgctggcaagaaagacatggaagaaagtgagcaacgaggctgtctgtggatggtggatttctgagcgtcggggaccggcacgtggatgtcgttcttggggaacgagagatgagaagctggatggatgagtgtgctgggagggacgtcaccggtcgatgtagtgttgggtgtaatttgcgaagaagccggttcgaggatctgtggggcttgctgggtgtaccatggtcgggcctgggatgtatgcgatctcacgtcaatacaacaggacgtgctgccccagctgggacggctggcatggttggcactgaacatgtgacctacccgcatcctgtgctggacaactcaccaggtaactgcctaggactcaagtgagaacccaagctggggcatatcaggccgctttcttggtttgaacagaccgccttgtgaggaacagccatcgggcaccgggggtggggtgactgtggccatagaagtaggggcgttggctaccagacgggggaagggcctgaaggggggatttggtgcaagtgggcccggggaacaggtcagacatgttggttacgaaaccagggtggtgaatcaaccactggagtgtagaatgaattaggaagcagtcggttctaaaggggtgagaaggacttaaactaacgtgttgtaaaaaagggggtttgttctgttgtattagtaattactttttttaagatagtaagaagataatagagagatagagacaagagaaga

SEQ ID NO: 615257 - DNA, 954 bp, Homo sapiens
acagaagatgaccttggagggaaaaaaaatattttttaaaaaaaagattatactgggtggaaggggggagaattcccattaacttaacttgctgaggagggaccgtgcttgggggagtaggggaaggcccagggagttggggcagggggctgcttatttcactcgtggggatttcgccagtggacacgttcttcaacttgggcaagctgctgcccatgtgttttccctgtgccccactttcacccccttgggggctgctcaggggtagggtgggcgtgggtggtaggaggttttttttttacccagggctcttgggaagggacaccaaactggtgtctggctggttacctttccctccggtcttcttccttcggcctttcacaggtccccttccttggcctgggtcctggtccaagccagggtcttaccgacccagcgcccacccgctctttcttcgcgggtgtcccgtggccgccttccagaattggccgtgggtgaactcatattgtgggttccccttttgtggtgtttgcattgttccgtggtttggcaggtgctctataacattgggcagggagttacacatggtagcgccggagaaaaatttctcacagatatcccagataccacaagcggggcatccaacggtggtaaaactttcgcccttatcaccccctgggggggacactttgcacgataaccattgggaaatcaggggagggggggacacacaggcggggctgctcaccgcggttctcttctcaccaacgctgcgcttctgcggtctcagtcgctgggttcacattgtttctccttcccatatcgtgtggccctttttttgtccccccgtatactacttcgtggcgcacgcgcgacatgtggtgtcagtatcaatccgtggtgcctacacaggctgcgctggtgtggtcagcgtgctgcactttcgggcacaat

SEQ ID NO: 615258 - DNA, 136 bp, Homo sapiens
gattcgtgtagtgcttcacgtggcatagtcacggacttgccgtctagggcactagtagtaggtcggcaggtcagctagggagctcgtggtgtacaggtccccggaggcatcctggctaggtggaagtatcaggcgg

SEQ ID NO: 615259 - DNA, 119 bp, Homo sapiens
cagagtcaaacagtgcctgattattttctatcctaatgtttcatttggctgcttttccaagttattctggatggttactggaccccaagattacctagccaactgtcagttttgagggg

SEQ ID NO: 615260 - DNA, 466 bp, Homo sapiens
tgcgccccgaaaaaaaaaacagggggttttttcttttttttaccggcccatggtggtaaatgcaacggggccgaagccttaggacaagcagtagagatgaccccgctcctcgttttatatgcgcgttattttatgggtattgggatccttactaaactaacgatgctattccccccatcatctctcccttggatactggttggctgttctcaaccccgtttcggactctcaccaagcccgggccgccaggcctgtccttcaccgtgaggtccagtagaggcccttcggtcgggcactaccttttgtcctccctatctttcttttcgcctgtcctccatagtctctatcgtgtcacgtataattctgtttggccagcccccgccccaagcatgttcttccccaagtatcttgctgtggagctcccccttttgtggcgtaacattccatcaaacctcgattcttcagg

SEQ ID NO: 615261 - DNA, 120 bp, Homo sapiens
  misc_feature (7)..(7): n is a, c, g, or t
gatcganaccaaccgcctgcaggaggctctgaacctcttcaagagcatctggaacaacagggggtgggtctggttgtcctcccggatgaccatgttgtagctgctgctggccaccacgaa

SEQ ID NO: 615262 - DNA, 122 bp, Homo sapiens
  misc_feature (7)..(7): n is a, c, g, or t
gatcganaccaaccgcctgcaggaggctctgaacctcttcaagagcatctggaacaacagatggctgcgcaccatctctgtgatccttgtttccttcaacaaggcaagattcttgcttcggc

SEQ ID NO: 615263 - DNA, 109 bp, Homo sapiens
tgaggacacggctgtctatacgtgcgaggtcggctagcagctcgtcccactgggtttccgcagaaatatattactactactacatggacgtctggggcaaagggaccac

SEQ ID NO: 615264 - DNA, 262 bp, Homo sapiens
  misc_feature (13)..(13): n is a, c, g, or t
  misc_feature (39)..(39): n is a, c, g, or t
ttcaggtaactangtgctacatgagcatgccatctctcnctgttgttcttaaagaaactgactgtcgaggggatctaaaacataccctacatggactgttgcagactgccttgatccatagttgtgtggtactttaccaccgaattgtcactagtgactttagagaaactccagaagagctgcttggctttcagcaagaggcctagcaaagaccatggcatgaggtctccatgagggacagccgtgtgttaggtctacctgg

SEQ ID NO: 615265 - DNA, 251 bp, Homo sapiens
ctatgttctcgaatcgttagaccacatgaaatgagcttctttgctcagccggtggctgtgggcatggtcagtacttcctcaggccaaaaaaaaaaaaaaaaaacctatggatttagggaaaaacattgagttaacaaaaaacaaagagcaccagggtaaggctaattttggataagcaatttccttattttccttttttcaggaagcggcttcaaccagaagaacccgtgccacgtgctcaggattgtctt

SEQ ID NO: 615266 - DNA, 150 bp, Homo sapiens
  misc_feature (108)..(108): n is a, c, g, or t
catagagacaagcttggagaaagagatgacactatcccacctgaatacagtcatcacctggcatgatattggtcaggccaatccagctggagccacctacatagcaantcagcaggctttcaaagcttcctttcagcatgcaccaagcat

SEQ ID NO: 615267 - DNA, 179 bp, Homo sapiens
ccagtcactcgctaagagttatgacatagttctacctttctgcactcactcctaagagttatgacatagttctaccttccccactcactcctaagagttatgacatagttctacctttctcactcactcctaagagtttgtgacagtagttcgtaccttccacactcactcctaagagg

SEQ ID NO: 615268 - DNA, 1144 bp, Homo sapiens
  misc_feature (1087)..(1087): n is a, c, g, or t
gagctgcggcttcccggcgctcgtggaatctgcgtggagccctttactccactcagcgagcctgagagtgcggaagtctccggctggtggggcatggacgaggagcagtagtgatgatgcgggggtgctggttgcgtgagacaggacagccgggaccagcgaagtcaagacttccacagtttggaagcacgtggtgatcgggcgtgggccaggagaccaatgatcagctgtataaggaaatgttctccgaaagcaagtcacagtgttgaacagcagagtgtaatgaacgggatcatgtcacgggtacacagccaggagtgtgcaggacagcggctaagaacccgtgggcctggagacgagcacaggcaaggcagcccagagatcaggcaacacgtgattctatagcaaagggggactgctggactcagggaaggcatcgacggactggggatcatggggcctgggaaacacatgggggaagcaaacctccttgagtcccacattgacgtacataggtggccaccctcagtaggaacggggacacacactgattgtccacactactacaagaacacacggggaaagtccccctttgtggggaccacaaccgtgggcacgcttccaaatggaggacacttgggacgacgcaagcttcatccctaacgtcgtccaacagtggaagcccgccccgagaagaaacacttaggccaccggaggtgttaacccaaggaagggcaacctagaatagcccaacagagttgggggatgggaggtggaacgtaccaccccgtgggggaatacaccaactatacagcaccccgacaatgaggaggtcgcccccaggaggatgtaacagcccaaaagtaaggaaggagcagtcagcacggatgtcccttattgaaagcccccgtcctgggcgagcaaaccacatatcaccaaatgtgtacatagcccaaacagcacatccctcgggaatgagagcaggacactggcggtatggacggtccacaagggcggggagcaagcgcaacccgccagtgttggggacacgcacagtgcgccgcatcttgaacagcgacccaccgcnttacaggtgtggcacagccaaccacgatgggacgggacgaagaggcgtaaacaacaa

SEQ ID NO: 615269 - DNA, 278 bp, Homo sapiens
  misc_feature (51)..(51): n is a, c, g, or t
  misc_feature (88)..(88): n is a, c, g, or t
  misc_feature (121)..(121): n is a, c, g, or t
  misc_feature (133)..(133): n is a, c, g, or t
  misc_feature (160)..(160): n is a, c, g, or t
  misc_feature (207)..(207): n is a, c, g, or t
atcccttatacactattgggcattgcaaattaggtacaacccattttgggnaacaatatgggaggtttctcaaaaaactaaaactagnattaccatatgttccagcaatcccatttatagntatatacccaanggaattgaaatcagtatatcaaacagntgtccatgctgccatgttcattgcagcattatgtacaatagccaagntgcagaaataacctaagtgcccatcagtgaatgaatggtttttttaagtatgccatatatacacaatggaa

SEQ ID NO: 615270 - DNA, 1834 bp, Homo sapiens
ccagacctggtccctgctgtgctctcccgttggatctctgacatggaggaaatgctgtccttctgggatgtggccattgatttttctccagaagagaaagaatgcctggaccctgctcagtgggatctgtacagggatgtgatgctggagaatttcagccaccttgatttcctgggtcttgctgttgctaaaccatacttggtaacatttctggagcaaaaccaagggtcttcgggtgtgaaaagccaaacatcagccaccattcctccaggaacaacaggcaatgaatttaacaatcacaatgaggccattgatcacagctctctaagtatgcaatgccagagaattcatacaggagaggaaccctactactttgaagactgtggtaaggcccttagttctcaggcaacactttctgtactccagggacattttattggagacaaaccctacaagtgtagagaatgtcataaaacacttagcagtcgctcatcacttttaatacaccagaaatatcatactgatgaaaaaacctacaagtgtgaaaaatgtggcaaagggtttttccgttcctcagatcttcagcatcatcaaaaaattcatactggagagaaaccatacaaatgtgaagagtgtgacaaagcctttcttcatcactcatatcttaggaaacaccaggcagttcatactggagagaaaccctacaagtgtgaagagtgtggaaattcattttactatcctgcaatgctgaagcaacatcaaagaattcattctggagagaaacttgacaagtgtgaagaatgtgggaaagtattttcctctgctttctttcttaaccagcataaaggaattgattccggagagaaaaggtacaagtgtcaagaatgtggcaaatccttttgctatcgttcatatcttagggaacattatagaatgcattctggagaatatccctacaagtgcgaagaatgtggcaaagggttttcccgttcctcaaagcttcaggaacatcaaacaattcatactggagttaaaccttacaagtgtgaagagtgtgggaaatgtttttcctcttttacgtcccttaaaagacatcaaatcatccattctgaagatactccccatgagtgtgtagaatgcggcaaaaggttttctagttcttcccgccttcaggaacatcagaaaattcacactgaagagaaaccatacaaatgtgaggaatgtgacaaagcctttctttatcactcgtttcttaggagacacaaagcagttcatactagagagaaaccctacatgtgtgaaaagtgtaggaaatgtttttcttcctttacatccctgaaaagacatcaaatccattccatagacatttcccatgagtgtgtataatgtggcaaaagattttctagttcttcccacctacaggaacatctagaaattcatactggagaaatcatacaaatatgaagactgtcacaaagcctttctttatcattcatttcttaggagacttgaggcagttcacagagagaaaccatacaagtgtgaagagtatgggaaatgtctgttcttttcttcaacccttaaaagacatcaaataattcattatgaagtcagtctctacaagtgtggggaatgtttaaagctccttgtatgctgtccactcttaagaaacacaaatttgttcattttggagaggaacatacaagtgtgaccaatgtcagaaagccttgtcttttgtaatacttctctatttgagcacaagctaagtcatactggagtgaaattttcctagtttgaagaatataccaaaatattttactctaatttataactg

SEQ ID NO: 615271 - DNA, 195 bp, Homo sapiens
aaacattttatcaaaggcctatctcattctgcttagccctatcttaggattctccacaaaatcaagcttaggaggcctttaggtttaccttttccaggtacttcctcttagcgagaaggacggaggaaacaaggtaaggtgcgtagaattgggctattgattcaacttgtatggaatagaggtgtggaagcgcac

SEQ ID NO: 615272 - DNA, 722 bp, Homo sapiens
  misc_feature (135)..(135): n is a, c, g, or t
  misc_feature (364)..(364): n is a, c, g, or t
  misc_feature (377)..(377): n is a, c, g, or t
  misc_feature (393)..(393): n is a, c, g, or t
  misc_feature (401)..(401): n is a, c, g, or t
  misc_feature (428)..(428): n is a, c, g, or t
  misc_feature (431)..(431): n is a, c, g, or t
  misc_feature (445)..(445): n is a, c, g, or t
  misc_feature (449)..(449): n is a, c, g, or t
  misc_feature (498)..(498): n is a, c, g, or t
  misc_feature (500)..(500): n is a, c, g, or t
  misc_feature (548)..(548): n is a, c, g, or t
  misc_feature (552)..(552): n is a, c, g, or t
  misc_feature (606)..(606): n is a, c, g, or t
  misc_feature (617)..(617): n is a, c, g, or t
  misc_feature (628)..(628): n is a, c, g, or t
  misc_feature (630)..(630): n is a, c, g, or t
  misc_feature (660)..(660): n is a, c, g, or t
  misc_feature (672)..(672): n is a, c, g, or t
  misc_feature (680)..(680): n is a, c, g, or t
  misc_feature (719)..(719): n is a, c, g, or t
tgtgctccaccgtgacctgagcacctctcctgctactatgtgttgccctggtgctgcttgggcatgtgaatggagccacagtaagaaatgaggacaaatggaagccactcaacaaccccagaaacagagatctgnttttcagaaggcttcaggcatattttaagggcagaggtcttgatcttggaacatttccaaatcctttccccacgaatgaaaatcctagacctctctctttcagtcagaacttactgcttctgcatctgcagattatgaagagcaagaaaaactcctttcacaattatctcaaaggctgaaagtttcttctgagctcaggtgtctggctattttaaaactacagatgaangcttctcattagnaaaaattaaccattgncatagctnaactttcatggagtttctttccccctnctnttatttttcagttngtangattttattccacatttccatattacatataaatcgctggaactatgantnctatgcatatttatggagttttttttcctatgaaacccataaatattngatngtacagcaccgcatgtatttggtagggagttccaaaaaacatcacaaactgganaaaaggttatnatctaaattangntggtttcttaagccttggtttttaaaactnggcctttatggntaattatnctcttatcgaccaatttatttttttaaaggacctgctcnctt

SEQ ID NO: 615273 - DNA, 175 bp, Homo sapiens
gcagaacaccaaatggcggatgacgccggtgcagcgggggggcccgggggtccctggtggccctgggatggggaaccgcgggtggcttccgcggaggtttcggcagtgtgcatccggggtccggggtctgactgcgccgtggtacgtggtgccggtgggccgagtgccgcggtag

SEQ ID NO: 615274 - DNA, 1069 bp, Homo sapiens
atttttgtcaacaccagacctgtcctacaagacatgctaaagggagttattcagtctgaaagaaaaggatgttaatgaactataagaaatcatctgaagatgcaaaactcattggtaatagtaagtacacagacaagtacagaatagtataaaaccataatcatggtatgtaaactactcatattttgagtattttgagtagagggactaaaagatgaaccaatcaaaaataagtactacaaccacttttaagacatagacagacagtataataagatctaaatagaaacagcaaaatgtttaaaaatgggaagagttttattggtttacagtgtagagttttattggttttctctttgcttctttgttagtgtgtttatacaaccacagtgttagcttatcagtttaaaataatgggttagaagacgttatttgcaagcctcatgataatctcaaatcaaaaagcctacaacagataacaattgaaatgccagaaattcacaatgtaccaccagggaaaatcacctttatgaacacgaagactagaagaaaggacacaagaaggcaagggaagactacaaaacaatcagaaaaacaaataataaaatgacgggatatcacagagatttcctgtactccagtgttacatcacgttaaaaagctttttacacagcaaggggtgggttcatggattacaaactatgttaagattggataaatgtatttcgatagcaactgagtgaaaaggtcacaatattgtcctttcaataactaaagattattggttggtggaccacgaaagaaagctgagaggaggaaatcacaaaggccagaggtcacactaaacaatatgcctcgtgatacaaatgtatccccaaaataatacaatataaccccacaaatatatacacaaaacaagcgccactaaaaacctcagacaaaatacaacacattatagcaacaaaacaacaacaaacacaaaaaaaaaataaacacaagtaatataacaaacaaatctagtaactccaaaacaactacacaaaaataaaaaacacaccaacacaagaaa

SEQ ID NO: 615275 - DNA, 259 bp, Homo sapiens
ctccatggctggtacacccctcttgtaactgtacatgatcttccccagttccaggttcttcccgtgtgctcctcacacctgctcctcagctcccggttctcctcctgtgtctgcctttaccactgcatccaggtccttctgcctgtactaggagcaggtccactaataggtccggtgcacatggggtgggcccccatggcgtgggaacaccctgggtgtgggccctggcacagggaaatgtccatgtgctcccaatgaa

SEQ ID NO: 615276 - DNA, 624 bp, Homo sapiens
tgacaacgatgaagaagaggttgtcacctttgagctgggcgagatgttgcttatgctttaggctgcaggtggggacgacgaactaacagactctgaagatgagtgggacttgtttcatgatgagctggaagcattttgatgacttggatctatagcaaccttgcgatggcgtgtgaactggtctgctgacctcagacagcagctgtcccctgtggatggtgtggcagagccaggtgtactcctccttaggcaaggcttcttcaattccaaggtgactgtcctaagaaattttaacccagggcctagtctatctcaacccctcacctttccctgaggagtgtgtcagtgatacccatattgaaaaaagttacaaacaataaatcttaaagttagtcactcaagtaacacgaatttaactgtcagacagattagtgtaggtgtgtagcgtcaatctgttttcaaccagattgcatatatggacttttcacacactcattatgaggacccaaggttccaaaagtcaacagcagatggcctgctttggggtccaagaataggagtgatggatgaagggacctaaagctgtgcaatacgcctcttgaccagacatagaatgtaggatca

SEQ ID NO: 615277 - DNA, 225 bp, Homo sapiens
aggagaaggagaggtgtgggaacagctagtcaggggagcagtgagaacacactcaacatttattgatgaagttcgcagtctaataatgagcatggtagtggcacccaaaaacaattacaacagtcacatcaaagatcgctgtcactgatcacagatcaccataacacatatgacaataatgaaaaagtttaaaatattgtgagattacccaaatgtgccataaag

SEQ ID NO: 615278 - DNA, 1324 bp, Homo sapiens
  misc_feature (135)..(135): n is a, c, g, or t
ggtcccgagtcttgtcggagattgagtggttccggaagatctggccagctaagattctactccctggctgtgccaccgaggttccctaccccgtggtctacgatcggctccgcgcatcgttcgcggcgttagcgnacgtaagaagagccatcccgcgaccgggaggaccgttccgagcctcgcgaagagctaggcgctggtcgcagcagtatcccctcgaagattcttgatctctgaacgttgtgaaggtcctccgaaggactgttcttgtgtgtgaatctgtttagagagggttacgacggaggcttggaaggcatgcgctgaaaggccgcagggccttacattgaggggctacgtgtacgggcgcgttgagcgaacgattgggaatgccgattggggagggcaagacgtgtactcccaaagcacttagaattcctttgcactccgcctacttattttgccgcccaagtcgctacgatttgggggggttggcaccggacagcgggtgtctagggggcgagatcgagttgaaagcgggccccgggggaaccaaccgccgtttataggttcgaaatacgcgcgatgaattcctacggggccccttggcgtgggacgtcccacagggacaagtgcgtctggagacgcccgtataaattcgttttcgacttaccgcttagcgcctctccgccatggaaccaaggggggcccgcgcacagccgtggaagcaccgacacgggaacgcataggaatcgcggaaccccgggagtggcccagacttgcgaagagggcagcccggcgagaaaaccgttggccgccaccaacagctttggccagcggggagaggcataagcacaacccaggccgtcccaagggcccatttcgcaaggataattccgttccttgtggtcccccatgggtgtgaaacccggaacttgaatctggcggcacaaaccctgccctgagcacttcccccaaggtccccgcttgagacacgacaaagccgacttgttaattccccgggggcggttacatacgccgagatgagccgacgactaccagccacgttgtcccaagacgttatttacacccaaagaaggccgatatcggagctaccctttgtcacacctaaccgcttaaattcaattaacctgtgagggccccccggtgataaacggtgcacgtcaaaacacttccctgcgccagaggcaccagacgaaacacttcggccgcagaagacacacatatgccgactgagggcaacatgaggagcaataggccgacaccttcccacgtgcgcaaaccgaggttctaacccccagcagca

SEQ ID NO: 615279 - DNA, 487 bp, Homo sapiens
  misc_feature (19)..(19): n is a, c, g, or t
  misc_feature (25)..(25): n is a, c, g, or t
  misc_feature (31)..(34): n is a, c, g, or t
  misc_feature (50)..(50): n is a, c, g, or t
  misc_feature (224)..(224): n is a, c, g, or t
  misc_feature (231)..(231): n is a, c, g, or t
  misc_feature (240)..(240): n is a, c, g, or t
  misc_feature (252)..(252): n is a, c, g, or t
  misc_feature (289)..(289): n is a, c, g, or t
  misc_feature (326)..(326): n is a, c, g, or t
  misc_feature (363)..(363): n is a, c, g, or t
  misc_feature (400)..(400): n is a, c, g, or t
atcaggatatcttacgccnactctnacctannnntacctagccctaaccntaaaactaacctagctcataaacttacgtagtctaacctaacatatttaacttacctaaccctagatatatttacttgtgggactataaaatgtcccagtttcttttcttttactcttcttgtgcggacacacaaacaaacgcacacggctcactggagtgtgtaagggctgtncagaganaacccttcnctggagtgtgtnagggctgttcagagagaacccttcactggagtgtgtnagggctgttcagagagaacccttcactggagtgtgtnagggctgttcagagagaacccttcactggagtgtgtnagggctgttcagagagaacgcttcactggagtgtgtnagggctgattagagagaacctttcactggagtgtgttagggctgttcagagggaacccttcaatggcgtgtgttagggctgttcaga

SEQ ID NO: 615280 - DNA, 196 bp, Homo sapiens
taaattttcaccagtattatcttctatttgcaaactgaaaaatgttgtaagctttcatattaaattacctacattagtgaacattatatctctttagtaagaaaggccatattttgctcctgcttctgtcaaaatattatttgtttgaaggggaaattatggtagtgtgacctttcacttatttccgtatctcccc

SEQ ID NO: 615281 - DNA, 150 bp, Homo sapiens
  misc_feature (110)..(110): n is a, c, g, or t
actcatcatcttcctccaatggtgtttaaaccaaagcaatggagaccaatgctctgataccacttgtaggaccttgagaagaggtgtctagagggggggggggtgattanacactaagtatcaaagttgcagcttttaacttctttaagt

SEQ ID NO: 615282 - DNA, 1079 bp, Homo sapiens
  misc_feature (397)..(397): n is a, c, g, or t
  misc_feature (406)..(406): n is a, c, g, or t
  misc_feature (408)..(408): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (446)..(446): n is a, c, g, or t
  misc_feature (454)..(454): n is a, c, g, or t
  misc_feature (468)..(468): n is a, c, g, or t
  misc_feature (474)..(475): n is a, c, g, or t
  misc_feature (488)..(488): n is a, c, g, or t
  misc_feature (492)..(492): n is a, c, g, or t
  misc_feature (498)..(498): n is a, c, g, or t
  misc_feature (507)..(507): n is a, c, g, or t
  misc_feature (514)..(515): n is a, c, g, or t
  misc_feature (520)..(520): n is a, c, g, or t
  misc_feature (522)..(522): n is a, c, g, or t
  misc_feature (526)..(526): n is a, c, g, or t
  misc_feature (536)..(536): n is a, c, g, or t
  misc_feature (550)..(550): n is a, c, g, or t
  misc_feature (555)..(555): n is a, c, g, or t
  misc_feature (558)..(558): n is a, c, g, or t
  misc_feature (562)..(562): n is a, c, g, or t
  misc_feature (570)..(570): n is a, c, g, or t
  misc_feature (579)..(579): n is a, c, g, or t
  misc_feature (581)..(581): n is a, c, g, or t
  misc_feature (583)..(583): n is a, c, g, or t
  misc_feature (589)..(590): n is a, c, g, or t
  misc_feature (592)..(592): n is a, c, g, or t
  misc_feature (595)..(595): n is a, c, g, or t
  misc_feature (597)..(597): n is a, c, g, or t
  misc_feature (622)..(624): n is a, c, g, or t
  misc_feature (627)..(627): n is a, c, g, or t
  misc_feature (629)..(629): n is a, c, g, or t
  misc_feature (632)..(632): n is a, c, g, or t
  misc_feature (635)..(635): n is a, c, g, or t
gcgtttccttatgcttttgtcatgtcgtgtttctttggtcgcttctcagggcagttttcttgagctgggtgctctcctgtgtgctcgggatgcctggcgcagctttggctagcgctatggtttagtacctcggatccgggtgttttcccgacccgtttttgggccgcatatggggggcctcggccgccccctgggacccccttaaggggtcgactggcttgtttgtcacgaggcctggttgccccgggtccaatggccccgtctggtccaattgagggcacttgcgagaattctggcccggccggcaaggggttggcttaagcgttggggtcccgatccagatccttggcaggttagcgcccatgtttgggcgccctcctcaagcagggccccctgnagccgttcnanccagggcctccaganggcccnccntgggggtctcaacntcccaggntctggccatatctncctccnncctttcaggggcnagancctggntcccagggncagctcnngcagnanttangggaccgcanctggggaggccgcngggtnctngggnccctgggngtccccctngngngactcnncnccngntcgtcgtcgtccctcgggccctcgnnntangnaantcntggctgcccccctatgtcggtcccgttatcccgtgttatctgttcccctttaataggttttttttttttttttttttttcctcgtaggagtcagcaaagaaagacaatttctctgccccttgggatggaggggcagaattgggctaggggtcgcctggagcccacccccctttgctcagtctccttctgtcctcttctcgcggctctgtggtggagggggcgcggctccggctgcagggggtggggccgagagggccgaaggggccgggtggcctgggttaccctcctgctcaggcgcctgggtccactgggctgtctggaccccaagctaggggactggggaggagaaagacagcttctgggggtttagggtggggtcgaggatcaagggggtctccactgggctctatcggcgcttgtcggggaggggaaggggtgggttgg

SEQ ID NO: 615283 - DNA, 231 bp, Homo sapiens
gggacccttatcctccaagcccatttcatcaccaactcctggcaattctatctgtttaagtctttcaaatgtatctaactattcttcagaatcactgccctagccttataaaagaagccaggattagttctcacctaaatttctgcaacagcatcctagctagtctcccagcctctagtcttgcctcctattgatctatgcagccagagagatctttgctacatcactcca

SEQ ID NO: 615284 - DNA, 425 bp, Homo sapiens
  misc_feature (10)..(10): n is a, c, g, or t
  misc_feature (179)..(179): n is a, c, g, or t
  misc_feature (275)..(275): n is a, c, g, or t
  misc_feature (288)..(288): n is a, c, g, or t
ccaattgagnctttgaaggagggcaaatcaaagtcgtttctggggagcctcggtttcccctgtctttccaaactggggtaaataataatagctgtgagcctcaagatgagatgtgcaatcccagctacctggccccagatgccagctctgacttctttcttggccctgcaccaaggcantgccactgccaagggaatgagtcccctctccatatgacaggtcccatcaggcctccaccttcctgtgtgtcttatttctcagcatctgcccccacnagtgcttttgcanacgttggtccctctgtccagatcacctgccctccaagaggcccgtccctacggcttccccgcagcagtcagagccaggggtgggtctctggccacctctggaagaagccctggcccaccgatcatgtttgtaatgat

SEQ ID NO: 615285 - DNA, 259 bp, Homo sapiens
gcctctatgtagcttcaggacagggactggtcacaggaaagaccaaggcagcattaaagggtcgggacttttagccccctactcccccctccaggaaccaaaaagggtggaaaggttgtttacccccaatggccaatgatgtaatcaatcctgcctacagaatgaagcctccataaaaaccccaaaggacagggtttggagagcttttgcatagctgaacccccggagcttcctaaagggtggcccccccggagagggc

SEQ ID NO: 615286 - DNA, 165 bp, Homo sapiens
gttatgggtcccacctgtctaccggctcattggtcgacaggctggccccaccgtttgggggtcttgtcgggggctggttactgttgcctcgcctctgatgacgagggctttgtcgaggtaagcatggctatagtgccgccgccttgcagactctcactgtagcct

SEQ ID NO: 615287 - DNA, 585 bp, Homo sapiens
tccccagtccataccactatggcaggcatgaaggtgggtggattgcctgagctcaggaggttcgagaccatgcctgggcaatacggtgaaaccccatctctattaaaatgcaaaaaattagctgggtgtggcagcggacgcctgtagtctcagctactggggaggctgaggcaggagaatcgactgaacccgggagggcagaggttgcagtgagccaagatggtgccaccgcactccagtctgggcgacagagcaagactccatctcaaaacaacaacaaaaacaaaatagttgtgggccaggtgtaatggctcacgcctgtaatcccagcactttgggagggtgtaagtttaagaccagcctaggcaacacgagaccccgtctctacaaaaaaatattaaaaaaaaattagtcaggcatgacagtgcacatttgtggtcccagctactcaggagcttgaggtgggctgattgcgtgggcctaggaggtcaaagctacagagagccatgatcacactactgtactccagcctgtgtgacagagcgagaccctgtctctcaaaggcaggacaacacttagctgaat

SEQ ID NO: 615288 - DNA, 516 bp, Homo sapiens
ccttcttcaagaaatccttcttggaaccctgacacatttaacacagcgcccctcatcgtcctgcatagagcggttagcgtggcccaccatctgaagcacgtcatagctgttgcctgcacagataggcatggatcttgcctttgtagtactgggtattcatgatgattggcaggtgggcagacacgttcatgccccagatagagagtccgagaagtcaccagcagctgaatagcccctgagctgaagagctgctccaccaggcgtcgctccatggggctgagcccctcatgcaggtagcccaccccatttagcagcgtttccttgagcgtgctgtcacttagcttctccaggtacggaatcagatccttctcggtgcagtgcaagaacctctgccgttggatgtctgctgcacaggtggtgaggatgtcaatggcagtgaggcgggtctgcttgcgagacggcacaaagacaatgacaggcttcttgggcgagtgcttggtgatagcatggtacaca

SEQ ID NO: 615289 - DNA, 920 bp, Homo sapiens
tggttataaacggagcctgtttgtgacacgcctagtgtgtccttgggtacgcccactcaccgctgtgtggtgcgccctcctagtgtagacccgcgggggcgagatcaacacctctccggggttttttacatttggaccgccggggggcgggggtgatccaacttgtcgtcagcccgggggacagcgtttttggcacccatggccgctctttgttgggggcgcccccaattaggacacacaaggtgttgggcacagcagcagaaacagggcggtggtgtccaccgtcccgcggtttttcccccgggggggattgtttttggttgcccccccgcggcttcgcgcggtgttagtcgcacggagatggatacacactttttctcttgccccaccgggtgttttttcatcccgcccaaggggcgacgccactctcgtctgggttgactccgcgccagacagaagtgttgtgatgacaccaccgacgcgggcggctgtggcgccccctttcttgtatgtatcatgtgtatctctggcctgcggtacggtctcctccttgccgagggcgccgttatatccctgccgcgataaaattttgttctagcccaacaagggtttacactcgtttgttcccccacacaacgttgtaacacatattacgcggaatagtatcatcacccccccttgttgatacaccctccttttaaagccgtggcctactccgggaaactcacttttttcccacggatgttttctaaatacataacagcaccattttctcccccgaatcaccacccttcatccaccacaccaaactccccttttccttaacccaaccccccctttcatttttttggggtttttaaccccttggccccctccccccccccaaatttaaaaaaacccccccatgcccctttttttta

SEQ ID NO: 615290 - DNA, 125 bp, Homo sapiens
atatttccttgcatgatatattgtccatagaaaaatcaaaacactactgaaaactcttctccgtggatttacgtcaagatcagtcgtctggtctggcgcggtgactcacacctgtaatctgagca

SEQ ID NO: 615291 - DNA, 758 bp, Homo sapiens
  misc_feature (13)..(13): n is a, c, g, or t
  misc_feature (61)..(61): n is a, c, g, or t
  misc_feature (65)..(65): n is a, c, g, or t
  misc_feature (69)..(69): n is a, c, g, or t
  misc_feature (72)..(73): n is a, c, g, or t
  misc_feature (80)..(80): n is a, c, g, or t
  misc_feature (82)..(82): n is a, c, g, or t
  misc_feature (94)..(95): n is a, c, g, or t
  misc_feature (103)..(103): n is a, c, g, or t
  misc_feature (109)..(109): n is a, c, g, or t
  misc_feature (113)..(113): n is a, c, g, or t
  misc_feature (125)..(125): n is a, c, g, or t
  misc_feature (136)..(136): n is a, c, g, or t
  misc_feature (141)..(143): n is a, c, g, or t
  misc_feature (157)..(158): n is a, c, g, or t
  misc_feature (160)..(160): n is a, c, g, or t
  misc_feature (172)..(172): n is a, c, g, or t
  misc_feature (184)..(184): n is a, c, g, or t
  misc_feature (196)..(196): n is a, c, g, or t
  misc_feature (205)..(206): n is a, c, g, or t
  misc_feature (213)..(213): n is a, c, g, or t
  misc_feature (229)..(229): n is a, c, g, or t
  misc_feature (241)..(241): n is a, c, g, or t
  misc_feature (250)..(250): n is a, c, g, or t
  misc_feature (255)..(255): n is a, c, g, or t
  misc_feature (257)..(257): n is a, c, g, or t
  misc_feature (261)..(261): n is a, c, g, or t
  misc_feature (273)..(273): n is a, c, g, or t
  misc_feature (283)..(283): n is a, c, g, or t
  misc_feature (286)..(286): n is a, c, g, or t
  misc_feature (299)..(299): n is a, c, g, or t
  misc_feature (305)..(305): n is a, c, g, or t
  misc_feature (319)..(319): n is a, c, g, or t
  misc_feature (536)..(536): n is a, c, g, or t
  misc_feature (577)..(577): n is a, c, g, or t
  misc_feature (597)..(597): n is a, c, g, or t
  misc_feature (602)..(602): n is a, c, g, or t
  misc_feature (604)..(604): n is a, c, g, or t
  misc_feature (609)..(610): n is a, c, g, or t
  misc_feature (652)..(652): n is a, c, g, or t
  misc_feature (667)..(667): n is a, c, g, or t
  misc_feature (685)..(685): n is a, c, g, or t
  misc_feature (756)..(756): n is a, c, g, or t
gacaacagaagtncactaaggatgaacgaatgaactgagaagaattaaaaaaacgaaaacnaacncaancannacgaaancnccttgaacgaannaagaaganaaaagnaaanaaaggaaaaaanaaaaaaggaanaaaannnagaaaaaagaatcnnanaaaaaaataaanaaaaaaaaaaanaacgaaaaaaantaaaggaannaataganaaggaaaaaggaagtnaaaagatcgganaagagaatnaaaananaaangaaggaagagangaagaagaanaangaggaagacatantaaggnagaggggagggatntcgcacacggccgtcttcacgttgttggggattcactccacgaagtagctgctgttcttgttctgcacgttgagcatctcctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcncccggtactgctggctgccccggctggtcaggggcgcgaancggggcatgaagaagtgcangaaangnaaggnnacatgttcaccgccagcttgcgcaggtctgcgttcagctggnccgggaagcgcaggnaggtggtgaccccgctcntggtggccgacaccaggtggtttgatgtccccgtagttgggggtggtcagcttcagggtgcggaacagatntc

SEQ ID NO: 615292 - DNA, 223 bp, Homo sapiens
  misc_feature (178)..(178): n is a, c, g, or t
tttttttcataatgcaggcataaagggtggagtgaagccaggtcataagtttcatgtttgcttttgttttgttttgtttttaatgtatgtaccaaatgttccagttttagggatccgggatgggagccccccctttaaaaagggtggtccctcctttaatcctctacccaccaatgtnctttttttctttttttttaaaaaaaataaaataaatttgtgccta

SEQ ID NO: 615293 - DNA, 227 bp, Homo sapiens
aggttgttgacaccgaacctcaaccatcgtgacgaaatcaatggaaagaggaagaccgccaaaaaacagaaaatgatccaacgtgcgcaagagttgcgggggagagctgaggactaccacaaatgcgacatcctcccttctgcaagaaaggctatttgcaactgaaccagaagggcgggagcgaagcatcggcattcttaagaatagccttactggccctaccttac

SEQ ID NO: 615294 - DNA, 102 bp, Homo sapiens
taaattcgcggtcgtgtctacctttgggaggccaggggaggaggattgctagagcctgggggttcaagaccagcctgggcaaagtggttaggacccattctc

SEQ ID NO: 615295 - DNA, 1344 bp, Homo sapiens
  misc_feature (467)..(467): n is a, c, g, or t
taaaaggaaaacccggaaatgatgtcggggttgagggataggaggaaaaggggggataggtgtatgaacatgaggggtgttttctcggtggtgaagtgagggttaaagtgtgtgtaaacgtggtgggggggtgaggtgagccccattgggtgttgggtggataaaatagtgttaagagggagataatagggcgtggtgacatagctagtgttggagctccgtggtaagtataggaaagagtgtgacatattgtgtgacctcgaggaaaacagcgtgtggtgtatactatagaccaacagagagagagtgtctcctccacagatatgagagtgtataaaatagtagtggcggcggtataacgggcgaaggtttataggcgaaggtcttggtctagagaagaggtctatccacagacagagcgtatatataaagtgtgagcgatgtcaaaaagttttgtggaatgtccntatagaaagaagaagggtattttatcgaatgcgcgcgcacttgtggagaatgtgcgcgttgtactcggtgacagtctttggcaatgtcttggcgtaaacgggccagagcacaatacagtggtcaccatggagaggggggatttgtaaaacacgcgcccctgtgagcggcgcgcaaaaaaactatcgcgagagaatattcagaccctgggcgaccctcagtgtagagaaaacgctctcacagaggggggagtgtatagcgggactaagacgacatatggggggcgtgggtggacaactacacccacaacgcggcggcccacaccctcgacgcgccgccctgtcggacctactctgcagaaacgaaacatgctacactttcggccgacaacgtcgaagccgcgcagaacattatacaacacgcggggctccctgcgggctaccgcggctccctccgcatacacggcgcacacacccccctctcggagacacgcccaccggcctccccaaaccaccacctcctcaaaatacgccggccctcccaacctagcggcgggcgatctcaacggggtctcaccccaagcgggggcaaacagcgggggagaaacacagcgcaccacacagagcgagtgcggatacagaggggcgacacaacagagacgcggagacttcaacgcaccaacacaccggcaccccacgttgtatacgaaacgggcaacaatacaactacaaacactcaccccaagataagccgccccggcagccccatcagaccgtatcgacaacacacgacaacgtactacccagcggtccgggagcacacgcgcacacacacacatgtatgaggacccccccgccaacgcaacaaccacggaacccg

SEQ ID NO: 615296 - DNA, 121 bp, Homo sapiens
tgatgcacgcatctaagagagaggttactcacactatagaggcataagtggtatcagttttcatttttctaacttgtttaaactgtgttttataccagtgtttgcgcgtaagggccagcat

SEQ ID NO: 615297 - DNA, 236 bp, Homo sapiens
tcgcaggtgatctagaggatcccggtgttccctttgtctactaaaaatacaaaaagagccgggtgtggtggtgggcgcctgtagtcccagctactcaggaggctgaggcaggagaattgtttgaaccctgggaggcggaggttgcagtggaccgagattgtgccagtgcactccagcctggccaacagaacaagactccgtcttaaaaaaaagaaaaggagagacaaagggaaaca

SEQ ID NO: 615298 - DNA, 145 bp, Homo sapiens
aaagagtcatatggctgactactggataagagtagactagctgcaagtctaaagaaagggttgtatggctgagagtctggagaaaggggcatctgaccgagggctgaagaaaggttagtctgactgagttctggctcatgtcata

SEQ ID NO: 615299 - DNA, 753 bp, Homo sapiens
gtggtgttacaacagatgatgcttcgcaagaactcgtggaactcatctatcaacaggccacatctatcccaagatttctcttatatgggagctcgcctgtgtatgttacctgtcccatgcatcgtgactaattagccccacagcagtggcaacttccgccaatagctacttcaaagatgtcggagtgaatatgacagttcaaggatcaagctgcaagaaggggatgaagttactcgaaaacgatttcattgcatttgtactctttctgggagaacttgatcttaacctggagatcaagggaacaaatggacgggttacaagagcagatattcttcaggtttggtctacgagaatggctgaatgccctgttttctaatcctatggatgacaattctaatatgtgcagtaccaagttgttacagttgacaggatcagtttggaagatgcttggaaggacacccaggaacagatggatatggacagaaattattcagagagattgaaaaggttgtcctagatgtcaagagtgagtagagatgtcaaacagagtgctcttgaagctggtagaatctccggtgcaagtaagatggggggagagtcccatgggaatttcgaacctataagagaaggaaaccagaaaatgatcttaactatttttgattgaccaacttttataacatttgagggtgtgccttcatggagttgatcagattaccagacgaaataaccagaatactgaagagagggtttccg

SEQ ID NO: 615300 - DNA, 753 bp, Homo sapiens
accctgcgtttaaggagttcagtcccacagaggccactgggttccagtggtggctgttcagaaagcagaacatactaagcgtgaggtatcttctttggtgttgttggttggttttcccaggcaacaattttacgggatgctttattgaaaggttgaagtttctctaaagtaaatggttgtaactccatgggtcccctggttggtaaaccattttccagtgggcgatattattcccccctttggaccttctcttggttgcaatttccctttggggtttccttttggaggaactaaaaataggcggttgaggggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgggcctgagtaagagaatgcgtgatgccaataacttttatgttgtcgatcttgttcaaatcaggtactggtcaggggaacctctgggtctcccgggggttaaccttgttttatcccatgttacgaaacgagcc

SEQ ID NO: 615301 - DNA, 143 bp, Homo sapiens
  misc_feature (110)..(110): n is a, c, g, or t
attgtgagttatatggtgatgctgcgctggcggaagaatttattggtggcgatcgcacggacaatgaaaatggccgtctgagtcggctggaactggcacacggcggcacntgtttcttgaaaagattgaatatctggcggtgg

SEQ ID NO: 615302 - DNA, 930 bp, Homo sapiens
  misc_feature (432)..(432): n is a, c, g, or t
tgatccagccaccttggctcccaaagtgctgagatgagccagcggatccagccagaactatttaatagttgaatgaaatagagagtcagaagaatgcaagagaggagagatgacagtgtaatagagatttcagcagtccaaacaaaataaatttttaaaaacctacaggtatattttaagaaaataaatttcaacacaagtttaggttaccagtcaaaaaggctgagaccaagtagtccatcaagatatagcccttgggcgtggaagtacttaacttgaagatctgagatgagttagatcctatgggtatcagaagaactgggtgaaagatgtggttctgggtcaagaaatagggaaattaagaatgtagtatagatgtggacacatatttactcagaaagaaaaaaagatcctgatctaacggctcctttnggtagagatagggctggaggaagtgtaacagaaatacattaggtaaatacttataggtctactgacattctttggaaagaagagctagcatacccaaatttcaaactaatttggtgagagcaacatgcctctttttcttttaattcaagcaaaaatggtaactgggtaagtagaaactgtatcacttcaggcatagctatgtatggtgctcaccttactatgtgtcaccgatcccacatttttaccaactgaaggtgtggaaccctacttggccagtctatccaggtgctttttccactatcatggtggccctttctgctctctgctcacatgtgggcatacggcggattctcacacttcatactaccgggcacgctctgccggcaccagcactggctgcggccaaaaggcccccaaaggagatatgtaacggtgtgttgggccagggcgtcaaagaggcgcgcggaccactatcgccgacactcttgtgctccggga

SEQ ID NO: 615303 - DNA, 1145 bp, Homo sapiens
caagaccccaggtagacaggcagagacactgaggtaaggggaggagaggctgtggcaggagatgacagggttagaggccacacagtgactactgcattgttgctggtgacaaatgcccagagtttgtgtgtcagaggccaagtgcagaggacaaactgctctatccagtggggcagtgagagcatcggggagggaaaaggcgtgctttcggaagtgtgctggagaggcggctggctcccagaaatggctgtaaggatcgggaggctggaactcgcttctctcctcatcaagcacttgctgaactgagtgggtggtgaatgtgggcaactgggaatgttgaactcttacccatcccctggagccccacctccagtgcacgtgaacttccaggccaaacctagacgtctgtctcccctacttagaccctgttcctaacttgatggccatagagggcaaaggcccaagattgaggtttctttggagcccacagacacaaaacaagtacagatacagattagggaggaagttctagagtgttccctggaataataaataaatgggtgggtgggttacactgccttccttgccaccttctctcctcctcacttctgcttcaaaagcaggacccaaatccactcctccaatacaccaggctctccatcctgcacagtgctttcggtataagtgcgtcctttgggcccaaggggctatgatggttcgctgggcacacggagaacatggttggcatcgaaggccgtggctgggccacaccattgttacacacccgtgggatgtgacgtaacaagggggacaaaagaggaggagcaaagggcgcaccaggtaaagggagagccgcggaaacacgtcacggtgaaaagcacgcagaagcacaacagaacgagacgacacccgaaagcaacaccaccacaggggagaacaacaaaaaagaaagtacagccacgaacggagggacaaccaaaaaaaaaacagagcgaacaagaacggagagaaaacagaaaccaacaactacaacaacgatcgacgaacagaaacacgagcgacacaagcaaagacgaaagagagaaggagggagagaacagtcaatacagtaatgcagccccacctcttcgctcctctgtacgaag

SEQ ID NO: 615304 - DNA, 915 bp, Homo sapiens
  misc_feature (13)..(13): n is a, c, g, or t
  misc_feature (82)..(82): n is a, c, g, or t
  misc_feature (148)..(148): n is a, c, g, or t
  misc_feature (160)..(160): n is a, c, g, or t
  misc_feature (164)..(164): n is a, c, g, or t
  misc_feature (177)..(177): n is a, c, g, or t
  misc_feature (191)..(191): n is a, c, g, or t
  misc_feature (195)..(195): n is a, c, g, or t
  misc_feature (199)..(199): n is a, c, g, or t
  misc_feature (222)..(222): n is a, c, g, or t
  misc_feature (385)..(385): n is a, c, g, or t
  misc_feature (437)..(437): n is a, c, g, or t
  misc_feature (486)..(486): n is a, c, g, or t
  misc_feature (491)..(491): n is a, c, g, or t
  misc_feature (526)..(526): n is a, c, g, or t
  misc_feature (588)..(589): n is a, c, g, or t
  misc_feature (601)..(601): n is a, c, g, or t
  misc_feature (613)..(613): n is a, c, g, or t
  misc_feature (649)..(649): n is a, c, g, or t
  misc_feature (659)..(659): n is a, c, g, or t
  misc_feature (704)..(704): n is a, c, g, or t
  misc_feature (737)..(737): n is a, c, g, or t
  misc_feature (740)..(740): n is a, c, g, or t
  misc_feature (764)..(764): n is a, c, g, or t
tcgggcgcgggangcttccagccgaggagttcaaggccaaggtggaggctgtggtggagaagctgggggtccccttccaggngctggtggcaacgcacgcaggcttgtaccggaagccggtaacgggcttgtgggaccttctgcaggngcaggccaacgncggnacgcccttatctntcgggaacagcatntttntggnagacgcagccgaacgcccggccnactgggccccggggcggaagaagaaagacttctcctgcgccgttcgcctgtttgccctcaaccttggcctgcccttcgccacgcctgaggagttctatctcaagtggccagcagccggcttcgagctcccagcctttgatccgagtactttctcccgctcagngcctctctgcctccccgagtccagggccctcctgagcgccagcccggaggtngttgtcgcagtgggattccctggggccgggaagtccacctttctcaaanagccnctcgtgtcggccggatatgtccacgtgaacaggancacgctaggctcctggcagcggtgtgtgaccacgtgtgaaacagccctgaagcaagggaaanngggtcaccatcnacaacacaaacnccagacgccgcgagccgcgctaggtacgtccagtgngcccgagccncgggcgtcccctgccgctgcttcctcttcaccgccactctggagnaggcgcgccacaacaaccggtttcgagagatancgnactcctctcatatccccgtgtcanacatggtcatgtatggctacaggaagcagttcgaggccccaacgctggctgaaggcttctctgccatcctggagatccgttccggctatgggtggagccgaggctggggcggctgaactgccagttctccgaggctgagcctcgcccagct

SEQ ID NO: 615305 - DNA, 343 bp, Homo sapiens
ggttctactgaggctgggttatggtgggtgattagaggcctgccctgaccttaaaagtggtgggtcctaaacttcagtaagcaggttgaggagcatgtttaagaaatggcagactagaatgtgagggggcagccatcagatgggattccgagatattgtgacggcctcttacccgaaggactggtgggctagcttctcaagtgagagaggctgatggcctcacagcttgatccagagtcacagatagttgtgactcggcctgtaggaaattagagttcctcttactggtgtgccgccatctgaggcctaaagtctaattatgtcgcaaccgtggagaagccag

SEQ ID NO: 615306 - DNA, 242 bp, Homo sapiens
  misc_feature (182)..(182): n is a, c, g, or t
atggccgagagccgagcgtgacgtcatcggcgcgcgcgctctcgctctctctcgcgcgcgctgggtgctcgcgctccctcccttattctctctcgttttatctgtattcctggcactggcgaaaagctcgttgtctgcgatttttgccaggtactttttttttttttcctggaaacagagtntaagctcttgtggcccgggctgggatgtgaggggtgaaatctcggttcactggcaccctc

SEQ ID NO: 615307 - DNA, 736 bp, Homo sapiens
  misc_feature (185)..(185): n is a, c, g, or t
  misc_feature (456)..(456): n is a, c, g, or t
  misc_feature (525)..(525): n is a, c, g, or t
  misc_feature (561)..(561): n is a, c, g, or t
  misc_feature (597)..(597): n is a, c, g, or t
  misc_feature (617)..(617): n is a, c, g, or t
  misc_feature (631)..(631): n is a, c, g, or t
  misc_feature (637)..(637): n is a, c, g, or t
  misc_feature (689)..(689): n is a, c, g, or t
cggcccgcgggcggggacgtgggagcgctgaagtcaggctcccactctcggccgacacccctcatggccaaccgttacaccatggatctgactgccatctacgagagcctcctgtcgctgagccctgacgtgcccgtgccatccgaccatggagggactgagtccagcccaggctggggctcctngggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccantttgcccatggcctgggcgagctgcgccaggccaatcgccaccccaaatacaagacggaactctgtcanaagttctacactccagggccgctgcacctacggctntcgctgccacttcatccacaaccactagcgaagacnctggcaggccccagggccancctcctgtgcttcnccagancatcagcttctccggtctgccctctggccgccggacctcaccaccaccaccnggcctggccggcccttccctgtcctccagctccttctcgccctccag

SEQ ID NO: 615308 - DNA, 424 bp, Homo sapiens
  misc_feature (185)..(185): n is a, c, g, or t
cggcccgcgggcggggacgtgggagcgctgaagtcaggctcccactctcggccgacacccctcatggccaaccgttacaccatggatctgactgccatctacgagagcctcctgtcgctgagccctgacgtgcccgtgccatccgaccatggagggactgagtccagcccaggctggggctcctngggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcacgccttgaggtcattttcagccacacttggttacccttcttatctcaacccacactttggggcctttacaagggaactt

SEQ ID NO: 615309 - DNA, 955 bp, Homo sapiens
caccatgtcttccctcccctgtatgcccacccgccatgtacctgtctccctacccgacatgccccttgaacttgcctgttgccgctgctgttgtccccactgtctgtgtgactctgcgccccttcccgtagcctgcccgaccgctggttccgtgacgttcgctcagcgacattactcaattccgtcaagggctctttcccgtggcaccatctgcgcgagctctcgttccgctgttagtgaccctgaagctgctagtgctgggcgccgtcccgcccttcacgtcatggatgtccccacttctgtgaggtgtccagccgcctgattgccggagtcccagggtgctcgtgaagcttgtacataggaagcctaggagacaatacaactagtcatgggaatacgattaccaagggttggaagaccaacaacataggacatgaggcattcagcatgacactagggtacagagccaccatcacttggtatgggacataacagactgaactaggggataagagacacaaaagaaccaatgggtcatgggagaagcaaattatagcatagtaccagtagaagtcagtgaagagaatcaaccccgtaggtagaaaacgataacaaagaaaacaaatagcattagatagcacacataaagaacacacagaagaattagggataagataacaacccacacattaggttaacccaccaggagagatagatcaggacaccaacgaaaaattgacccaaagaccaaataagggatacatacaaataccatacagaattcattccattacacagatcataagaaattagcattgatagagagaacacatggacgacggaaaaaagaggacatacaacaagaaagagcgcagcgaagaaagccgcgagaaaattaggaacataaccagaagataacaaaaaagataacaaaaacaatccaaaacgacatccg

SEQ ID NO: 615310 - DNA, 438 bp, Homo sapiens
  misc_feature (326)..(326): n is a, c, g, or t
  misc_feature (386)..(386): n is a, c, g, or t
  misc_feature (411)..(411): n is a, c, g, or t
  misc_feature (426)..(426): n is a, c, g, or t
gaccacaggcaggtgccaccatgacttgctaatttaaaaaaaaatctgtagtgataggatctcactgtgttgcccaggctagccttaaactcctgggctcaaaggacccacccacctcagcctcccaaaatgctgcaattacaggtgtgaactaccacacctggtcagattttaaattccaaatgtaatgaatagggattaggatcgaggctctgtgattctaatttccatttaagaatgggggaggagggaagaaagccagaaacgaagctctgtccactcctataagagagtgctagaaaaattctacttcatttactcagganaattcatgaaagggggcttgttaacctgtttcaattattttgatagggggggaaaatttngcttattgagactttgggaaaactnccagggcctacatcnggagtgtaggat

SEQ ID NO: 615311 - DNA, 164 bp, Homo sapiens
atatttaagctgcagagatgcccatccctgccttcccacggttgtccagtaagggggagggatcattcgcattgttacaatatctcctgtacttgtcagtctggcaaacacactccccccaaaacttcaaccttccacctgccagtagcttccccttcttccca

SEQ ID NO: 615312 - DNA, 814 bp, Homo sapiens
ggtccccacggcgggcagcagcggcggggcggggtgaacgcggagggggcggagggagcccgcgcggcggctagcagctacagcgaaatgggggagacgtggttgacaccctggggtttgatcaccaagccgaagaacctgaaatgacgcctaggggacccccccaagaatttttccttcgagaatccggtggtgaagcaaacgccggaaaacacggggtgggggggttccggcgccggggggcccgggtttacaacccaattttaccgaaacatcagggggttccacagaacaatattcttccataattttccaaggctggaagagaagtctagtgtgtttaagacaggaacgattacgcggtggacttttgtgaatgtgggttgagaaggtggaatttacgacagagagagaggcaaggtccggtagtttccccacgggttccggtgggaaaaaggcgtgttgggcgtcaggagtccctttataagagcagaatgatgggcattatttgtggatcgacactttttattggacgggaagagggaaaacccagggtggtcgaacgcaagttttataaaaccagggggtcgggtggtcaaattcctgtgggcacaggaaacggaagggtgggtctgacagagttgttttttacaaaggatggactttacttagataagaagggttatactccattcgtaaaaattacgatttcgctgaatttgtgccaacgaagggggcaaaaagggtggactattatggatgtgatacgcccagtgaaagaacttctaactttaagtgttgtgacagaaactgt

SEQ ID NO: 615313 - DNA, 157 bp, Homo sapiens
cagaaagaaaagtcaaccaaatcagagggaaaacatgaaggtttctatagagaacttgttgatgagaaagctctgaagcacataacggaaattggcttcagaatggatgcatcgaggcaagcctttatggagaatggcatcatcttagatgcagcac

SEQ ID NO: 615314 - DNA, 987 bp, Homo sapiens
cgggaggctgaggtaggagaatggcttgaacccaggaggcggagcttgcagtgagccgagattgcaccactgcactccagcctgggcgacagagcaagactccgtctcaaaaaaaaaaacaaaaagtgtaagtggcattaaaagagaaactgggctctagctccataatattttaaatagggctttcccgtggctgctggaaaacttaggccagtaagcatctcttggcttaaaagtcctacaagacaatttgacaataatctcatggtccatgccaaaattctaagtactggtttttcttagcaaggtgtaacataatcaggaaacaagtgggtacaagttaaaacattcttgggatgatattcaaagccttattagcacgtgcaccgtgaataataggtcattttggcctcactcattttggccaaacgtacgccatttctaaggtaaagggaagttcttcaaagatagggctcatacgccttgtattccggtttaaagattggtaacgctcaatggggcaggggatactatatgggcacacttagtgcttctccatattagccaaccaccaagagctataatcctggggtgcattaattacacagtgtttctataacttgtggcttacccaattaacccgtgttcgctataactggcccacacttcggcaagtgggaacatatagtggtgacacataccattatgtgcaccacctgtcgaccgtaatcacagtgcacactcatatcactacgagaaccacggctaccctgcacgaacacacaccacacaataagcaacactacaaaacaaacaacaaacaaaccaaacacacacactaaacagacgattgggccgcccgccacctagcgacagtatcctcacaacacgggggcccacactgtcttgtccgcccttaccccgtcgtctcttgtgattcacacaggggttgcccattaagaatggacgtgttgtattaagactgcg

SEQ ID NO: 615315 - DNA, 186 bp, Homo sapiens
gacatagtttcactccagcctgggtgacaggagtgaatctctgtctcaaaaaaagaaagaaagaaagaaagaaagaaagaaattacatgggcaattggcctgggcttggcctctgttaatgagttgcttgggcataagaatatggtttagcttcatccttcccttaattcttgtaattacagtgtt

SEQ ID NO: 615316 - DNA, 863 bp, Homo sapiens
gaggacgtctccggagcactccgcatgcaacagtgatctaggagttaaactttggcgatgtgcccgtgatgttggaccacacaggtacttagaggtcgaaatccaccccttgaaaaatgaggaacagaaacatcggaggaaaatcgtgggaacatccagtcagagacaaatgaggataagcgctgaagaagcgcgcttccacagtcccggcatctcccggctgccgagcggtggcgtgttgcttctattacattgttatctactgactaatagtggtgtatcgtcctctcattcgatcatgccgtgttccagaccggtcggtgtaacagtgaatgtggaaggaatagacgtacagtgacgatgtgtatctaatgagcataatctggactgtggatgatataaacggggatcaggatcgcaaagatgtcattgttgcattaaatatgaatacaagaagaggaagcaaacaaattgttaggccgaatcctgtggtggacggataggctataaaacatcatacctgtgacacagtatatggaagaagtgctgatgtcgaggggcacaaaaggggtagtgaaagtctcatggggaggaagacacttgatggtaccataagaacggtggacattcgatggtaggtcgatgactatgggacccaacatgcaccaaagaaggggcagatgaagagtaaagcgttatgtagaccttgcaatgacttaggatgggtgaagaacgaacaaggaaatataggagttgcaggaacaacagatagagtacagagagaggagaaaaagtgtgatggaattcgaaaagatagaaaggcgtatacaggcagggaaattgaggatacatacagttgaaga

SEQ ID NO: 615317 - DNA, 955 bp, Homo sapiens
  misc_feature (72)..(73): n is a, c, g, or t
  misc_feature (99)..(99): n is a, c, g, or t
  misc_feature (121)..(121): n is a, c, g, or t
  misc_feature (134)..(134): n is a, c, g, or t
  misc_feature (139)..(139): n is a, c, g, or t
  misc_feature (141)..(141): n is a, c, g, or t
  misc_feature (155)..(155): n is a, c, g, or t
  misc_feature (165)..(166): n is a, c, g, or t
  misc_feature (168)..(168): n is a, c, g, or t
  misc_feature (174)..(174): n is a, c, g, or t
  misc_feature (195)..(195): n is a, c, g, or t
  misc_feature (204)..(205): n is a, c, g, or t
  misc_feature (211)..(211): n is a, c, g, or t
  misc_feature (254)..(254): n is a, c, g, or t
  misc_feature (256)..(256): n is a, c, g, or t
  misc_feature (276)..(276): n is a, c, g, or t
  misc_feature (305)..(305): n is a, c, g, or t
  misc_feature (739)..(739): n is a, c, g, or t
  misc_feature (745)..(745): n is a, c, g, or t
  misc_feature (831)..(831): n is a, c, g, or t
  misc_feature (943)..(943): n is a, c, g, or t
ttatttttatacatagggatgtgaaaaacgtgaaatgggtaaaaaaagtcagctgcacaaaaacacttcagnnaattctaacacagagggagcataganatggggggggtgggggttaggntgggggagacaanccttncntgctaagggctcgnggtccaagcnnanaaccanagggtgctctgggtggtgtcnaggaacatnnagtgcnggctccggggaggagggaacgagaagaagaaagggagagtcananaggaggctgcagatgagcangagtttattggactctggcctcgcgctgntgcttgatgaagttgatgagcccattggtagaagcgtcgtgagaggtcacttgagcactgccatcaagctcaggctctattttcttagccagctgctttcccagctccactccccactggtcaaagctgttgatgtgccagatgataccctgaacgagatcttgtgactcatacatggcgaccaaggctccaagcatgaatggtgtgagcttggtgaacacaatagagttggttgggcgatttccttcaaagaccttatgtggcagcagcctctcaaggtcctctggactcttgcccgcagcctggagctcctttcgggcctcctccgtcgattttcccctcatcagggcctctgtctgggccaagaagttggccaggaggatcttgtgatgcagacccttccgtatggggtgctgggtctggaccgggatgangaagtnacagggtatcatcttggtgccttggtggatgagctggtaaaaagcatgctggccattggtccctggctccccccacacaatggggnctgtctggtggtccacacggggttccagatttggtgatgtatttcccattggactccatgtcgccctgctggaagtacgcagcaaagcggtgcaggtactggtcatagggcncatggcgtgtgt

SEQ ID NO: 615318 - DNA, 526 bp, Homo sapiens
gacaaacaaggggagggggtcccgtgatgggatcaggcagatgcccgcctggccgctcccccttaggggacttgggctcctcttaacattgacaggccggtataaacccccgggtcggatcgagctatgcctgatgctgccttaagccttatgaggtcgccacggaaccgtaggtgagggcccacttgaactccgtagctttcgccgtggagctacaaactggaggacaagcgcaagcccttgtcctcccccattcattcaccattcacacagagtttataacagtttttcttttttctttcccagagattctccaagaaacctgaacaaggaaagattagagatagaaaaagagagagagagagaccagtcttgccaaaaccaggacttatttccccagcatccttggatgtggactgacttcagggatggcccctgtcaggggcactttccttcctaacagagaaacataagcctctaacctaaaaccatggctctaccctttagcatcctaaaaaatgggcaa

SEQ ID NO: 615319 - DNA, 144 bp, Homo sapiens
tatgtgaagctgtttcctaatagttggacagacagactgcacgtatttcagaatacaacatcatgtctggtccgacatctgtggccctggcacaagaaggttcatgtcatcttcaactacaagggcaagaaagtgctagggcgg

SEQ ID NO: 615320 - DNA, 262 bp, Homo sapiens
agttatgatggaggggcggagtcgctcatactctgtgctttagatccacatctgctggaaggtggacagcgaggcaagtgatggagccgtcgatccacacggagtacttgcgctcaggaggagcagtgatcttgatcttcattgtgctgggttgccagggcagttgatctccttctgcatcctgtcagcaatgccagggtacatggtggtgccgcctgacagcactgtgttggcgtacaggtctttgcggatgtccacgtca

SEQ ID NO: 615321 - DNA, 639 bp, Homo sapiens
  misc_feature (265)..(265): n is a, c, g, or t
gcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttgggtaaaaatgggggtctcgcttgtgttgggccagggctgggtctcgaatttccttggcctcaacgattcgtccttggtctcggcctcccaaaggtgccgggattgacagggcattgangccaccgcgctgtggcccctttctttgagaatgtgggccctcctttgcgtttccgcgtttcaatgtcgccccggtgcatacttttttggggagagcccacaagggcttgatagcgtgttgggatgagacctccttctttttcgcccccttttcttcttttaacccatcaaattttaaagcgctttgcacactggtgcaagacgcccccggccatgtggaagaagacacgcgccggctggcgtagattactcgagaaggcagacgaaagacggggacgggtggtgttgctgggggctcccacaccccaagggtgcgtgttgtacggggccttttcaggcaggttccacatctcctgtgggtggttggttgcaccc

SEQ ID NO: 615322 - DNA, 572 bp, Homo sapiens
gtcatgccttgttcgtagtgctcagataggagacggctgttctgacggctcctgcttccccattcctgtgtagggaagacagacttagccactggtatctgtgggacttcttggaactctgaatgccagaccttgcccagtgctagaggcgacaagtgtgtgaagttgaatgaggcttctcccaccctgctcagctgcagtggacccgagcgggcagagagagcagagtgcagcaggggccaggctgtgctcgcaggcggggcaggtgccctggatgagcatggcgcccctgggatgcctctgtgccagtgaacgggcattgtgcactggcaagtgtgccggtggaccaagtggcctcagctccagtgtgttgaccgagggtcccaaggcactcacgtgtgtggggatgttagcaacacaacggcgtggaagccccgtgattgccaggttgctcaaccaaaggcgtgtagcaagaacccaggcaaccgacacaggtcaggggaccccacacagggcacagagccccacacagcccacacagggcaggaagcccgacacagggcacagagcca

SEQ ID NO: 615323 - DNA, 319 bp, Homo sapiens
gctgccttgaaaatctgaactccttaatgccatttccttcagcaaaacaggcatctcttagagtgtcaagacaagacccagagtcttggttcctgtgtttgctccctgagtgaaaaatcatgcttcaaattgattcatagatctggcaaataccactgatactagcagctgtttgctaatattctgaatagagcttgccacagagagttcacggatttaagacatacttgaaaaaaatttgaaatgatttcattacatgaagaaaaaaataggtattgcagcatcctgttaccaagaaataaagatagaaaaataaaaa

SEQ ID NO: 615324 - DNA, 240 bp, Homo sapiens
gtcttaacgtgtcttaagatctctgtcgcaacaagccgtagttccgttttcgggtggaaacgaaaaatacctttcgtaatgaaataaatttctctgtcttgttaatgcgtaaaattagatggaaacagaattaaatgtcgtccataacatacttaaaattggagaattgtttgagggtttagacccactacggaactgtcactactcttgctaaagtggtgtagactcacgtctctctgc

SEQ ID NO: 615325 - DNA, 281 bp, Homo sapiens
gaggagcggatggagctggagaacatccggcggcggaagagggagctgctggtggagattagcgccttcgggaggagctcagtgaagccatgagcaggtggagggcctggaggcaatcaggcagtagaccttcaacgacccgaagatggcatggcagaagagttcacatgccccaagagggtatcagttcttggtggagataactcttcagacacaccgagagtccccttcctctcaaggccgagtctcacagacacctcggctctactcgggagaggagt

SEQ ID NO: 615326 - DNA, 235 bp, Homo sapiens
cacgactcaccttatccatactagtatatcgaaccatcagcctactattcaaccaatagccctggcgtacgctaaccgctaacattactgcaggcacctactcatgcacctaattggagcgccaccctaggcaatatcaaccattaaccttccttacaatattcactttcacaaattctaattttactgactatcctagaaatcgctgtcgccttaatccaagcctacggtttca

SEQ ID NO: 615327 - DNA, 1071 bp, Homo sapiens
  misc_feature (148)..(148): n is a, c, g, or t
  misc_feature (248)..(248): n is a, c, g, or t
  misc_feature (431)..(431): n is a, c, g, or t
  misc_feature (929)..(929): n is a, c, g, or t
gctcacgttttagcactcgagccccaggacttcatccatgtgacatggcatccgattcccaagacgaccgagactgtcaagatcatcactgactgtgattgggaacactcctgagtgatggagcagacgagctgctttctaccaatcnagcacctgggcccagagcaagcagtcatgctaggcactatcatttgctcaaggctgcagtcgagccgtacaggctaggtaacctggtaacatagatgtcntggtgaaattcgcctgtaccttaactgcttcatggtaatcttttcttccacagccctggatgccctggtgggcagactcgtcccttctgtggttcctttgccttgggtgcctgcagaactccagtgggtctgggcgttgcagcgcagtgtcgtagctggctcgtcctcgtcttactcttctcncagacttttagattcttatcaatcatgtcagtgtatcagcgattccttgattgcgtttgggtccccaccaaaagccgcttattagctatggttggctgttggtgcctctttaatttgggcgttacacgctaggatgaccttcccctactgtttcctcgcgcctgccagggctaaggactctcaaagctaagtggacttgtctcgtgtacgccgcctagtagcctctcggggcattctggtaaacccgaaccaatattgcgcaggaaaacgcaagaactgtgcttcgctttgggcgtgttcacgccagttgttggtcatcaatggctttcacgccaccttgtgggtggccgaaacgggggtccaagggacgcctttggggctttccttggcgggttgcagcgcttttggggggcttatcgtggacactgcagaccgaacgcagataggcaaaggagctacaaaggaaatctccctgattctccttaaggacgcatattnttcttaaaaaaagcccgaaggaaggtaatgctctgaaagcccccacttttccgccttacacaaaaagtgtgccgctcaagcgtccgcttttgcgacgttggtctcttggatgggtttgtatgtacacccatttctccacatg

SEQ ID NO: 615328 - DNA, 1337 bp, Homo sapiens
  misc_feature (3)..(4): n is a, c, g, or t
  misc_feature (19)..(19): n is a, c, g, or t
  misc_feature (43)..(43): n is a, c, g, or t
  misc_feature (51)..(51): n is a, c, g, or t
  misc_feature (67)..(67): n is a, c, g, or t
  misc_feature (100)..(100): n is a, c, g, or t
  misc_feature (117)..(117): n is a, c, g, or t
  misc_feature (177)..(177): n is a, c, g, or t
  misc_feature (211)..(211): n is a, c, g, or t
  misc_feature (213)..(213): n is a, c, g, or t
  misc_feature (225)..(225): n is a, c, g, or t
  misc_feature (318)..(318): n is a, c, g, or t
  misc_feature (361)..(362): n is a, c, g, or t
  misc_feature (364)..(364): n is a, c, g, or t
  misc_feature (398)..(398): n is a, c, g, or t
  misc_feature (410)..(410): n is a, c, g, or t
  misc_feature (484)..(485): n is a, c, g, or t
  misc_feature (498)..(498): n is a, c, g, or t
  misc_feature (523)..(523): n is a, c, g, or t
  misc_feature (541)..(541): n is a, c, g, or t
  misc_feature (620)..(620): n is a, c, g, or t
  misc_feature (693)..(693): n is a, c, g, or t
  misc_feature (699)..(699): n is a, c, g, or t
  misc_feature (712)..(712): n is a, c, g, or t
  misc_feature (853)..(853): n is a, c, g, or t
  misc_feature (873)..(873): n is a, c, g, or t
  misc_feature (900)..(900): n is a, c, g, or t
  misc_feature (921)..(921): n is a, c, g, or t
  misc_feature (1079)..(1079): n is a, c, g, or t
  misc_feature (1264)..(1264): n is a, c, g, or t
agnngccgggccctttctncgggcgacacctctgggttcaggncagccgcnccctctctcgccgctncgcaggcaccacactatatacaaattctcagtngcacattccagataggncacctagatataacgtcttaatcactaaccctctacttcaccccgcagagacgctccggncgcgcccgccacgacacaccacagtcgacagacncnacccgcgtcatnccatatcacatgattgcagcgtgtgtatgatctagagtagaagagctagtggaaatcgtagctttcctgctcgtatctctgctcggcgctccnctctatatgtgcggcgctgtgcgtcatctccgactgcaccatnncncacgcgacgcactacgtgaggcggagcgcgatancacagatacgantgtatcatcacgacccttaccccgtctgagtcgtacacaccagacaacaccacgcgacagagatacgactcgannctcttcctctccntgcttcttcctctcgcaacgtccgngcccgatggtattatgtncacgagcatatgagtattacgccactatctacactacatgctccttcactatctacatttggtattctagatatatacncataatgagaggtaggacaaagtacaacccaaacacatttcacacaatctcttcttctatcatacatccctcnagaagncagtgaactgcancatgttgacgacacatagatgtccccatatgagtcctcaacatctcgtcatactgtcgcgtcggctccctcggctatggtcgtgtaagtataggatgagtgcagaggaagacggcgagggagaagacagagaaagcggacncatacagacagacacaagangaagctacgaaacacactcagcagtangatctctcagtatcgttgacngctctgctccacatctcctctcgtatcagtctagcgacacacgctctccgctccgtaccgcacctcacgccgctactctcatttcctgactcattctcttcctcgcacatcttcacttctactccttccactcgcacgctgtagcagcgcgaccgcgntaactacctatagtcgctctgttcgtctctatagctacgcgtctctctcaataatccttaatgtcagtcagctgtcgagtatctagtgtgttttgtcttactctctactcggcttgtcgtgcgtcgtcctcgtgatgcgcgttatagatgaccgtacgaacacgatcagagtagtaccgttacancacaacgacacacgatgacacaacatcaccgtgtttacgcgcgcgctgacgcatcataagaatacacgattat

SEQ ID NO: 615329 - DNA, 470 bp, Homo sapiens
tcaacatgctatattatcatgacaggtttaaaggtctttgcagaactacgaaagcctatgtcaagtgtcaaggataaagtgagtcaggtgtacatgaatccagaggcctggaacacaatggtactcaaaaacatagctgcctcggggaaattctccagtgaccgagaagcaatgttaaagaatatgcccaaaacatctggaacgtggaaccttcagatctaaagatgtctctatccaatgatatctaacaaagtcatatggaaattgagactcgtatggaagtgtctctagaaaacataagctgcttactgaacttgaacattgttacaacattcactggtttaagtatgttagctaatagtcgtataagtaggttgagtgtctctgggaatggggagggaacattcctatgtgatagagcttataaataaagggtccattctccaaggaaatcattgactaacaaagcg

SEQ ID NO: 615330 - DNA, 371 bp, Homo sapiens
  misc_feature (49)..(49): n is a, c, g, or t
  misc_feature (316)..(316): n is a, c, g, or t
  misc_feature (342)..(342): n is a, c, g, or t
ccctttaaaacacctgtacctcaaagaatgcttttccgaattgtgcccnagtctccttcaagattgtccccctttttaaaatttgaaaattagcccagatgtggtgccttacaccctgtaatccccagcattttgggaggctgaggtaggcagatcgcttgaactgaggagttaagagaccagcttgggcaacatggtgaaacctcgtctctacaaaaaatacagaaattagccaagtgtggtggtccacccctgtagtcccagctgctcaggaggctgaggcgggaggatcgcttgcacctgggaggtcaggacntgcagtgagccaatgtcctcaccacntgtaatccagcctgagttacagagtgaga

SEQ ID NO: 615331 - DNA, 363 bp, Homo sapiens
  misc_feature (4)..(4): n is a, c, g, or t
attntggaatttttttcaatatatttgaaaacagatggagctttgcaaattccctttgaagtcacaaacctacccagagtttacctcaagaagagaccagaaaatcctgaatagccctaataaaatcccataaaagtcacagtgaaaaatttttctgcaaagaaacccccggttgcctgggtgtggtggctcatgccctgtaatcccagcaactcccagaggctgaggcaggagtattgcttcagcccacgagcttgaggttgcagtgagctatgattgcgccactgtactccagtctaggtgacagaggacaatcctgtctctaaaataaagaataataaacaaacaaacgaaaaaccaaca

SEQ ID NO: 615332 - DNA, 104 bp, Homo sapiens
gtggtggcctgcggtgtacacctcatgtgaccgacaccacaccccaagaaccaggcatacagtggatgatatccataaatatgaaacctggtgctgtgccctac

SEQ ID NO: 615333 - DNA, 216 bp, Homo sapiens
  misc_feature (178)..(178): n is a, c, g, or t
  misc_feature (180)..(180): n is a, c, g, or t
  misc_feature (182)..(182): n is a, c, g, or t
gacaggcggacagggccggggtcacgtgggcccggcgaagtgtccctcggtccctccgcccgccacgtagcactgcccgccccctccccggcctgctaccccttggttccgccgccacgtcaggccgggcgcaacgcgacggggtcggcggcgcggaataggcaaggccaggtcgacncngnctacggagctgccgcactcaccttcttgcggtcc

SEQ ID NO: 615334 - DNA, 308 bp, Homo sapiens
cacgaggctcactgcaacctccacctcccgggctgaagtgattctcctgccttagccacctgagtagctgggattacaggtgtccaccaccatgaccggctaatttctgtatttttagtagagatggggtttcaccatgttggccaggctggtttcgaactcctgacctccagtgatctgcccaccttggcctcccaaagtgctgggattacaggcgtgagccaccatgcccaggtttcaagtttccttttcatttctaaaacctgcctcagaatttcctccccaatggtccactccaacatttgata

SEQ ID NO: 615335 - DNA, 279 bp, Homo sapiens
gaggctctctgtgggtccctagtggggaaaatgactcctccccacctacagtcttggtcagcagccccactgagctgtgttcatgtcgacttccagctccaaccttatctcctgggtcctgccagagttgacctctctgttgcgggcattcttgttctggaaaaggcagcgcggtgactcgcgcgtccggaagaccaggtccagggtctcagtggctggaactaatttcccactccattccccttcactccgttacagctcctttttggaatgagggga

SEQ ID NO: 615336 - DNA, 1390 bp, Homo sapiens
ttggggggaaactacttgggaccggttttccagcccgccctctcggttgcacgccatgggtgtatactcgggggggctctctttgtcgctgcccgcggcggtttccggccacccttttttttgcccccggcgtctcccggagttttttcgcctgtgttgtcgtaagttgtcccgccgcctctttcgggtgttatacccggggggtgtgcagcgccacccaaggttcactagtgctccacttctctgttgtgggtactcccccggctcctcgggtgttcccccccccccccatgggtgccttttaagggaggatataaaaaaggagacattttggtgggaaaaaaaggcgcccctagaaaattggggaatagaaatacccccccccctctggcttataccccggggaatattcctttggagtgaatattgatggggcaaataaattgggggacacacacagagggcgccctgcgcccaaaatgtagaggtttatgaccccccattgtatacagagagggaaaatgaaaaaggtttgggggaggcgactacaaaagtgagaggagggtgaaatagaataaagaaaaggggttgatattgcggtgaagaggacaagaacagcgatatcgggagagagatgtatacagaaatttgtgagggagaactctcgaggttccacactctatccgggcgccaacacgcgggcccacacctgagaagaatagagatgagaggagattcaccgagatggtctgagtgcccccgcagagacgcccacgagaaggccccgcgcccgagaggagagagactctatacacccacgccccacaaaaagagagaataagtgtttaaatctctataaaattaaaatagagtgtccgccctccggagacctcatatgtgtcacaccgctctccacacttgtcccgctgtctctcacgagagttctataaaacgctggggtgcaccctctttcgagagtatagagagagaggtcccgccccgcgcccacccgcgtgggccacagtggccacacccccacagatgaacaccgccgcgcttctccacccacacccacacccccacacccactgaggagaatttgcacacaccagcgggagaggagaaaaaagagaccccacaaacttcccaaggccctcgcttttttttcttaaaaagtaactttaaaaaaggaaaatttgttttgtaattttttaatttaccacttttaaaatttttgtacacacataattgttaagggtcacacccactttttaaatgattctcggaatgacccaaccagccttcggagcgttttctgtcctacttctgactttacttgtggtgtgacccagttcccttataatctccaaggagaaaaaaaaccccttgt

SEQ ID NO: 615337 - DNA, 706 bp, Homo sapiens
gagacaaatactttgtatttttaatacagaaaagtatgcctcggctcccaaagtgctggaattacagacatgagccactgtgcctggcctgctcactttctgatgctgctttttggtgttggttggttatttgttggtcttgagacggagtctcgctctgtcaccaggctggagtgcagtggcgcaaatctcggctcatgtgcaacctccgcctcccaggttcaagcgattctcctgcctcagcctgcggagtagctgggactataggtgcgtgccaaccacgtccagccactgatgctgtttgccactgatgctgtttgaaatgatatttggtctcataaaaactaggccaggcatggtggctcattcctgtaatcccagcacttgtgggaggccaaggtgggtggatcacctgaggtcaggagtgggagatgagcctggacaacatggaaaaaccccacctctactaagaaattacaaaaacagaaaaaatgcaacaaaaatttatagtagtggcgccagggggtttataacactctcgaggcagagaaatttggttatgggcaaaaagagagattcgggtgtgacaaggggtgggcccataacttaagaggggggattaaacctgtacagaggtgggtgttctaccggaatgtttttgaagtttgcgtattttacataggtgggataatttcaattggttccc

SEQ ID NO: 615338 - DNA, 619 bp, Homo sapiens
  misc_feature (23)..(23): n is a, c, g, or t
  misc_feature (99)..(99): n is a, c, g, or t
  misc_feature (101)..(101): n is a, c, g, or t
  misc_feature (122)..(122): n is a, c, g, or t
  misc_feature (140)..(140): n is a, c, g, or t
  misc_feature (146)..(146): n is a, c, g, or t
  misc_feature (156)..(156): n is a, c, g, or t
  misc_feature (171)..(171): n is a, c, g, or t
  misc_feature (173)..(174): n is a, c, g, or t
  misc_feature (226)..(226): n is a, c, g, or t
  misc_feature (255)..(256): n is a, c, g, or t
  misc_feature (318)..(318): n is a, c, g, or t
  misc_feature (349)..(349): n is a, c, g, or t
  misc_feature (383)..(383): n is a, c, g, or t
  misc_feature (389)..(390): n is a, c, g, or t
  misc_feature (393)..(393): n is a, c, g, or t
  misc_feature (395)..(395): n is a, c, g, or t
  misc_feature (397)..(398): n is a, c, g, or t
  misc_feature (400)..(400): n is a, c, g, or t
  misc_feature (411)..(411): n is a, c, g, or t
  misc_feature (417)..(417): n is a, c, g, or t
  misc_feature (425)..(425): n is a, c, g, or t
  misc_feature (436)..(436): n is a, c, g, or t
  misc_feature (441)..(441): n is a, c, g, or t
  misc_feature (448)..(448): n is a, c, g, or t
  misc_feature (495)..(495): n is a, c, g, or t
  misc_feature (501)..(501): n is a, c, g, or t
  misc_feature (506)..(506): n is a, c, g, or t
  misc_feature (522)..(522): n is a, c, g, or t
  misc_feature (584)..(584): n is a, c, g, or t
cgcgggccagtgccccgcggcgncgggccgagtgcgtttggggggggttgtggggcgcggctgcctttttctggggggggggcggccagcgtgtgcccngnggctcgctgggcctgtgtggncgcgcggcggtggcgggnggggtntctgcctgtngcttcctttcgctcngnnctgtctcctcgtccccctggggttcgccccgtttccccgggtggcttggggnggcgtttgtgcttggtttttgttgtggtnngtgctgttctgtgtttttgcgattcggacgggtgaggggccttgttgtttagcggtgggggngccaggggctctgtctccattctctcatcanacacaagttatgcatctaccaaaaaaaaaaaaanaaaaannctntncnncnaaaaaactgtnctctgnggaggcanaggtgttaaanataangaacctncagctcagattcaacaggcacctgccaagtccacactcaggactgtnaaagcntcaanaacatgaggtccaganacattcactgtggaaggctctgcccacgcgaacaaagctgttagctctagcaaaagggacantgccttcttcctccctcacttctcacctggtaagc

SEQ ID NO: 615339 - DNA, 169 bp, Homo sapiens
tgccggaccagctgattgcttttggtgattagtcaaagagaacaaatcccatatctcgatccgactcctccgactcttccttggtttcaaccttagctggggctgcagcatgcagcatggagcatgctgtggtggcagcagccacagggtgcagcagccacaaatggca

SEQ ID NO: 615340 - DNA, 118 bp, Homo sapiens
cagaggaccctatcgcggtcggcggcgatcttttttgctggaactttagcagcagcagcagcagcagcagcagcagcagcagcagcagcagcagcagcaacaacagcagcaacaacag

SEQ ID NO: 615341 - DNA, 912 bp, Homo sapiens
  misc_feature (757)..(757): n is a, c, g, or t
gtcaccatgagcctctggcagcccctggtcctggtgctcctggtgctgggctgctgcttatgctgcaccccagacagtcgccagtactcacccttgtgtctcttccctgggatgacctgagaacgcaatctcaccgagcgaggcagtctggtcatgaggaatacctgtagccgctatggttacacttcgggtgagcatggagatgacgtggtagacgtctgataaattctctagggcgctctgcgacttgtctgactgtctacccagaagacagactgatccctgcccacgagatcctggttgagctggaatatgcgcactacagctgaatggccatgacgaaaccccacggtgcggggtcccagacctgagtgcatgattccaaacctttgagggcgatctcaagtggtaccaacacaacatcacctattggatccaaaactactcggaagacttgccgcgggcggtgattgacgacgcctttgcccgcgccttctgcactgtggagcgcggtagacgccgactcaccttcactcgcgtgtacagccgggacgcagacatcgtcgatccagttatggtgtctgcggagcactggagacgggtatcccttcgacgggaaggacgggctcctggacacactgcctttcctcctggccccggcattcagggagacgcccatttcagacgatgacgagttagtggtccctggtgcaagggcgtcgtggtccaactcggttggaaacgcagatggcgcggnctgccacttccccttcatcttcgagggccgctcctactctgcctgcagcacctgacggtcgcgtccgacggcttgccctggtgcagtaccacggccaactacgacaccgacgaacggttcggcttctgccccagcgagaaatctacaccgggagg
